United States Patent 6,812,339 (POLYMORPHISMS IN KNOWN GENES ASSOCIATED WITH HUMAN DISEASE, METHODS OF DETECTION AND USES THEREOF) - sequence listing, part 74

SEQ ID NO: 16971 - DNA, 97196 bp, Human
  misc_feature (1)...(97196): n = A,T,C or G
tggtcttcccgctgccacccctgccatgcgggacccccggggctgagggaggggctgctcagtggctaaccctgaagggtagggaatgctgccccaacccacactccctggggctccactgccccctttctccgggaatagctctgtgcagggcttgggtttggaaatccacccacatggggccttgccttgctcaggcctgcttcatgcatctgtcttctggaagctcatttcctgagtgctctcaacactcacacctgtgccagttgcttgtggagaattttagctgtgaaccagggtggcccaagctgttctcaggtgacttgtgagaaagggattgagcctgtaattttgggtagaagaaccccagaaagggctggatgggcccttggaaggtcgttgccaggcctgggttttcagggttctgcacccctgggctgaggctgaggcacccgtcctgttgggcactgggtcgagccattggcccccccacagcgggcatcagatgctcacaggggctcctggctgcctcctgcaaagtcgggtggtgctggagcaggtctgacctgcttcccagggcctgcttgcctctgggattagaggaacctgcacaagaccccaggggctgtgctgaggtggacagctgcctgaaagatgagcgtgtgaacagaacatgctggtcttaaggcagagagtcccacaccgtggaccctcccgtctgatgctggggtcttcgtttccagcgtggagccatcctcatcccgtgcagggtggaccgcctgcctggggagccacctgcagtctgggtccccttgcggtgccactgcgatctctctagagcctcctcttcctcctgccactggggacatctctgcccctctgcttccctcggaagctggttgtgaagccgggccagtggctgcggggacagctcatggccctggaaagaccccactggcatgcggcacaacatctgctctgagaactgcaggaaaaggccgggcagggcacccctgccatcctgccagtgaagtttacgggtctcggaatgagtgtggccaaggggcaaaggggaggagggagagggggaggtggggttgcctgagagtgcccgccccaggacagcagcccgtagctcagccccaagagcccggcaccgagcttcgagctgcgtggccccgaagaggggctcagtcacctaatgtgatgaggggacggcagagcaaaggcttgtctgacagtgaccgtcgtgtgtagtggagaggacgtggccagagatctggtttcagggcagggatgaggggggattccagtcagatcttttgcatcccagcaaccctccccttgacacctttggggcagtggcaggggatgaccatggatgacctcatgagaacactgtgggtgtcagggactcagggaggccccgcagggcttgaacatgcttatgtttctcatttgtaaagggagggcagtcatccggtggcttcttgtggcctcggtgatgaaggccacatcagagccagggggaaaggatatgagagaaaaagattcatttgaattattgtctttttcctggagtggagagatgtggtactccccaaaacttcctttctaggctgggcacagtggctcacgcctgtaaaaccagcactttgggaagcggaggctggtggatcgcctgaggtcaggagtttgagaccaacctgaccaacatggtgaaaccctgttgctactacatacaaaaaaaattagcagggtgtggtgattggcgcccataatcccagctactggggaggctaaggcaggagaatcacttgaaccagggagaccgaggttgcagtgagccgagactgcgtcactgaactccagcctgagcgacaaagtgggactccgtctcaaaaaacaagaagaaaaagaaacttcctttgtggacagtgagggctatttaaaaaaattttggaatatgaaagtagtcactggtgtctggaagcaggagctgtgcagaattgtacagttgcgaaaccatgtcgctggcagctggtgctggcggtggagacttccctgtgcggtgctcagtgcagctgcacccgtgggggagggagctctttctctggccctgcagtcacctgaggttgttaccattatgaacggccgctgggacccccgcatgtgcatgtactcccccagagtgtccgggggccccagccaagggacacagctcaggcagctgggaacatgtgcaggctgatgaagagaaccggatgagggcttcacatgaggaagcatgtggccaggtcctctcagaacatcagcctcatcttcctgtctctgatctatttcagcaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaaggtaggctttctgctggtcagcctgcagttggcacgtggccacggaggtcaccgttgggcaggtcatagcttgaggctgtgacgacgggggtgggaaagggtctgctgaccttgggggctcctgcccaaccatacctttgggagaacagaactggggagggtgatgcgtgtctcgtcttctgtgggttgcatgaccatttcccatggttggtctgattgggaaatcaccgggttaactcaaaaatgttgcgctagagtcctggaaatctgttacccgtgcttaccttgttgcataatgatttcacatcctttatccgattgggagggcctgggcctgggctagctttccccaaagccctggatacaaagacacaagtatgttgaaagcacatggcatcttgcagtccccttgccaggcaggcaggagggtggctgccctttttccgatggtgcaagatccaggtccccagatccccagcctccacgttttccaccacaccatgttgttcccaaggaaggtggtggtgctgtagaaactgtaaagtgcgcgcacattcaaaatggtcccaagaggaaatgatttcttagattcattcctccctcctgaatccccaccggagagtcttggcaaggtgcttctaatctttggctcagggtcgcgcaggcttccttccttcaagcaaatagtgtgaaagctcctcaaggagctcagatgtgtctccagggggctgggtgtgctctttcgaatgttggaagatctcagtgtgctgtctttaccttcagcaagaaagcctcagttcgtggattcctgaaaacatcaagaagaaagaatgcgtgtattttgtggaaagttccaaactgtctgatgctgggtaagtgacgtgatttgtgtgtaagacctctgacttcttccttccgatcccacatggagtagctgatcaggccaagacccctcagggcctcagtgaagggtcactggagatacctctgtctccatacgaggcttagagtccacagagcatttccacctaacccttgcaagcctcctgtcggggacagttgaccctcatcctgcctcgcaggtgcagggaccaaagtgcagagtttaggtgacttgttcagggtcataagggcactgtcgcgcggcgaggcccagtggtgtgaacacagatgcatcctctaatcctctcatttccacacctgcccccaccccaagagagagagtcccagggtccaggaactggaagggccttagggagagtccatggccagaagactgcccccctgcacagcttgccaaagccagaggcccgacttgcccccaggccccacagagccccctttgcccctcctccccacagagcccacgactcaggtgtggccaagacccccgcccaggcaacatggccactgtctctgagtggctggatatggccctccggagccgatggtgctccccgcagttggcgcccctttaggcacggacagagtgttgattcatgtttgtgtgccctccccgagcaacacccatttcatgctcttccacaaatgggccacacgcttcctccttttactccattgcctggtgagctcctacttatccctcaaggcctattgcagatgctgcctctgccgtgcagccttccgtgactatacaacctctaccaggaagtgagcttccctcctaccgcaccgtgtgtttctctttgatcccagctgtcgtgctgtaactgtgtggctttgtgttcatctttcttgctagctgctgagcttctggggggctgggacgaaagcagagtgttgtgttaattcccagagagtggccttcagctcatatttactgaatatggggagggagaagcatcctgtgcttgggaaatagaagaagactgtgttgccccagggtacctctagtgtactcggtacatcatcagagtttcacggtcaccaatacaacagctgtccctccgcatccctggggaattgttcccggacacccacggacaccaaaatcccatatctcgtatcagtcccaaaatctcatatcaagtcactgatatgagatggtgtggtatttgcatataaactatgtacatccttcagcatactttaaatcatctctagattacttataatacctgatacaatgtagatgttataaaaatagttatactgcatttaaaaaatttgtatttttgggccgggcgcggtggctcacgcctgtaatcccagcactttgggaggccgaggcaggtgatccacccgcctcggcctcccaaagtgctgggattacaggcgtgagccactgcatctggctatgttatttttaattgttttttttttcctgaatatttttagtctgcgtttggctgaatctgcagatgcaaaactcgcggccatggagggctggatgtagagacagtgatgaagagccccatgtggaaggagcggggtctgtagagcagtggtactccagcctcggagctcacccttgttactggaaaggggtcccgatccagaccccaagggcgggttcttggatctcacacgagaaagtatttggagcgagtccacagagtaaagtgaaagcaagttattaacaatgtaaaggaataaaagaatggcttctccataggcagagcagccctgagggctgctgcttggctattttttttttttttttttgagacggggtctcgctctgtcgcccaggctggagtgcaatggcatgatcttggctcgctgcaaccttcgtctcccaggttcatgcgattcaccatgttggccaggctggtctggaactcctgacctcaggtgatccaccagccttggcctcccaaagtgctgggatttcaggcataagccaccgtgcttggctggttggctatttttatggtagttttggatcatgtgcttaacaagggtggattattcatgagttttatgggaaaggagcggggatttcccagaactgatttcctctttctttcagaccatacagggtatttctgatgttgccatggcatctgccaactgtcatggtgctggtgggagtgtctcttacatgttaatatgttataattagcgtgtaatgggcagcgaggataaccagagcccactttcgtcgccatcttggttttggtgggttttacccagtgtcttgcaccctgttttatcagcagggtctttgtgacctgtgtcttctgctgacctcttgtctcatcctgtgacttagaatgccttaaccgtctgggaaggcagcccagcaggtttcagcctcatttcacccagcgcctattcaagatgggactcactctggtttgaacgccgctgacaccctgacctgctgtgtcctgagaagcctaggtgaggccccgtgggtctggggcctctgccagtcggctctgcgtgcttctcacatggaagtggaaacccttggggcagcagggcccagagaggaaggggtgctgacctggatcagatgtaagcaggacagacttgcttctggaggtccccaaagccatcccccatgctcaggggtttgctaggactcacagctgtgcacacagctaaggtttatcatggtgaaggcctacgtgatgggcttggcaagggagaaagacacaggccgagtctggagaatctgagggcaggctgctgcggctctcctgtgcaggcgccatgcatgctccttcctctagccgagaagcacgtggccacctgcaaagcccattcgaggctcagagcccagggcgtgcatcctgcgctggccacgtgggcccctctgcatggcaaccacccaaatcccagactcccagcaggaaagcagctgttcagcacaaacccattgcaggaacagtccaggcccggcaaagcactcctagcagtcaggggacggagagacgctccaaaagccccgttcccagacaccaccttgaaagcaggcccctctgagaaggcaacctgagatctgctgcaccgagtctgtcccgcacagaagccgctctcatctcaccaaccacggtggtcactgcagcaggatgggaagagggaccaggtgtgttcctggctgttccttcctgaggagtggatggaatgtccctccttcttgtggaaagaccagggcggaacgagtggtgagcatcgtctgccacaaacacagcttttcaagcagatttatttataccacttacatgtttccattaagcatggtagggtcttcctaccccactcgtccagacctggagcccctcgacacccgcccgggtaatcccactgcttagccccacgtcctggtaaccctcctcagctctgcacagactcgtctcatttccgtgtctgctgtggccaccctggtccagacctttgtgctcacattttgccaccatggatctcatgaccttgggcagatgacttctcttccctgggccaccaatcctcatctgtgagcgcagagactggaggggatgcctcagaattcacgcgcacatgcggtgggggtggggaggcagggagccccccttgggtggcaggaaggagcccaggttggagagaatacacctccaagagctctcatttcccgtggggtgccgggggtggtgtcccgtttacgcctatctgggccgagttccgagcgagctctccggcgatgtaatttctggatcagtgtccgcaatgcagtttccagcatcacatcaggcttgcaaacgccatgcaggttcaagttccaatctcatcagaggtgatcgttcaaggacaagagggacaggaggtagcttgtgataggctgttaggaacatacaaggacatttggggcagcattggagcaagacgggagagctcaggtccttgtctagggaactcctttccccacctccgacccaggtctctcatccataaacagtggaggtcacattgtgtccggagttggttccttcccgggggtcttggtctcgctgacttcaagagtgaagccggggaccttcgcggtgagtgtcacagctcttgaagatggcagggacccaaagagtgagcagcagcaagatatattgtgaagagcgaaagaacaaagactcctcagcgtgaaaggggacccgagcagtttgccgctgctggctggaggggtggccagcttttattcccttatttgtccccgcccgtgtcctgctgattggtccattttacagagcgctgattggtccattttacagagcactgcttggtccattttacagtgtgctgattggtccattttacagagcactgcttggtccattttacagtgtgctgattggtccattttacagagcatggcttggtccattttacagtgtgcggattggtccattttacagagcaccaattggtccattttatggtgtgctgattggcgcattttacaatcctcttgtaagacagaaaagttctccaagtccgcacccaacccagaagtctagctggcttcacctctcaacatcaggtgctcgcaagatccctgcaagtctgaagtgccttgagcgtgaccttaggggtttgtacggatttggatttgtagggtgcacatccgggaggaattattttttccattttaatgattgagaaactgagtgtagaaacatccgagatcacacagtcaatacgtggcggggaaacctgtttcctttctcactgctcagtggtctttcccctgtgccatctggttcaggtttcatctggttttagagtttttttgtttgtttttttttaattcccttatttgtccccgcccatgtcctgctgattggtccattttacagagcgctgattggtccattttacagagcactgattggtccatttttttcctgtctcatctgtgtatatatatacacatatatatgtatatatatatatattttttttgagacggagtcttgctctgtcacccaggctggagtgcaatggcctgatcttggctcactgcaacctccacctcccgggctcaagcgattctcctgcctcagcctcctgagtagcggggactacagctgtgcaccatcacacctggctaatttttgtatttttagtagagacagggtttcaccatattagccaggctggtctcgaactcttgatgttgtgacccgcccacctcagcctcccaaagtgctgggattacaggcatgaggcaccatgcccagcctcatctgaacttttctaggttatttgttaccagcaaaaaattggaatctaaaaatatggtggatttccaattaaacaagttacaaagaacacataaatttatctcttcttgccctgaaacaccaatgaattgcagtaaagcaaaaaaagacttcaacccacaaagaaaaaagagggaagttagcagttgaagaaagagattgccgcattcttgccagaggaaggggaggaggcagagtagcaggtcctgaaggctggcgactcgggcagctcctgccgtccccaggcgaggggaggaggtgggagaccttgggcgaggtgctagccccatgtcgtctgcttggagcctccatttgtgtgtgcttttaactttttattttgaaataattacagatgtacagaagttccaaagatactgcagaagggccccacggttccccctgtggctacattctgcataactgtagtacagtacccaagccaggaattaaagctggtagaatgcatgtgtttagttttatgtctttttttttttttttgagatggagttttgctctgctgcccaggctggagtgcagtggcaccacaccagctcactgcaatctccgcctcctgggttcaagcaattctcctgcctcagcctcctgagtagctgggactacaggtgagcactaccacgcccagctaatgtttatatttttagtagagatggggtttcaccatgttggtcaggctggtctcggactcgggacctcaactgatctgcctgcctcggcctcccaaagtgctgggattacaggtgtgagccaccgctcttggccttatgtcatttttcacatgtgtatttgtgtaactaccaccgtggtcaagatacagcactgtccatctccaccgagctcttcctgtacttcctccgtatggtcagctcaccttctcccccatcatccctgatccctgcaaccaccagtctttcttcatgcctatcattgtgtcatttcaaggatgttacgtcaatggaatcatacgctacatgacccgtgtctttttccctcagcacagcgcacttgatatccatccaagttgctgcttgtgtcaatattattattattattatttttgatatggagtctcattctctggagtgcaatggcacgatctcagcttactgcaacctccgcctcccggcaactgggagtagctgggactacaggcatgcgccaccacgcctggctaatttttgtattttcagtagagacagggcttcaccatgttgtccaggatggctttgaactcctgacctcaaatgatccactcgccttggcctcccacagtgctgggattacaggtgtgagctaccacactcggcgttgtgtcaacattatttaactgctgaatattcctttccctttcgccttgcctgtgtcattacacttcaagtgagattttggtagacgtcaaataattgggtcctatttttttaaatacattctgtcaatctgttttttaattgtcatatttagaaaatttatatttagtgtaattattggtatgttagggcttatgtctgccattttattttttgttttctgtttgttctgtgttttttttttgccttcttgtgggttacttgaacattttttagaattctattttgattattcatactatttttgttttttggagacagagtctcactctgttgcccaggctggagtacagtggcacgatctcggctcattacaccctccacctcgctgggctcaggtgatcctcccacctcagtctcctgaatagctgggactacagacatgcaccaccatgcccggttaatttttgtatttttggtagagacaaggtttggccatgttggccaggctggtctcaagctcctgagctcaagcaatctgcccaccttggcctcccaaagtgttcggattacaggcgtgagccactgcttacaccatactatttttgagtgtatcttcttgtatcactttttcttaaaggggttgctctagatagtatattatataatacagcttatcacaatctgctgatgttgacattttaccagtttgagtgaaatatagaaacattatctccttttacatctctgtccccttcttaatctataatataattgcttgaaatatttcttctacatatattgaaatgagggccgggcatggtggcttaagcctgtaatcccagcactttgggaagctgaggtgggcggatcacgaggtcaggagatggagaccatcctggctaacacggtgaaaccccgtctctactaaaaatacaaaaaaaaaaaaaaaaagccagatgtggtgatggccgcctgtggtcgcagctacttgggaggttgaggtgggagagtggcgtgaacctgggaggcggagcttgcagtgagcagagatcggcgccactgcactctagcctgggtgacagagcgagattccatttcaagaaaaaaaaaaaagaaagaaagaaaaccatgtcagatagtgttataatttttgcttcagccatcaaacatcagttatgaaattcaaggggttactctttttgttattctttcttcctttcagatatttcaaaattccttttcttgtttcctttctgtttagagaatgtcctttagccattcttttagggtgtgtctgctcgtgacaaattccctagccttccttcaattaagaaggtccaaacttcctgtcttttctgaggtgttttttttgttttttttgaggagtctcccactgtctcccaggctggagtgcagtggcaccatctgggctcactgcaacttccatctcctgggttcaagcgagtctcctgcctcagcgtcccgagtggctggggttacaggctgctgccaccatgcccagctgattttttagattttagtagagacagggtttcaccatgttggccatgttggtctcgaactcctgaccttgtgatccacctgcctcagcttcccaaagggctgggattataggcgtgagccactgcgcctcgccgcttttaaaagtttttatttgtttttagtttttggaagtttaactgttgtgtgtcttggcatgtatctctttggatttatcctgtctggtgttcactcagattgtagcgtgtgtaggtttatgtcttttttgtcaaatatgggaaattttggccatgacttctttacatacattttcaggatcactgtctttttcttttccttctggaactctgagcatgaatgtatgatcttttgttatagtgctgcaggtcccagaggttttgtttacttgtgtattttttctttgttgttgtttgtttgttttctctctgttgttcttattgggcaatttctactgttatatcttcctgctcctgggttctttcctctgtctcctccatcctgctgttaggtccatcctttgagttttttatttcggttactgcatttttcagctctaaagtttgcatttggtatatcttctctttttttactggaaatttatattttttcatttgttttgagcatgttcatgattgcttgttgaagcatttctaatgtggctgctttaaaatcattttcagataattctaacatctgtgtcatcttggcgttggtggctgttagctgtcttttttcatcctggttgagattttcctgtctcttgttaaaactagtgatgtttgattgaaaccttgatagtttagattttatgttaagagactcaagatcttgagttttagctggtcctcttgacatgtctatggtgaaggaaggaggtccccccatcactgccccacaaagggtgaagtctaagcccccctgtagcctccactgatccactgacacttcctggggaggcttcttgttactgctgagggtgagaagagctccagcccaccattaggcctttgctgcctcccccatggctggaagggcaggtgctttgtttttgctgggtgggggaaggttgcggctttccactgggcctcctctgatgccttcacagggagcaggaagggcaccacactccctgggtgactggtgctgtgtctttgcaggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaaggttggtttccatcactctcgctctgaactgtaggtggagctgcatggccccacagtgacacgcggtggtcggcatttcctggggcaagagcaggaggctggcaaagctccagggtgcatagagcccactgcacagcaagggaagcggcggggaggggctctgcaaggcaagcaagacatgcaccccactctcagagtgcttggccatctgcaaagcagggtggggcacagtgagctttctaggaaggtgcaagctgggagtggtgagtgaattctggctgggtgtccttgggcggcatttgtcagggcctgggagggagtagggaggaaggagagggatgcaggacacagatgcgctcagggtgtgctgggagaatggtaggaagggtgtggggagggagggaaaagctgggggaaggggcccaggatagcagggaggcccatgtggcaagtctggaagcaaacgcgagagtccttgcgaggagtctgggccaggcatggcgggatccaggctgagcctggcctgcaggagagcgctgtgagggtgcagactgctggagggaggcccaggtgcagggttaggttctctcgtgcacaacctcactgaggtccctggaccagccatctctgaccaattctcaggccccatcccaggcctgtggagtcagaggctcagccccttgcatgttgaccagccttctggagggttctgagactcgcgtgttgaccagccttttggagggttctgagactcgcgtgttgaccagccttctggagggttctgagactcgcgtgttgaccagccttctggagggttctgagacttgtgtgttgaccagccttctggaggttctgagacttgcgtgttgaccagccttctggagggttctgagacttgcatgttgaccagccttctggagggttctgagacttgagtgttgaccagccttctggagggttctgagacagtgattgggtgccactgtcctggaggtggggagggtggcactgatctctgtgctggcgtctggagccctgaacttggtacctgtcgagtgtgacctgtccactcaatgcatggtgttgccatgaggtggccaaagaggttgagtggggcaggtcccggagacggggtcatgtggccccaggcttcctggctggcacagcccctgagccaccctgtgtcaccatgacacgtgggtgttctccaggcccctggacccctctgtcgctgtggtcacggggacagtcctgttgttgggtttcagatgagggattgaggtatggggaggccctacctaccctttgtctgatgccaccgtggccgtggcagtggtgggtttgaatccagctgtgtctgagcctggggtctggctgcatccctcccccaaccccccggcttctcccagccccctccctgcagctgccgacaggggccggtggtgtgagggagaaatgcctgtggcctgacagtgagggacgccagggacacagaccctgtactgcagcaggtctgcctcgaagcccgggagcgtccaccatgcaggccacagccctgctcctcccagggagaccagcacctccagatgcctggtggacccggtgggacccacgttctgatggtgacaggcactgtgcttgtgggttaactggaccttctttagtgacaatgccaccacatggttgttttgagggcacctaatggcatttctggatttcacccatcacctttgtgtctctgctaggccaatcccggcggagattgcagaccccgctgggtctcttcagacacagcccgcctagcggaacagggaaagtccgctgtgtacttgggagggtctcctggaggacggggggccagagtgacgacagaacctgggagagccgtgttcagacgggaggcagaggaagctgggcccactgagtccccaggacgggccagggcacaggggccacagagcagaggggatagggcagaggggacaggagaggggacaggagaggggacaggagaggggacaggagaggggacaggagagggggcagtgctgggtgcacaaggacagaagggcagagaccccggtgcaggagctgattagacccgggggaggcagggcccaggcgctacggcgggaattggagtctgtgctggcgcatgtttgggaggcgctcccaaaatcgagaggaagaggaaaaagtgggtgccgtgggggcacgagggctgggggaggtttgctgagggcgatcctggtccccaaaggatggcctgatgctcctggcttgggcctctctgcctccctcttctctcgtgatctgtgccctgcccacatggggaccccttttctgggtctgagccggaaaggtgtgcggtgtctgccgcccgctggggcctctctgcatggcctgtgtgggtcggtgctgtccctgaccactgacacacaggttccctccgccgttttccctttcccgcagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggtaactcggaggctggagggacacgaggccccggcgggtggggtgggctgtggaggcagtgctggggcaatcagggccatcaggacccaaaaagtccctgggagccgccgaggctgtgccccagcctgagtcggacccatgcacctctcacctgggcacagctgctccctgacgcccgatgctcccactggcttgcctgtgggctggagatggctcagtgcatggccctgctggtgcccagggccaagcagagatgagaaccttggtggcctgggaaccttggtggcctgagaaccttggtggcctgggaacctcggtggcctgagaaccttggtggcctgggaatcttggtggcctgagaacctcggtggcctgggtgcacggctggggccagcactgcaggccatttgtagggggtcagcgagagttcccagtcatcaagctttccattatcgtgtttttccatcaaaatcagggaaggagcattattatttccatctcttcacttaaggcaactgcctggttggagtcaaatcacctcccaaggttgcaccactggtgagagccaggcagggacccagtcctggtggatggtgtgagatcccaggtgccgtgacctggtgccccgccccaccctaattccatggggagggggccccaagtcctcaaggctccctgggcctccctggaggggactgtggatgaatagtgaggccctgaggtgactacttggcaatgttgcgtccggatgggcctagagtcaccctgctcttcctggggtctggggtctggtctttgcctcgcagtggagtcgtaactgagcctgacttggcctgcatggctcacagagtcctcagtttcattgtctgcctggtgagcgtgaggcacggctgcatcttttgacctgtgagtcccacagccctgcttgtaaaatgaccagaccttttctcagcctggtcacatgggactgggtttaacgcaggtcaccatcccacaggctctttctgaagctttgctgcctcaaataatgccatggatttgttcaggtctcacctgctccaggtcttgatgttgcatttttttagctttcaatatccgtgtccttgttgtccgcttcctggcccaaagccagtaccaccttttcaattgttatctttctatctatctatctccatccttccatccatccatctatttatttttgagacagggtctcagtctgttccccaggctggagtgcagtagcacgatctcagctcattgcagcctcgacctcttgggctcaggtgatactcctgcctccgcctcctgagttgctgggactagaggcgtatgccaccatgccaggctaatttttgtagagacaaggtctatgttgtccaggctggtcttgaactcctgggctcaagtaatcttcctgccttggcctcccaaagtgctgggataacaggcgtgagccaccatgcctggctgattggctgttttttttatttttttgttttttttttggagttggagtcttgctctgtcacccaggctggagtgcagtggtggtggcgctatctcagctcactgcaacctctgcctcctgagttcaagcaattctcctgcctcagcctcctgagtagctgggactgcaggcgtgtgctaccatgcctggctaatttttgtatttttagtagagacggggtttcaccatgttggccaggctggtctcgaactcctgacctcaggtgatctgcccgcctcggcctcccaaagtgctgggattacaggcgtgagccaccgtgcccggccggaggtgtgtttcttacaggggtggctgcaaaccaccagcagcagatggcaggtgggaggtgaggggcatccttcctagggaccaggctgagtgttgggagcgaggaagcactctgccgcacctgggtcctgaaagctgggaggaagagggaaagcaaaatacaagaatgcagagaggtgctgagaaccgcgatcctgagactggggcctgaggaggcggcagggaccgggagaggggcggggcctgctcctgttcccaccccacctgagcgcgtgggaacctcggttccttacacctgatgctggtttgaaagcccctgagtgaggagctctgcgttgttgggggcggggcatcgctgagcctagaagggctcaggcgtcaggctcctgggtgtcagggtgcccctcagtgctgtggggcctgcccacccgtgctccttccccaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacggtgagtgcggccccctagggaggggagcctaagaccaggggtgtgggtgaggtctgactgggcgctgtggggagcaggtggagtgtacgggggccggggtgtgggtgacgtctgaccgggcgctgtggggagcaggcggagtgtgcgggggccggggtgtgggtgacgtctgaccgggtgctgcggggagcaggtggagtgtgcgggggccggggtgtgggtgagttctgaccgggtgctgcggggagcaggtggagtgtgcgggggaggcggggtgtgggtgacgtctgaccgggtgctgcggggagcaggtggagtgtgcgggggaggcggggtgtgggtgacgtctgaccgggtgctgcggcgagcaggtggagtgtgcgggggccggggtgtgggtgagttctgaccgggtgctgcggggagcaggtggagtgtgcgggggaggcggggtgtgggtgacgtctgaccgggtgctgcggggagcaggtggagtgtgcgggggaggcggggtgtgggtgacgtctgaccgggtgctgcggggagcaggtggagtgtgcgggggccggggtgtgggtgagttctgaccgggtgctgcggggagcaggtggagtgtgcgggggaggcggggtgtgggtgacgtctgaccgggtgctgtgaggagcaggtggagtgtgcgggggaggcgggcacactcaggagattgggtgcaactcccggcccacccctgacccaggtgaccccggacaaacggctaacttggctggactctggtatctccctcaaggttgtaagaggggtccacgtgacagtcactcgctgcgagggttccgctaacagagcagagggagggggcgtggccagcaggcagctgggtggggctgagccagggcgatccgaccccgaaccggagcttttagcactttgagtccctgtactcagaggtctcctgcagccgggaatcccactgtgctgtggtccctggcagccagcacccacccccagcttctccgtcaaggttgaggacggagcactcctgcctctgattaactggacgcaggagaagcagttgctttaatccggagccttgagttgggacagataatgagtcattcaaccagattttccaaggacacactaactttggtatgatgcgtgtgtgcccctgaatccacgtggtcaggaaagcccagggaacactggcctgtgactcactgagcaggttcccttgttaccccgaggggtgatttactcctctgacagtgacacggacactgtgcgtccattccccgggcgggcagaggacactcccagatgcccacgaggggcccagcaagcactggccagccccagcccggccttcgccttcctttgcgtcagaatcatgaatgtgtccggcggggtcggactggaccagctgttgggctttgtttgctctttttacgaattgaaaaactgaagccaggagcggctgggtgacgtcccaggtcactccttactttcctccccacgctgagttcagacgacttcccgtgacaccactgttggtggcggaatgggactgtggctgcttccgctcagccacgctccctctctgtggacggcggagggtgtgtgtcccagcccggctgccgccctcccttaggtctgtctcccggggctgctgtaacccaggctcacaaacctggtggcttaaagcagcagaaacttagtctatcagatctggaatccgcgtcgattggccatcatccagccatcggtgttggcggggccacctccctctagggcctaggggaagagcattccttgctgcctccagcgtctgggtgctgatggcattccctggccagtggccacctccctccagtcgctgcctccgtgtcccatggccgcctccctccagtctctgcctccgtgtcccgtggccgcctccctccagtgtctgcctccgtgtcccgtggccgcctccctccagtgtctgcctccgtgtcccgtggccgcctccctccagtctctgcctccgtgtcccgtggccgcctccctccagtctctgcctccgtgtcccgtggccgcctccctccagtctctgcctccgtgtcccgtggccgcctccctccagtctctgcctccgtgtcccgtggccgcctccctccagtctctgcctccgtgtcccgtggccgcctccctccagtctctgcctccgtgtcccgtggccttctctgtgtgcctgtgtcaaatctcccccaagagttccgtaagaacactcgtgatggcgtgtaggtcccactagggtcatctagggtgatgccttcatatccagatctttaactgacatctgcaaagatgcttttccaaacaaggaaatgaggagcagcacttaccgggtccatgagcaggccttgatgtctttgggtggccatgattcagccaactgcggtcctccctctgacctcaaagatttctgtccactccacaggcaaaatatgttcacaccattgccagatcttggctgggtgtgggggctcacacctgtcatcccagcacattgggaggctgagatgggcggatcacttgaggacaaaagttcaagaccagcttggccaatatggtggaaaccctgtctttactaaaaatacaaaaattaactgggcatagtggcaggcgcctgtaatcccagctgaggcagaagaattgcttgaacccaggagctggaggttgcagggaaccaagatcatgccactgcactccagcctgggtgacagagcaagactctgtctaaactaaaccaaaccaaaccaaacaaaatgatcccctccaactacaaacctgttacagcagaaactccaagatcaaaatctcatgtaaatatcataagcttggccgagtgcggtggctcacacctgtcatcccaacactttgggaggccaaggcaggcatatcacctgaggtcaggagcttgagaccagcctggtcaacatggagaaaccccgtctctacaaaaaattagccgggcatggtggtaggcgactgtaatcccagctactgggaggccaaggcaggagaatcgcttgaacctgggaggcggaggttgcagcgagccaaggttgtgccactgcactccagcccaggtgacagagcgagacaccgtctcaagcaaaacaaaacaaacaaacaaaaatatcatcagctcaaaagtcccaaatgtcatcatttaagtcagggacgctgaagactctgggtctgatccattctggggcagaatttctcttcatatgtgcacctgtgagaccagaaaacaagtcacctatctccaaaatacaagggaagagcaggtgtagcatcacagctgcagacactctcattcccaatgggggaacacgggaggaacgaaggcatcaccagccccaggcaattccaaaacccggcaggcagaatgcactaggtgataagaccggggagacccctctgtggcttgggcaccccctaccctgctctgtgtccacggccctgccttcaggacgatccttttccctgaaggttatagcttttagtctgcttgaagattttaaggagtctgacgacctttcattttatcccgtctctgtccctttcagtccaaatttgcagtgttgttgttgatataacatttgtgaaaaccttgcagtcctcctttgaatgccataggaatttctgccagtagacaaaaagggctctgcagacctttcctgtgatgctgtctccactcctggcttctgagatggttgagtgaattgcagtctccttgcctggtctcttcatcactagcaggaggttgtttagacacacccttggccctctctcttttttctttttgttttttttttgagacagtctcactctgttgcccaggctggagtgcagtggtgcgatctcagctcactgcaacctccgcctcctgggttcaagtgattctcctgcctcagcctcctgagtagctaggtctacaggcacccaccaccatgcccagctaatttttgtatttttagtagagacagggtttctccatgttggccaggctggtctcgaactcctgacctcaagtgatccgcccgcctcggccccccaaagtgctgggattacaggtgtgagccactgcgcttggccgttggccttctctttagagtctgcttttcgaacagtgaatctcttttcattttctgcattatatgcgacctgcattatatgcgacctgcattatatgcgacctgcattatatgcgacctgcattatatgcgacctgcattatatgcgacccggataggctgagaatttcccacatcatcaagtcctggttccattttgtctgtcagtttttccctcaatttctctctttccttttgcattttgtgagaagcagcaagaaaaaaaagccaggccacaacttgaacactttgcttggagatctctgcggctaaatcttcaagttcatcatttacagttctgctctccacaaaactgcacagcacaattcagccaggctttctgtcactctgcagcaaagttggccttccctccagtctccagtaccacatttcccacttccttctgagccctcaccagaagaagcaactgtgatgttcatttttctgctaaaattctgttcatgccagtatatgtattctctctctctctctttttttttttttgagatggagccttgctcttttgcccaggctggagtgcagtggtgcgatcttggctcactgcaacctccaccttccgggttcaagcaaatctcccaccttagcctcccgagtagctgggattacaggcatgtgccaccatacccagctaatttttgtatttttagtacagacggggtttcaccatgttggccaggctggtctcgaactcctgacctcaactgatctgcccaccttggcctcccaaagtgctgggattccaggcgtgagccaccgtgcctggcccgtatatatattttctaaggcagcggtccccagcctttttggcaccaggaactggtttcgtggaagagagtttttccacagatgggggcggggtggtaagcggttggtttggggatgattcaagcacgttacgtttattgtgcactttatttctattattacattgtaatatataatgcagtaatcatacagctcaccataatgtaggatcagtgggagccctgagcttgttttcctgcagctagacggtcccatcatctgggggtgatgggggacagtgacagatcattaggcattagattttcgtaaggggagtacaacctaggtccctcgcatgcacagttcacagtaaggttagtattcccatgagaatctaatgccgcggatctgacaggaggtggagctcggacagtcacacacacgatggggagcggctgtaaatagggatgaagcttcgctcgttcacccaccacccacctcctgctgtgagcagcccagatcctcacaggccacagaccattaccagtccatggcccagggggtgggggacccctgctctagggcaacaaagccctctctgccctgctcctcacttccttctgagcccttactgcgagttgttttttttctgagacagggtctcactgttgcccaggctggagtatgttggtgcgatcctcagccttgacctcccgggctcaagtgatcttcccatctcagcctcccaagtagctgggactacaggtgtgcaccaccatgcccggctaattttttcatttttgtagacatgagatccgctatgtcgtccaggctggtctcgaactccagggctcaggtgatcctcccgccttggcctcccaaagtgctgggattccaggcgtgagccaccgcgcccgtctccgcaaggcctttaataccacattcccaccaacattctcttcaaggacgttgagacgttttccattcatggtgcttctaaatcctcccgtcgtctccccattgccggtttcaatgccacttccacatttttaggtgtttgttgcagcagcagcccacttcctcaccccagacctgtatccgtttcctgtggctgccgtaacaaatggcctcaagcctgaaacagcagcattgtggtctctcacgtgtctggaggacagaactctgaagtcagggtcacacgtctgtttccccgcctcctccactcctggggggtccggctttctccacttgtggctatgtcacttgcccctgcctctgtggtccctcggcctcctctcctgtgtgtgtcccccaccacctctctcctgtaaggacacctgtgatggtattttgggcccactcggatcatccaagttaatctcatgtttcgatcacatgtgcaaagtcgctttctccaataaggccacgtccacagattccagggactgggacctggtctctgtgagggccggtgttcagcctgctcgcgttagagaggcagagctttccagaagcagtgtctgacgcttcctggccatcccagggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtaggggagcttgctttcgagggtgattgggcagagagcacagtgggctggtcagagtgtcaggtacagctggtcacgaccaggacgttcaacaggcctggcgtttggcagagagtgcagtgggctggtcagagtgtcaggtacagctggtcacaggtcattcgtggcactcggcagagagcgcggtgagctggtcagactgtcaggtacagctggtcacaaccaggatgttcatggtactcggaacgtcctcagaacacacctgggtttctttcccgtgtctctttatactttgttccaggagggtcatcttctcttgcccattttagccagtgggagggcggtctggggggctggcagctcacctgtgtgctcgcaggtaatgggccaacctacattttttttgggacagggtctggagcgcagtggtgtgatctcagctcactgtagcctcgaacttctgggctcaagggatcctcccatcaccctcccaaagtgctgggattacaagcttgaaccactgtgcctggccctacaattattttaaaccttgatcatggtctgctctcaggttcagaaatcagaatgtacgatagtcaaaacttaggatttgatacctttttcctcataggtgggatgggatgggtttgaggacgtcgggaggtcaagtgcggggttttgcatatcacttgaggagggttcaaagaggagatggtgaacgggaggtgtctgacctgtggctgggtgggctggggtcccttgcagggttccttgtgcatcgaactcccctggagggttcctcaccagcttgtgggccccagccccagggtccaactcagcagctccaggtgggctgagaacttgcattaggagcacgttccctggtgagggcgatgctgcagttcagggaccagggaccacactttgagaaccctgcttgactagtaggagcacgttccctggtgaggacgatgctgcagttcagggaccagggaccacactttgagaacctgcttgactagtaggagcacgttccctggtgagggcgatgctgcagttcagggaccacactttgagaacctgcttgactaggacatctggggtgggatgtgtgggtgagtgtgtgaagacgatgggcccatggggggctcacagacagagtttgctgcctggggaaaggggttgccaagtccttctcaggctccactgctgttgggctggatgaagttcagggtggggctgggcggatggacacaggatggacgtgccgcatgctgctcgcatccacgcgtggcaggttgtgccacctgcttggggcctcagctctgattgtccatagcccctctccctccctcccaagaaagcaggcaggggtggatgggaagcaagcgagcggggaagtgtgggtggcggggggctcttgagtctgctcattgatgtggaacaggcaggtcccctgggaatgtggagctttgactttaaacggcgactcagcactggcaagaggcctcccagcaggtgcttcagtgtgtggttaggctggagccagcagggggcaggggagagtgccctcagtgcagggtcttgccccccacctctgtcccctcactcggctccatgctttgttcaggtgtggccctcactcggctccgtgctttgtttaggtgtggccctcactcggctgtgtgctttttctaggtgtggccatcaagatccccatcgtgtgcgtggtgctggagggcggcccgggcacgttgcacgtgagtatggccaggtgggagggggcatgtgtgggcccgtcctgctgcaggcagatgactgtccaaaagtgcttgtctcagaactcaagactgttggcaagagggcgatgagctttcccaccagaagaagagaaagagcatctacgctgtgtcggggctgcttctgggtgggtggaggacgggtcggaggaaggtgcctggaggaggaggctgggcttggctatgactgggccattgaccggcgtggaaggaaagggtggggccccagggcctggagtgagtggggagcctctgctcccaggacctgctggggaggctggggggtttctacaactctgcccccaagattcctccaggaagcatttttcaaagtacagggctgtggcccccatcccagatccgtggtgccagcagctgtgtgactgcagatttggcaggcagcttgaatgcgctgctctgccggccttccttcccgaccctaaccctaactgctttgtggcgtgcagggtgcgaggtgacctcacctgctgtaggaatgtacgaggacatatagcctgaggatctggagcaagagtatgggcttttgtgaaggatgggatcacaggcaatgtcccgtttatgtttcatgattgcaggaggtcaaaacagagccttgggggcttgaggctggatgggaatccatagagcactgggtcctcactccctatgcgtgccgagtacccttcacggctcttctgctggggcggctgcacccgcctccttaccccaggccgatgctcatgcacacggcagagtccttcctgccagacagctttgtgtccagtcccttcccgaagtccagcacaccctggagcccaggtgccctcctcatggctctgctcttactgtgggcttttatgaggtcggtaactccaggtccatgcagcgtcccctttgctgcgaggccctcacgtctgcaggtccatgggcaaaaatgctgggagtctttgattctgctggagctgaggcctgagaggtgccaggtgtgcagcccccagtgtgttggggcagctccctcttcccccagagcaggggacgccacgaaactaataagtgctttcagtggatctcggagtagtgttagccagctctgcccttagctggccttggagaattctccatttcagaaagcatcggagcggtgaggacccagtcccgggctcacacccccacctgccttgcagaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaaggtgaggctgacgggcacgacggtcaccagcatgtggctgctttgcagagacactgtcagcctggtgggcaggaccaggactcatggaccgatgcggagaacccactgggtctgagtgggtgccagagcgatttgcagagggcagggcccaggtggtaaacctcctggctgggttccggaggtcagatcccaagacagcatgtgaaaggagggtgtgaacctcacccgcagcacaccagggcgggctgggaacgctgcggggctcagtggtgctgtgaaaagggtctgctggattggaggggtgggaggcaggcgctggggaggcctcagccgagtcgggcagcagggcagctgctgagcaatggctgtgggtcgcagggtccagtccagattgtagcctcataggtgagttaatggaggcatgtagagtggcctcaggaggggccattgccccagtccaggggtagattttgggtggcccctgccatgaccccagcctccagagggggtccgttgtgaagggccgtggttggccagccctggccaccccaccaagcccttgaccaggggggtgggctccagtggagagcctctcccctccctgtgcctgctgcttccagggtgacctgactcaattcctggcaggattctttgcaggggctggcactggggccttttcatcctcagtttcccagcaagccagggccggcagagccctctgtctgtgtctttcctgcagacccgggacatctccaggttctgagtggctgacatgcgctttccactgtgttgaatttgggttctgtgggcagtggtgacccccagctgcaggccgcagggacacacctatttggccagattgggcctgtggagagtggattaaaaatgagcaccctcaggaaccacgggtgtcggaagggctgggtggaggtcttggccccgttggccgattcagaagcagagtttctctgactggtgatttgtgggtggcacagtgaccttgtttccttctgtgctttgcgatggtctcagagtgacctcgttctgcacagatgtcttctgagagcgtttttgtccggcaggagaataacatgatgtagctgcaagcgtcagatcagtttgtgaaaacatcgtggtccggctgtgagcggccgctcagctccccatgtcagggcggctttccttccttcccggtgccattgggacttgtcgggcgggccctggagccctctctctgctggttgataaattattcaggcaattctcagaactgagtttaatctgctgttgttgaaaggtgcctatttttaatgcactctccatagccaagccaaggccctgaaagtggtgctttcacacacagccgtcaggcctcagcaggggctcggcattcgctgatgctcctgctcagtggggaggggcccagccatgcagccagggtcagtgcgctcctttaacacgccttctcagagtgtccgtctacactgtggaggagttgcagagctaccctcgggtgctgctgctggtgggcggccccgtcagaggggcccggggacctccctgcaggggctcacagctgtggccaggaagaagttgcccaccctcgctcagccttgcctttctcatctgttaagtaggggtactgagtgctcgactcagacgaggaaacgaggccctggcgtccatatgggctcagacgctgggagctgcttcaccctatgaggacagggcgggctgaagtccaggagacttttatgggctcagacgctgggagctgctttacggtatgaggatgggggtgctgaaagccaggagacctttggctgctggatgagggtggagttcgccagggagctcaggatgtgttttggagttgtcatgaaagctggaccccgagggatggggcaccgttggggtcttaggcatggaggtggagtgtgaggagccctccaggtgagggcagagtctatgtggaggcaatggggccaggctgcggacgaggagagaagcaggggaggccaggtgtggctggcctggggagccagagggagaaggctgaggcttactttgggagcagtgggagccatgggaagatgcgtttgtggagttgctcgccctggacacagggggaaggtgcttcaaggaggagtaactgtagtagacatacctgctagggatgccatgatggatggatggatggatggatggtgggtgggtggtagatagatggatggatgatgggtgggtgtgtggatggctggatggaaagatggatggatgaatagatggatggatggatggtgggtgggtgggtgggccatgtggatggatggatggatggagggataggtgggtagctagatgataggtagattagatggatggatggatggatagatagatagacagacaggtgataaaatggatggactgggcactgtggctcacaattgtaatcccagcactttgggaggttgatgcgggtggatcacttgaggtcaggagtttgagaccagcctggccaacatggtgaaaccacatctgtactaaaaatacaaacattatccaggcatggtggtgggtgcctgtaatcccagctacttgggaggctgaggcaggagaattgcttgaagccaggaggtggaggttgcagtgacccaagatcgtgccactgcactccagcctgggtggcagagcaaaaagtctgtctcaaaaaaaaaaaaaaaaagatgaatgaattgatatgatagatagatggatagatagatagatagatagatagatagatagatagatggatgatagatagatagtgggtgggaggtagatagaaagataagtggatggatgaatggttggtaggtgggtgtgtgtatggatggatggaaagatggatggatggatggatagctagacaatagatagatacatgtggatggatagatggatacatggatagatggataggtagatagatagatacatacatatatacatagatgaaacacacacatggatggatagatagatttatagatggatagattatgtagatagatggatagatgcatagatggatagatagatcagattatgtagatagatagatggatagatgcatagatggatagatagatagactgatcgatcgacagacagacagataaataagtagacagatagataggcaggtaggcaggtggtgaggagtggcctgggcttagcaggagggctaggaggagcagcctcgcatgaagctgcactatcgtcagggtgaagatccgttgcccttggattgtgttttccacccaacagactctcacgaacatgatgtatttggtccccatggatcttcatctgcaccatctagggcaagaggagatgtggtggtgtcctggccacaagcgcaggcaggacccaaggctctggctgtgtccggggcctcaattctatgtgtcctggaggaggcaggggttcaggagtcactgtgtgtctcacttagaaaatgcttgttgcagatccaagatatcgtccggaggcggcagctgctgactgtcttccgggaaggcaaggatggtcagcaggacgtggatgtggccatcttgcaggccttgctgaaaggtgagggtcagggaacatgggggcaatggggtggaggccagaacgtgagctctgaggacgccaagttctagtcttgaagtgccatgattctgggaaccagaatattcctccttggtcagaaaccctggccagagggcagctggcgacgtgcaggtgggcgcctgcctgtcacctgatgttagaggtatgagctcctttatttgtaactggaatccgagtgcagcctgtgtcatttttacctttgtagtggtcataatttctcataaaacttcagggtggaaagaaagagtgcagaagttgcctctctcaacttcctgcttgctggctgctttagctcctctacctctgatgcaggaaagagtgtagaggtagagcagggcctcaggaatggtgtgatggacttgagctgtagtggctctctgtgtaacttctgttgcttagcctggcccattctccaggccacaaacatcactgtcctcttctcatgccacaggagagaaggcttatgcctctttgtcttacccagctggcacctgacactgggaagccttggtcttatatgtgctcctcccgcccgatgctgggcttctcaccctccagggtcggaggccccaggctgattctgaagggctcagcagagtgggcccaggctgggatcagcagggaacttttgtgataaaggccagactttcatcttgtttctgtgttgatttgagactccccttatcaaggacttgatgttgtgcataaaacctcacacaaacagcgagatgatagactacatattagaccacaaattaagccttaatttatctctcaatagatttaagatagatattatacaaattatcttctctgacaacaagatgaagttaggaattaataatggatgtaaaagtggaaaattcacaaagttgtggaaactaaacgacactaccttacacagccaatggatgaaagaagaaatcaaaaaggaaatcaagaaaccaatgaaaacaaaagcacaatatatcaaagcttatgggacatagcaaaaacaatgctaatggagaagtttatagctataaatgcttacattaaaaaataagatcttaaaccaacaacctaactttacaacttaagtaattagaaaaataagaacaaatgaaatccaaaagtagcagaatgaaggaaatagtacagattagagcagagatcaatgacataaagaatagaaaattgcagagaaaatcaataaagtgaaaaattggttatttgaaaagatcaacaaaattgacacacatttagctaactggactaagaaaaaagaaagaagattcatattactaaaattagaaatgaaagtagggacattactcctgactctacagaagtaaaaggattctgtgaataattgtatgccaacatgttggataacctagatgtgttagtctgttttatgtgactaaaacagaataccacagactaagtactttataaactacctagtactttataaatcaatcactgaccatccttgccttcccagaggatggtcagcatctggcaaaattgaggggccagcatctggcaagggcctgcctcatgtcattccagaatggcagcacatacatgcccttccactggaaggcagaagggtaagggagcacacagatgcatgaaagagagtaagaaagcaagagggagctaaacttgctttttataacaagcccactcttgaaataactaacccactcccaaaataagacattaatccattcatgaaggctttgccctgtaatggatcacctctattaggccccacctcccaacattattatactggggattacatttacaacacatgaactttggggaaaacattcaagccatagcactagatgaaatgaacacatttctagaagcacaaaacctaccaagactaaatcataaaaaaatcaaaactctgaatagacctataagtagtaaggagactgaatcagtaataaaaaatctccccataaaagttttagggctgatagcttcactggtgaattctaccaaatgtttaaagaactaacaccaatccttctcaaactttccccaacaattcaagaaggaaggcttcctaattcattctgtgaggccagcattattctgataccaaagacagacactacaagaaaagaaaactacagaccaatatccattatgaacattgatacgaaattcttcaacaaaatattagcatacaaaattcagtagcattaacaggattatacactatgactacatgagatttattcctggaatgcaaggatggttcaacatatgaaaattaatcaatacaccacattaacagaatgatggggaaaaaacatgattatctcaactgatacatttgacaaaatttgacaccctttcatggtaaaaacattcaacaaattaggaataaaaggaaactaccttgatgtaataaaagccatatatgaaaaactcccagcgaatatcatgttcaatggtgaaagactgggacatagcaaaaacagtgctaatggagaaatttatagctatacatgcttacattaaaaaataagatcttaaaccaacaacctaactttacagcttaagtaattagaaaaataagaacaaatgaaatcttttcctccaagatagaaataagggaaggatgcatactttcaccacttccattcaacattgcgttggaagttcaagccagagcaattagacaagaaaaagaaataaaacttataaattgggaaggaagaagtagaattatttgttcacagatgatatgattttcgtatttgtccattttcacactgctataaagaaatgcccaagactgggtaatttataaaggaaagaggttaaattgactcacagttcagcatgccttggaaggcctcaggaaacttacaatcatggtggaagatgaaggggaagaaaggcactgtcttcacaaggtgacaggaagaagaggtgccaaatgaagaaggaagagccccttctaaaaccatcagatctcatgagaacttactaccatgagaacagcataggggaaactgtccccacaatccaactacctccacctggtctctcccttgacacatggggatcatagggattataattcaagatgagatttgggtggggacacaaagcctaaccatatcaattttctatgcagaaaactaaagattctacaacatacccctgaactaagaaatgaattcagcaaagtagcaggacacaaaatcaatacacaaaaatctgccacatttgccaggtgtgatggctcatgcctgtaatctcagcactttgggaggcggaggtgggcggatcacgaggtcaggagattgagaccatcctggctaacatggtgaaaccccgtctctactaaaaatacaaaaaattagctgggcgtggtggcgagcacctgtagggcatggtggcgagcgcctgtagtcccagctacttgggaggctgaggcaggagaatggtgtgaacccaggaggcagagcttgcagtgagctgagatcatgccactgcactccagcctgggtgacagcaagactccgttcccccaccaccaaaaaaaaatctgctgcatttctatacactaaaaatgaataatcagaaaaggaaattgtgaaaacaattctatttacagtagcatcaaaaagaaaaaaaatactgaggaattaattaaaccaagggggtgaaagacttgtacaatgaaaactgtaaaacattgctgaaagaaatgaaagaagacataaataaatggaaagacatcccatgttcatgaattggaagccttaatattgttaagatgtcagtactactcaaagcaatctacagatccaatgcaattcctatcaaaaccccagtgatttttttttttttgcagaaatagaaaagcccatcctaaaattcatgtggagtctaaagggatcccaaacagccaaaataattttgaaagggaagaacaaagctggaagactcacactttctgatttctaaactcactacaaagctatagtaatcaaaacagtgtggtaatggtgtaaagaaagacatagagggctgggtgtggtggctcatgcctgtaatcccagcactttgggaggccaaagtgggctgattgcttgagctcaggggtttgagaccagcccaagcaacatggtgaaaccttgtctctataaaaaatataaaagctgggcaaggtggttcatgcttgtagtcccagctgtgtgggaggttgaggggagaggatcacttgagcccagaaggttggggctgcagtgagctgtgattgcaccactgcactccagcctgggcaacagagcaagaccctgtctcaaaaaaatcccaaaaagatatggagaccaatggaatagaatagtgagcccaaaaataaaccctcgcatatatggtcaaatgatatttgacaggaatgcaaaaatcattcagtgaggagagggacagtcttttcaacaaatgatgctggataaactggatatccacatgccaaagaatcaagttagacccttacctaacaccatatacaaaaactaactcaaagtagatcaaggacttctgaatataagacctaaactcttagaagaaagcacagggcaaaaacttcatgacaaaggatttggcagtggtttcttggccatgacacctaaggcacaggaaacaaaagaaaaaatagataaattggactttatgaaaattaaataattttgtgcatcaaaagatattatcaacagagtaaaaaggcaacccatggaatgggagaaaatatttgcaaatcatacatatggtaagggattggtatccagaatatatagagaactcctataactcaacaataaaaaaaaaacacaattcaaaaatgggcaaaggacttaaatagacatttctttaaagaagtcgtacaaatggccaataagcacgtgaaaagatgctcagcatcactaatcattagagaaatgcagatcaaaactaagagatatcatttcaaacacattaggatagctactatagaaaagaacagaaaatcacaaatgttggccagtgtgtggagaaactggagcccttgtgcactgttggtggatatgtaacatggtgcagctgccgtggaaaacaggatgacagttccttaaatatttaaaaatacaattcctatatgatccagctattccactcctcagatacatatgccactccccacccccaaatttaaagcagggtctggaagagatatgtgtatactcatgttcatagctgcattatccacaatagctaaaaagtggaagcagcccaagtgtccattgacagaagaatagataagcaaaatgtggtctatacctacaatggaatattactgagctttaaaaaggaaggaaattctgacacatgctgcaacatggttgaacccttaagacattatgttaagtgaaataagccagtcacaaaaggacaaatactatatgattccagttacaagaggtccctggagtagtcaaattcatggagacagaaagtagaatggtgggtgccaggatctgggggagaggtgaatgaggagttaatgtttaatggggatagagttttagtttccaagataaaaagatatatggagaaggacagtgatgatggctgcacaacattatgaatatacttaagaccagtgaactgtacgcttaaaaatatttggctgggtgagctggctcatgcctataatcgcagcactttgggaggctgaggtgggaggatcacttgagcccagcctaggcaacatggagaaccctgtcactacaaaaaaaaaaaaaaaaaaaaactagtcaggcatggtagcacacacctgtactcttagttactcaagaggctgaggtgggaggattgcttgagcccaggacgttgaggctgcaataagccttatgattataaatatgatcacagcactgtgctccagcctgggtgacagaggaagaccctgtctcaaaaacaaaaacaaaaacaacccaaaaagttaagatggtaaattttatgctacacgtattttaccacagtttaaaaacataatgaattttaaaatatcaactttatgaaggttcagcttagagacaataagctccctcaattctaaatgtactgtataacaagcacagacaccgtgacccaccacagtctccatacaggacatctcccctatcctgaatattccctcatggccctttgtagttaagcctccctccagactggctctggaaatcatctgtctgctttctgtcactctagattagttttgcccattttagaacttcacgtgaatgaaatcatacatgatgcattctttcatgtcttgtttcttttgctcagtgcattgtttttgagattcatccatgttgttgcatgtgtcagaactttgttcttttttgtctgtgaaggagtgtcctgttgtgtgaatacaccacaggttgtttttccattcatctgttggggtgcatttaggttgtttccagtttggggctattatgaataaagctgctatttgtcttcatttctcctgggtcaatatctaggagtggaattactggcctttatggtaagtgtatgttttactttgtaaaaaactgacaaacttttctgaaaatattgcattctttttcctgtgtgctggcagtggatgagcgttaccctacatccttgtccacacttggtgttgtcagtcttttaaactgtagccatcctagtggatgtgaagtgacatctcattgtggtttgaatttacattttcctgaggactactgatgtggagcatcattttaaggactttttggccatttgcctgtcttccttctgaaatgtctttcagatctcttgtccatttttatttgattgtttgtcttccagttttcgatttgtaagagttatttatatattcggatacaaatcgttcgtcagatattattttctcatggtgtgtagtttcctttcatattttcttcaagatgtctttgaagagcaggaggcttaaaatttttttttttttttttgagatggagtctcgctctgttgcccaggctggagtgcagtggcgcgatctcggatcattgcaagttccgcctcctgggttcacaccattctccagcttcagcctcccaagtagctgggactacaggtgtccaccaccacgcctggctaattttttgtatttttagtaaagacagggtttcgccgtgttagccaggatggtctcgatctcctgacctcatgatccacccgccttggcctcccaaaatgcgggattacaggtgtgagccacctcgcccagccaatttaatcaatttttctttatggttcatgttctttgtgtcatagctaagagatctctgcccatcccaaggttgcagatattttcttctgttttctgacggcagttttgtagacatagcctttatgtttgggcctaagaaccgctccatgttgattcttgtgtatggtgtgaggtaagggtcaaagttcttttttctttttccccaaataacaacccatgttttaaaaagttaaaccagaaagggaacacagaaactacttgagcaaaataacttgtcctgagaaccagtgaggtggttgttactgttgaacatttacaggcagttgaggcaggaaaggaaatgtgatggcttctgagtcctgagttttggatgttagtgtaagatgcctgccctccagagacctatgtcttcttaaaacagtgaggcccttttcttgcttactgcccacctgtcgcttaggggccagggcatggccaggaggagggcaggggaaacaggagtgagtggacgtgatgaccaaagccccaagattcactgattctgactccgaaatggaacatgcttttgcaaggctgtgtgtatgggaggaggtcactgggtgctgcgcctgtcactttgaattgttgagaggcaagggctcatgacacatccctgactctgacatcatttccctggagggaaatggctttgagctccagatcgaggcccaatatgcacctgttcatctgcagcctcacggagccaagaccactttggccacgagaactgggaccaccagctgaaactggcagtggcatggaatcgcgtggacattgcccgcagtgagatcttcatggatgagtggcagtggaaggtaagtcttccagagcaccccgtggaggggcctactgggcccacatgcattgcaccactgaagcaagggcaggcaaagttcgcattgtctggatcccagcccttcccttgagggtgggtgacctgggcagctttcatcctccccaggttggggacaacagcagcccccatctccagggtctttgagatcaggatgacatggggtgatgaccaaatgcaaccgtcactgcacaatgcttgctctcagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcgtgctggtaacggggcccatcctggactcgtcttcgcgggctactgctatgttcttagagctctctgtttttaaaattagcttttatttttattagaaaagacacatgctctatcttaggctgcttgggctgctgtaacaaaattccacagatggggcagaaactaccagtttattttctcgaagttctggaagcccgaagtcccagattaaggcaccagcagggctggcttctggccagggcctcttcttgcttgcacgtggctgccctcttgctgtgtcttcacgtgacagagagagaagtctctggtgccacttcctcttctttttcttttatttattttttatttttttgagacagggtctcactctgtcgtccaggctggagtgcagtggcgtgatcttagctcactgcagcctcaacctcccaggctcaagcaatcctcccacctcagcctcccaagtagctgggactacaggtatgcgccaccacacctggctaattttttatttttttgtagagatggttttgctattttggacaggttggtctcaacctcctggcctcaagtgatccgctctcctcaccctccaaaaggctggaatttacaccctccagccaccgtgccttgtctatttttatgtttgagacagggtctggctctgtgacccaggctggagtgcagtggtgcaatcatggctcaccgtaccttccacctcccaggctcaagcaatcctcctgcctccgtctcttgagtagctgggactataggcatgtgccaccacacccagctttttttttttttttataatattttgttgagatggggtctcattatatggcccaggctggtctcaaactccggggctcaagtgatcctcctgtcttggcctcccaaattgctggcattgcaagtgtgagcctccgcacctggcctcacccctctttttataaagagaacacacctatccacttaggaacccacaatgtggcctcgtttaaccttaattaccttcttaaaggccctatctccaaatgctatagtcacactgggggttagggcttcaacatatgaattttaggggggacagagttgcgtccataacataccctttctaaaagttccaaacagtacaaaaggttctgcagggagcgtgatccccctgccctgagccccactgctgcccactgtgtatgctggttttttccgacagtcaggtcagtaacattccaccgtatttttgtgagatgcccagggtgcactgcagctgtgggagagtggatgctgtagtctgcaccctgtgattcaatgggagccctgctctagtctcacctttatttaatggtgagactgccccagtctccaaccttattcaagggaaccctgctctaatctccacccttatccaatgggaaccctgctctaatctccacccttattcaataggaaccctgccctagtctccaccctgattcagtgggaaccctgccgtaatctccaccctgattcaatgagaatcctgccctagtctgtttaccctttttcagtgggaaccttgcagtgactcaatgtcaggaatgatgctggattttgtatttgtatttcctcttgggagtatttatctctgattcattaaggttttacaaagcaaagcatcgatgcctttgagaagattgagctccttttcttctttgacctatgaatttggtgaattattttaatagattttctgatagtgaaacatgtttttatccctgttttgaatttcagcttggcctcagtgcaagtttaatatactggattctcttggcaacattttcaggatgtttgcatcagaatgcttaaggctttgattgcagttttatttggggggctatatttgtcaggctctgatatcaattttatgttagttttgtaaaaaccatttgggaagctttctttccttctccgctccaggacagtttatgtagctggagttaactacttcttataagcttggtcgactcccctgtgagtccatctggacccagtgccttttttttttaattggtaatagttctagtaactttctcagtttcttttctgattatttttctgtttaggttctctatctcttctaagatcacatttttttttttttcctgctagaaaattgtctgtttcctccaggttttccaatcgatccattgttccaggtgagctctgtctgactcttgagaaagacatgggtatgacttggtttctttgttttttgtttttgagacaaagttttgctcttgttgcccaggctggagtgcaatggtataatctctgcttactgcaacctctgcctcctgggttcaattgagtctcttgcctaagcctcccaagtagctgggattacaggcgcccaccaccatgcccagctaattttttgtattagtagagatggagtttcaccatgttggccaggctgatctggatctcctgaccttaggatccacccatcttggcctcccaaagtgctgggattacaggcgtgagccaccgtgccaggccgggtatggcttggttttatacattcacgatctgcacttcttaagtccagtgcgtttatttaagacgctcagttggaatatgcttaggaaggtccaaagcagaatctcaagcttatctgtacctgtggtttaggaagaaaaacacatttcttttttttttttttttttttgagatggagtcttgctctgctgcccaggctggagtgtagtggcgcaatcttggctcactgcaacctccacctcctgggttcaggccattgtcttgcctcagccttccgagtagctgggactacaggtgtccgccaccacgcctggctaattttttgtatttttagtagagatggggtttcactgcgttagccaggatggtctcgatctcctgacctcgtgatactcccgccttggcctcccaaattgctgggattacaggcgtgagccaccgtgccaggccgggtatggcttggttttatacattcacaatctgcgcttcttaagtccagtgcgtttatttaagacactcagttggaatatgcttaggaaggtccaaagcagaagctcaggcttatctgtacctgtggtttaggaagaaaaacacatttctttataatgaaaaaccttcaggaaatttctaggatcacttgaggtgtgttttgtacagtatgtgatgtgggagatggttttttttctacttctggggagcgtttcccagctacctgagtacgtgtttcctggtccggggaaaagcctagccatgcagggaggtgggtctgggcaaggtgccctgtgcttgctcgtgagtgagccatattgcccacctgacagatctttcctagtggcctctctgccagagacactgcaggagagtccctcagggagaagacagtcactgacctattaacatactccactgtgctagaattttgcttcgttgaaagcagctttgatgccatcagataagactggggaacttgaagtgcctggcatgaaacaagagtctacacatgttggtaaaggagttagacgggcgtttcactttctagatgtctccagaacagtgttttaaaaaacttcagtgtgcataagaatgatctagggtgttgctgaaaatgcaggttgtagttctccagggacagtgagatcctgagaaggtcggggctggggtcagggcctgcacctctgacaggctccgccagtgactctgagccaggcggcccggctggggctctgacagttcactgctcaccaggtgcagggagtgagcctccggtccctctacaagcgttcctcaggccatgtgaccttcaccatggaccccatccgtgaccttctcatttgggccattgtccagaaccgtcgggagctggcaggaatcatctgggctcaggtaataagactggcttctcagtctcagcagacacagctataggccagcggccagctggggagtgtggctggagagagtggctggagagcctgaggccaagtgcacgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggagggatgtggagactgtggaggggtgtggaggctgtggaggggtgtggaggctgtggaggggtgtggaggctgtgaaggggtgtggaggctgtggaggggtgtagaggggtgtagagggttgtggaggctgtggaggggtgtggagggctgtggaggggtgtggaggggtgtggaggctgtggaggggtgtggagggttgtggaggggtgtggaggggtgtggaggctgtggaggggtgtggagggatgtggagggatgtggaggggtgtggagggtgtggaggggtgtggaggggtgtggaggctgtggaggggtgtggagggatgtggaggggtgtggaggggtgtggaggctgtggaggggtgtggagggatgtggaggggtgtggagggctgtggaggggtgtggagggctgtggaggggtgtggaggggtgtggaggggtgtggggggttgtggagggctgtggaggctgtggagggttgtgggcgtctccaacactgggaaggacttggggcacctggagttggagaacaaagaacttagctctaggcaggaaaggaattttttttttttttgagacggagtcttgctctgttgcccaggctggagtgcagtggcacaatctcggctcactgcaacctctgcctaccgtgttcaagcgattctcctgcctcagcctcctgagtaactagaacaacaggcatgtgccaccacgcctggctaattttttataatttagtagagatggggtttcaccatattggccaggctggtctcgaactcctgacctcatgatccgcctgcctcggccttccaaagtgctgggattacaggcgtaagccactgcgtccggcccaggaaaggaatttttaaattaaaagttctgctaaaaaaaactggttctgtggttatgtccagggccgagtctcactgggcacgcacaggccgggtggtgccgccctctgcagctcacacgggttccgatgggggctggtgcatgtgctgggcccgtgctgtccgtcaggctttgcagggcaagcagacccctcccacaggccacgcaggagcctgggccatcatcagaggttgtgtattgactggggtggggcttaagttgtctgtatagatgtggtcacacacagtgattgcccagtggcccgcactgtccccgggcctcgttttcatcacctggggcagtgtgttgggttcctcaggctgggttgagcctggctctttagtctcacggtggctcctccggtccccagagccaggactgcatcgcagcggccttggcctgcagcaagatcctgaaggaactgtccaaggaggaggaggacacggacagctcggaggagatgctggcgctggcggaggagtatgagcacagagccatcggtgagctctgccgggcacgggctgcaggccatggctcagccgtgcatgccctcacctggagttcccatccctgggtctcagccccatgtgccctcaccctggggtcctcgtccctgggcctcagccctgcacgcttaccctggggtcctcatcccggagtctcggccctgtaaccacccagtgggttcgtcttgcctgctgctcagatagagcccatttgttaagacagcgagattgcaatagagaaagagtttaattcacacagagccggctgaatgggaagctggagtttcatcacccaaatcagtctccctgaaaatttggagactgtttttttttttttgagatggagtgtcgctctgttgcccaggctggagtgcaatggcacaatctcggctcactacaccctctgccctctggattcaagcgattctcctgtctcagcctcccgagtagctgggattacagctgcctgccaccacaactggctaatttttgtatttttaatagagatggggtttcatcatattggtcaggctggtctcaaactcctaacctcagatgatccgcccacctcggcctcccaaagtgctgggattacaggcgtgaaccaccacgcctggtgagactggggttttttaaggataatttggtgggtagggggccaggcagcggggagtactgattggttgggccagagatgaaatcacagcgggtcaaagtgggttcttctcactgtctactattcatgatcacaggggtcgaagtgggttcttctcgctgtctgctgtttctgcgtgtggtcacagaactggttgcaccagatctccagtcggggtggcgtcagtgacgcatcagaatgcaggctttcaaaatatcctgggttttccaatagtgatgatattcctaggaagagttggggaggtttggaatcttgtggcctctggctgcgtgactcctaaaccataatttctaatttgtggctactttgttagtcttacaaacgcagactgctcccaggcaagaagggggttcgtttcgggaaagggccgctatcatctctgtttggaagttaaactataaacgaagttcctctcaaagttagtgtggcctatgcccaggaatggacaagggcagcttggaggttagaggcaagatggagtccattaggtcagttctcggtccctgtctgagttttctccctgttgtcatttttgtagaggcagttccagccctacgtgccctctccctggggtcctcgtccctgggcctgggtgttttgagacaccagccccacatttgccctgtgcccttccctgtgtcctggtggtgctgtcccgagtggttgccctctgacccgtccccagggctcagtgattgtgacctgctgctctgacggggctctcatatctccgcccaggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggtgacctcccaagagccccttccagaaacagacgcctgtggtgcctgcagggcggacacagcctcctgttcgtgcagttggcacgcacactcacacaggcttcagggccctcagcagctcggggacagcgcctgacccctcggccacctgctccaggctctggcctcccattttgcagatggggggaagctaacatgaagcaaaagcaggagctggtggccatggagatcgcaattcacctccccatggatgttcctacctgggagcggcaggcagaagcccaggtggctctgggaacggcgtctgccctctctccctggagggataagcgggacacggcgtgtcctccctggagcagcaggggctcccaggcatggctgccctcagcatcgccctggaacccccggcagggcctggctcccagcgagtgccccttgcacactgggcttccttggagcgccgagctattgccaagtccatgagctcccgtcatgtcctgggctgtgccaggcctagggaggcctggggaagggtcctgtcccccactgcagagctcagaggggccagtgctctacagcctgcaactgcggggccttcgaagccagcagagatggggtcccatagcttgaggtcaggtgaaaggcgggattgggcacccaaagccccagggcaagctctgtgtcttcaccactttctgctgtgagactgcaggctagctctgtccactaggcaccccgagtcctcagcagacagctgacgggcaccatctggggcacagggctgggcactgccatcctgagactgcccccatccgcaggccttcctgaccaaggtgtggtggggccagctctccgtggacaatgggctgtggcgtgtgaccctgtgcatgctggccttcccgctgctcctcaccggcctcatctccttcaggtgctgcagggctgcggggctgcgggactgtggggctgcggggctgcgggagaggctcctgggggctcaggatcttccctagatcccctcgctgggagcaagtcatgtgtcctcagaattgtccctggatcctggggctgtagagatgggggtgggaagcagagcagggccccacgtgctggaagcacctgccttgccccagccccagcactgatctcatgatgctgatgagcccgtccctcagccacatcagcctggggttggggaggccaggaaagatggtctcctgctcctgccggcactgtagacctgagccagtctgcggcgtgggcagttagtgcaggtctgggatgcgagcagcgagctgcggctgagccctgtcctcgcagccgcagagcctgtattgatggaatcgctttcccttatgaaggaggaggacacggctggccatggttgaagacctggcctggcctggtgtccccacctgcacctcctcagaggcttgctggggcgttgtgggatctgctgtgttttactgagggctggatggaggctcagggtctcctgggagtcagggcagattcaagaccccagcgaggtggctgagccccttctgcaacccgcagtccacactgcctgcctccttccctttctcctcacggccaggatgggtacttgagtgttcaggaatcctggtgggaaactgaggcagggaggagcggctcaggtgtcctaaagcagtgctggcttctctcctgctctcccgaggatggcagagccgtgtcactgatggccgcctctgctcccgttccagcggcccggggatagggacctgggatcagggcacaccacagggggagtgtggtcagccccacccccattgaggacggcaaggaaagcctgtccccatttacaggagggtgactaaggcctgagcgtccactgagcactgggagctctgaagctggggcccacccaaggctgggcttggggcaggctgggcctccctgtttgcagccattaaggtcatggccatgggcagggcgtcagcgggcatccctgtgtcctcactttgctgggctgtggggtccagccccaccccggtggctgtgtgtgaggctcccaggctgtgctgtgccggctccgcctgtagctgccgttatggccccggatccctgagtgcttttgcctctaaaagcacatctctctgaggggcacgggggatcacggggtggccaaagcctgtggaggtcaggaccctggccctggtggtcactgtctcctctctgctgtgacggccgcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcaggtacagccccacctgcttttccacgccccagcccggggccacccacttggctgcattctcataggggacccatggcttagagcccaccccatctagcctgcccagctccctgcaagctgagcagagccggtgtttcctccccaaaatgggtggctggggcgctgccctccaagcccctccctcctcatgccccctgcgcctgcttccctgctttccctcggcccaggcatccttccctcctggagaccggctgatcagctcaaggtggatgccctgaccttgtggactatgagtatgtcccttcccccaggaagagcagtgcaaggtgtggggtccctaagacccctctcacgttcaataacgagccagaaggacccacagacgctggggagtggcaatgctcacttatggtttattaagcaacagtctacagactaaaccagccagggggagggacgcagctgcatccaggacagctctgagcccagggcatccggccagtccctccctgtggaggtgtgggtggcactccatcctcccggtgatgatgtgtggcctcatgcatggaggcacgtccccagagaggctcgcgggccttggtgtctactggaggtcagtcacagaggcgaggctgacaccacatggttgacctcagtctccagccctccaaaggtcaaactgaaaactgcccggggccccaccccaaatcacactgtgggaccacctggcatggcccaggccccaggaacaaagacaccctcatcaggcggacattccaagggctcagaggctatctccctggagctgggcgaggccaagctgccctccaggtggggcgaatcccttactgtgtggggtctccactgtgcccccacggtgcctgcacctgctggcagccggtgaatgggaactaggtccttggaaccctcagggcagtggtgagggggtggggtcagcccacggggcagtggtcctggcttagacttacctctgctctctaaccttggtggaccaccaggcccccagttaccccagttagaaagcagtgtgcactgtgtaaataccactgcctactggggccctgggggaggcaccggcgtccccaggaaggaagatcaggtccaggacttggcggggcctgggagctgtgctgtggccctggctctgctgggctctccttggctctcctcttgccacagggcttctgccaccagaccctctctacaaggggccagaggcctccatgcacccccagccccagccccatgggcagcagcctgagagcagagggggcacttccttctccctgcatctgtctgtgatccagggagggccctggttggtcctgctggtcacctgccccacctgtccagctgctgggtcctggggcctggggctagggagggtgtggggactcctgccaagtaggccaaatgggggctcccacagcccctgccaggtcctgcactcttggcctgctaaagaaacagtgtggcccctgacagaacaaagatccttgtgggaaggcagctggcgcctgacattgagggcgctgctccaacacacacacacatgcacacacatgcatacacatacaggtacatgcacacacatgtacacatgcacacaaatgcacacacacataggcacacacacatacatacatgcatatgtacacacatacatgcacacacatgcacacagtacacacataggcacacacattcatgcatatgtatacacacatgcacacatgcacacacatgcatacacacatgcatacacatacatgcacacatatacacatgcatacacacatatgcatggacacacatacatgcatatagagatgcacacacatgcatacacatatacatgcatgcacacatacaaatatacacagataaacacatgtatacacatgcacacacatgcatacacacattacacgtgtgcatacacacaaatatacacatacatacacatgcacatacatatacagcacacacatgcatacacacatacacatgtacacaatatacacatacacatatgcacacatacatacatgcacatacacatgcatacacacatacacatacacacatgcacatacacaaatatacacatcacccaagcacatatacacatatacatacatatgcacatgaacaaacatgtacacacatacacacacatatatacatatgcacacatgaatgaacatacacatatgaacacacacatacagacacatacacatatatacacatgcacacacaaaaacatgcaaatacacatatacacagagacacacagatacacatacacatgcacacacacaaacatgcatacatacacaatacatgcaaatgtatgtgcatacacatatacatgcacacatacatgcacatacacatatacacacatgcatacacatacaaatacatgcagacacatacagaatgcacacatacatacacacacacatatgtgcacacatacatattcacacgtatacacacatacatgcagaatatatgtacatacacatatatgcacacacaggtgctgagtgagcagggggccgaggtagctgctgccagcgctattctgcattgttcctccacgtcctgttcccatctccctcactgacccagctctcttcagatcagaaccaatgttcggatttgctgaccgtgatgatagtgatgatagtgatagtgatgatagtgacagtgatgatagtgacggtgatagtgatgatagtgacagtgactgtgattgtgatgatgatagtggatagtgatatgacagcgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatagtggatagtgatatgacagtgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatgatagtggatagtgatgtgacagtgacagtgaggatagtaagagtgacaacctgtctgccttcctaccgcccctcttcccagtagctcttctatgaccctgacgagtgcgggctgatgaagaaggcagccttgtacttcagtgacttctggaataagctggacgtcggcgcaatcttgctcttcgtggcagggctgacctgcaggtgagtggcctcaccccgatggcgggcccgtctgaggcagccagccctgcaggggatgagcacaggccgggcccagaaccagccacaccgggtgaggctcagctcgtctgtgaaccctggattgtcatctgtccaatgggtgtccaggcaacagcgccccacctacccttgggattgttgagggagcacagaaggggcatgagagctcctggcagagctgagattgtccatgtgcaaggggccatagatggcaacctctggaattgtcccagctccacggacacgcggctgccgctttctccctctgcctccctactgtgggctcactgcactgcctgtgatgctctcgtgtctctgcgaggccgcggccccctttctcggaggcaatagggccctggctaactgctggctctccaggtgcccccatgccaggctgccctgtggggctgggcgtctgaagaaaagtgggaggctctattcctcaatctcatgccagctttgaacacctgggatgcagggcccaccagagccctttgcctccagggcccacctgggctaggacaggtggaggggcgacgggggacagctctgggggctgctgtgagcaggtggctgagatgtgtgtgcttctgcccggcggccaggctcatcccggcgacgctgtaccccgggcgcgtcatcctctctctggacttcatcctgttctgcctccggctcatgcacatttttaccatcagtaagacgctggggcccaagatcatcattgtgaagcggatggtaagggggcgggggcaccggctccatcgcggcctgcagcccagggtgggcctcagggagggcaggccccttgccagtggctcggactggggcttaaacacacctgtaggttccccgtccctgctttgccccttgggctcccaagaatgcccttctcgtatctttgcctgtacgtcacctcttccaggaagccttccctcattctcccctctgatccccactcattcctggcctctgattcagctctaggagctttcctccttggtcacggttatgtctgaccgcactcattcctggcctctgattcagctctaggagctttcctccttgggtcacggttatgtctgacccctcttgcactttgtggtgctagcacaaagatgtcggcagtccacgagggtgtgggggcagccccaggactgctcctgggagcctcctgcatgccgtgtctgtgctgtgagtggcagtgctgtctccaccgctgctgggcctgcctctgggcccagtgagcatcgggggccaggagagtgtagcccacacaatctctgtcctgcagatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtaggagccgggcgccatgggagctcgggtggtgctgccgggaagcaggagagaggctggaaaggggccgcatgagtgggagtgaggccggctccatcagggggtcctgcggttcccacctggccggtgtcctccctgggggcattcattccccggctcctgtggcaggaagtagaaggggccccaccaggggagggaggaggggggcctggtgggggtgagtggtgccacgcagaggtcagagtgggccgagggcacctggggcatcagctgacagccccctgaaatggaatgtcaccctgtatcccctttccctctcacctcaatcagaaataacttccttcttctcttgatggaaataattcattcctcccttcctcccttccttccttccattttttgacagggttttgctctgtcacccaggctggagtgcagtggcacgtccacctcctgcgctcaagtcctcctcccacccgtctgctgagtagctgggactgcatgtgcacgccaacacacccggctaatttttgtattttttgtagagatgggggtttcagcatgtggcccaggctagtatcgaactcttgagctcaagtgatccacccccttggcctcccaaagtgctgagattacaggcgtgagccaccatgcctgccagagagaacacttttcatatagaaggttttttttttttttttttttttttttaacagcttcattgagagaaatttcacctggataaagtgcacctgtcagtggttttcagtatctttacagaatctaactttataacatctgcatcaccctgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccttccattttttgtacagggttttgctctgtcacccaggctgggactgcagtggcacgtccacctcctgcgctcaagtcctcctcccacccgtctgctgagtagctgggactgcatgtgcacgccgacacacccggctaatttttgtattttttgtagagatgggggtttcagcatgtggcccaggctagtatcgaactcttgagctcaagtgatccacccccttggcctcccaaagtgctgagattacaggcgtgagccaccatgcctgccagagagaacacttttcatatagaaggttttttttttttttttttttttttaacagcttcattgagagaaatttcacctggataaagtgcacctgtcagtggttttcagtatctttacagaatctaactttataacatctgcatcaccctgaaaagaccctgcatactcacagtcactcccgttcccctcccctcagccacagccacccacgaagctacttgtgagctgccttttctgggcgtttcatagaaactggatgatgtaataggcagtctttggtgtctgacttctttcacttgatgtcccgttttcaaggtttgtcaccgtgtatcagtatttacttcccgtttatggctgaagaggaccccgctgtgtggacacaccacattttgttcatccattcatcagttggtggacatatgggttgtttccacttttccttttttttaaaaaaaattaatatttaattttttaattaaaaaattttaaattaattaatatttaattttttttttcccctagagggagtctcgctctgttttctttttcccgagagggagtcaggccaaagtgcagtggcacaatcttggctcactgtgacctccacctcctgggttcaagcaattctcctgcctcagcctcccgagtagctgggattacaggcacctgctaccacgcttggctaatttttgtatttttttgtagagatggggtttcaccatgttggacaggctggtcttgaactcctgacctcaggtgatccacccgcctcggcctcccaaagtgctgggatgacaggtgtgagctaccgcgcagggccgtttccacttttcacatgctgtgaataacgtagcatgaacagttatttacagggttttgtgtgggtatgtttttatttctcttagacacctaggaatgcacggctggctcatatgggaactccatgtttaagtttttgtggacgtgctgggctgttttccaaagaaccggccgcattccacattcctgcctgcccagtcccaggattccaatttctctaccttcttgtcaacatttgttattgtccattaaaaaaacaaagctcgcatcccggtgggtgagaagtggctctccttgtcgctttgacgggcatttctctaaggacccgccatgctgagcatctcctcctctgctaacctcgtcgtctgtaagtcttctttcaagaaatgtctctccctctcctttgccctttttttttttttttttttttccgacagggtctcgctctgtcacccaggctggaatgcagtggtgcgatctcagctcactgcaacctctgcctcccgggctcaagtgattctcctgcctcagcctcccgagtagctgggactacaggcgcacgccaccacgcctggctaatttttgtatttttagtagatacagagtttcaccatgttggccaggctggtctcgatctcctgacctcgtgatccacccgccttggcctcccaaagtgctggcattacaggcataagccactgcccccagccatctttgcccatttttcaattgagttgtcttttatattattgagttgtcttttatattattgagttgtaagagttctttacgtaaggatgccagtctcttaccaaaggtatgatttgaattttttttgtcaatctgtgcactgacttgttattttctttatggtgtcatttgatgcacgaacttttgaaattttgatgatgttcaacttatcaatctctttgatcattgtgcttttggtgtcctagcgaaaaccattgccgtgatttatgcctgtgttctactaagtgttttatagctttcgctttttgtttgccctggtgtgcggtaagggtcagtcttcgttgtggctctcctgttgtcccagcactatttgttgacaagactgttgtttccccagtgaagcatcttggcatccttgttgaaaatcagtggaccattaacataagggcttatttctagagtctcagtttgactccactgatgtctgtccttgtgccagaaccacactgtcttggtgagcgtagccttgtagtaagttttgaccgcactgtcttggttggcgtagccttgtagtgagttttgatcgcgctgtcttggttggcgtagccttgtagtaagttttgatcgcgctgtcttggttggcgtagccttgtagtgagttttgactgcactgtcttggcgtagccttgtagtaagttttgactgcactgtcttggttggcgtagccttgtagtaagttttgaccacactgtcttggtgtagccttgtagtaagttttgaccacactgtcttggttggcgtagccttgtagtaagttttgaccacactgtcttggtgtagccttgtagtaagttttgactgcactctcttggttggcatagccttgtagtaagttttgaccgcactgtcttggtgagcgtagccttgtagtaagttttgaccacactgtcttggcgtagccttgtagtaagttttgaccgcactgtcttggcgtagccttgtagtaagttttgatcgtgctgtcttggttggcgtagccttgtagtaagttttgacctcactctcttggtgagcgtagccttgtagtaagttttgaccgcactgtcttggtgagcgtagccttgtagtaagttttgactgcactgtcttggttggcgtagccttgtagtaagttttgacctcactgtcttggtgagcgtagccttatagtaagttttgaccacactgtcttggtgagcgtagccttgtagtaagttttgaccgcactgtcttggttggcgtagccttgtagtaagttttgaccgtgctgtcttggtgagcgtagccttgtagtaagttttgaaattcggaagtgtgagtcctaatttgttcttttccaggattgctttggcctctgggtcccttggcttcacaagaatttttggatcagctcatcaatttctccaaaaagggcatctgtgattttgattgtgaacatgggatgtctttttgcttatttaattctttaatttctctcaataatgttttatagtttccagtaataagtcttaatgcttcttctgttaaatttattcctaaatattttattattgtccaagctattataaatagaattgtcctattgatttcatttcaaattgttaatgactggtatgtagacatacattgtcttttgtagattgatcttgaactctgaaaccttgctaaacttctttattacttttaatagttttttagtggatttgtcatatacgagaccatgtcatctgcaaaaagagagttttacttgttcctttccaaactggttgccttttatttcttcttcttgcctaagtgccctggctagaacctccagtacaatgttgaacagaagggacaatgggggacatccttgctttgctcctgatcttaagacgagtccactgatcttagggaacaagcctttcaccattaagtgtgatgttagctgtggggcttttataaatgtcctttatcaggttgaagaagttcccttctattcctagtttcttgagtgtttttattgtgaaggagtggtagactttgtcagctgcttctcctgcacttattcaaatgttcagatggtctttgatccttttactattaatatggtgcattccatcaattgaccttcgaatgttaaaccaactgtatgttcctgggacacgtcccacttggtcttggtgaataatctcttttacatggtgctggattcactttgctagctgttttttgatgatttttgcacctatattcatgaaggttattggtctgtggttttcttttcttgtaatatgtttgcctagttttggcaccaggataatactggcctcataaaatggcttaggaagtagttcctcctcttatattttggaagagtttgtaaaagagtggttttaattcttccgtgaacatttggtagaattcaccagtgaactcctctgagtgtggacttttctttgtgtgatgtttttaacttactaattcaatctctttatgtgttataggtctatttatattttctatttcttctccagtcacctttggtagtttgtgtctttctaggaatttgtccattcatctagatcatctaatttttttagcatacaattttctctaggatttcctttgagttctttttctttttgtaagattagtagtaatatcctctctttcatttctgattttagcaatttgagccttctctctttttttccttgatcagtcttagctacaaggtggtaattatttttgttgctctttttcaagaactgagtttggtttgttgacattcattgtttttgttttctcgatctcatttatattctaatcttcattctttccttccttctgcttgcttttggcttgtctcagggaaagcatccagtctttcccactgggtatgatgttagctgcagggtttttgtaaatgtcctttcaatcaaagaggttctctttgattcctaacttcttgagtgtttttattgtgaaagggtggtttgctcttctttttctagtttactacagtgggaagttacgttaataatttcagctcttctttattaatataggaatttatagccatcagagtgcgtttctatcttagaaaattagtaacacattcaaaataggtttgattacccaataatgcattgctcattgttgaacaattttaaaattcaagataagtataaggaaagaatgttattcataatttcacctcccggagttaactactgttaacaacttactatttttccttagagatttgtttaaggtagaagctgtttccatattcaatagcccttactttctatgcacgcaggatgctatttttcttcacaatcacccgtttcacttgtcgatacgttgcctctgcaacatcttcccttttccacatctccacgtctcccttctctttgggatagttgttatttttttccttttcaattctttttttttttttttttttttaatttttgagacagacatttgctcttgttgcccaggctggagtgcaatgaggcaacctcggctcactgcaacctccacctccctcccggattcaagtgattttcctgcctcagcctcccgagtagctgggattataggcgcccgccaccatgcctggctaatttttgtatttttagtagagacaaggtttcaccatgttgaccaggctggtctcaaactcctgacctcaggtgatccgcccgccttggcctcccaaagtgctgggattacaggcatgagccactgctcctggcctttccttttaaattatttccaccaaattgaactccccaggcttgggacctggtgctggccctggctgggaccctggcagtgccctggtgggtggcacaccctgggcggaggcacgggccagcctgggtgcagctctgcccccggggcctcctacctgcatctggctggagacagatgcctctttctggacttctggcccagaggtgacagctgaggtcacccaaatgagcagcatcaggcctgcgggggacctggcagtgactggaggcctcgagggccccctcctgccaagctcctcttgactctgtgttgttttcttggctcacccacccccattcccaacgccaggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaagtgagcgcctgggtggggctggcgtgcaggtgggtgggtgggcggcgttcctgggccgcagtggccacgctgtctccagggtctcgtggacagtgtggatgatgggctggtgcacagaggcgcgtcactcatatcctggtggagtgtgcacagccactctctgtggtcactgctgcgtctcttgagctggcgtgagtctgtctcttgagctggcgtgggtctgtccttgtggctgctggggacccgcggtgctgtggatccacatgggccctgctcacggtgctgctgcggaggcagcctcctcccgcagggcagggatgttggtgtcagcctcgttccttctgcgcaggcgcagcattattcatgagctcactgctctacccggggagcgtgctggggccgctgctgctcagggctgtccccttgtcaccccaagggctctgcctgtgtctccctgttactgagcaaaagggctcgctgcccgatgtgcaggaggccaatactatgacaccaggtttttgagaaaagaaaagcttttattctaggccaacccacaaggagacaggggcgcagttcacgtctgtctccccgcgctggctttaatgcagtgtttctattagggaaggttcgggggtgggttcttggatgagtaagtggctggtggaagaaaagggggttctggaaagttatgtctcctcataggtctcgtgtgcacatttgggcggagttactgggaccctggggtggaaactcgggctgtgcagactccagctggccacagtggttccagctgtgacctcagccagttccaaaagctcctgcaagcgagtctcagcatcccagcaggtggcttcttttcccgtctgccatctgtaagtgtgagcatttcggttagttgctgggttctttagctctttggggccggttccccagccctagacgtgttcctgctgcccccaccgtgtgcctcagacggcgctggctctgcggtgccttccccagagctccaatccatctgtggacggctctgtgtctgccctcccgtgccattggggtcttcctcatctgcacgtcttcacgtgctttgctggttttgtggatttgcacacacgtgtccacctcctctgggcctggtgtttgtggcatctgtggcagtttgaataacagcccagggaggtccacactcgaaccctgtggctatggggccctatgtggcaaaagggactgggagggtggggttaagtggaggatcctgaggtgggaaattatctggggttatctgcatgggcccgacatcatcacgaggggccgtggaagagggaggcggagaaggaatgtgacggtggcagtgagcgtcggcgggaggggagagcctcagcccaggaatgcaggcagcctctggaaggcaggaaaggcaaggcatggaggctcccgacctacgggaggagcacagccctgccgaaccttggttttagcccagtgagactcctgacctccaggactgagagaagagtctgattgctttaagctgccaaggccgtggcggttcactacagcagcatcaggagacccatgcagtagctgtttcttctctttgaaaatgtctaggattttctttaaatcctagtgtcttgaagtcttatcatagaacttttggaatgttatttgctattgttgcttttgaaacaaggagtacaaaataggtggctgtccatccggcccctggtggacgtggtcctctggggtcgtatctctgatcagccgcagcagctgtgggccccaggctttgggggttctgttttgctcttgcagcttttaaacttagaacaaattaaatgctgaggacctcacaccagaggcagcataaaaaagaactccagggaaccaggaggccacgcagaatgaaaacacaggtgtttggggtcctagtgggccccagggttggctctgggggttctgtggccaattcctagccctgacagtggagctgaggagcccagcacggctgcggagctgtcatggtccacagaaagcccagtctccccatgttgcccccataattcagaaagcctcccaggccctcagagcccttcccagcatctgcagacagaccctgtgctacccaggactctgaaaatccttgtgttcctggttttgttaggaaccaaccgtttctcttcttgtttcattggctaagttgctgaggttgccacctttcagaacgtgggttctgaacattgagagaacccgagcatgggccaggactgtcatctcgaggccaaggggctggtggcaggacactgtccctgcagcaagtatggcacccacacttccggctcccactgcggagggctctgtgcctgtcaccctgagacacaccaaggaggcccctgcagccctgccccttccacatgcacccctggagggtctggctcttgtgctcgtcagaatccacagatcaggtcctagagttcagtgccagacagtgtctgtctcctgataaacacccactttgtgttattagccagtgaggcttataatatcgaaagtctgtgtgcttctccttttttcttgctttggttcccaggaagcctggaattgtgaggtctgtgggctgagttctgtgcctggagctggcctcccgtgtggcgtggctctgctctctgtggcatcacagtgggcacgtgggcatggctctgctctctgtggcatcacagtgggcacgtgggcatggctctgctctctggcatcacagtgggcacgtgggcatggctctgctctctgtggcatcacagtgggcacgtgggtgtggctctgctctctgtggcatcacagtgtgcacgtgggcgtggctctgctctctggcatcacagtgggcacgtgggcgtggctctgctctctgtggcatcacagtgtgcacgtgggcatggctctgctctctggcatcacagtgggcacgtgggcatggctctgctctctgtggcatcacagtgggcacgtgggcatggctctgctctctgtggcatcacagtgggcatgtgggcatggctctgctctctggcatcacagtgggcacgtgggcgtggctctgctatctgtggcatcacagtgggcacgtgggcgtggctctgctctctggcatcacagtgggcacaagggcgtggctctgctctctgtggcatcacagtgtgcatgtgggcgtggctctgctctctggcatcacagtgggcacaagggcgtggctctgctctctggcatcacagtgtgcacgtgggcgtggctctgctctctggcatcacagtgggcacgtgggcgtggctctgctctctgtggcatcacagtgggcacgtgggcgtggctctgctctctggcatcacagtgtgcacgtgggcgtggctctgctctctggcatcacagtgggcacgtgggcgtggctctgctctctgtggcatcatagtgggcacgtgggcatggctctgctctctggcatcacagtgggcacgtgggcgtggctctgctctctgtggcatcacagtgggcacgtgggcgtggctctgctctctggcatcacagtgggcacgtgggcgtggctctgctctctgtggcatcacagtgggcacgtgggcgtggctctgctctctgtggcatcacagtgggcacgtgggcgtggctctgctctctgtgacatcacagtgggcatgtgggtgtggctctgctctctgtggcatcacagtgggcatgtgggcgtggctctgctctctgtggcatcacagtgggcacgcaggcggtgagaggggtctgttctgggtaaacaccctgacctcgaggtgtcgctttctcctccctgacagctacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcagtatgccagccccagtgcctctcctgaatgtcctggccacccgggtgcagagggggtggagatggcatggcagctctgcccagaaccctggacgctcagcaggcgtgcaggtcactcaggctgctggccttctgctggccttgagcaagtggtgggggctgagcccagaggcccccttgggggcaggtgtgcgatgggctcttcctgccactcaggactggccccctcccacggggcccccccggtgggtcagggcttcagggcccacctcctgaggattccaggtcccctggtctgtccgcccaccctgacagagaacaagctggagaagaacgaggaggcggccctgctatcctgggagatctacctgaaggagaactacctccagaaccgacagttccagcaaaagcagcggcccgagcagaagatcgaggacatcagcaataagtatgggggctccggtgggcctgggggcgggaagcctctgggggacctcctgcaggtccacaggcaccatgagtacatgtcccacctggggaggcccagcaatgcctcaccggtgagggagcgctgtatcccgtggcccctgcaatgctgcaggcatccgggcctgtgcccacagctgacccaggaccctctgcggtccttaggaaggctgggccccacagggcgcagggtcagaggctgggagggaagccttggcggctgggggaggggcaggttggcccgcaggatccggcttggaggcctgggggcatgtgcacacggggtccaggctggtttgggggtggtttgctctgtgagcttgttggtgcacagccttattatagcttctgcaggacctcggcagcccagccctcggggtcagccatgctcagcaccgtcctccctctcagctcctcccatcttgcttctttccaaggtgcgaggtcagtgttgggggaacatctgctcccttctctccactgccaggccttccgccctgctaggtgtcagcagggcctaatggcccagcagcgggcagcaggaagggctgcccccagtgtcctgctctcagtgtgcgtctcaccatggcatgagaggaggagggggaaatggacacggtgccacctagttatggccgtgtggaggctcctgcagccacaaacaggagcatcctggagctggcaagggatggccaagaccaggccaagtgccctcccccttagagacatgtatgtactcctgcctttccatacctccctcaccttgtctgtaagatggagacacgatagtccctgtctcttggagttgtttccagaatacagtggggtcctgactgtaaagaattgagcacatatgctggaactataaccagggatctgctaacgtggctggtgcttttatcatcacccttacttatgagtagtgggggcggtggtggtgatggtgatgatggtggctgcgatggtgatggtggtggtggtgatggtagtggtggtagtggtgatgttggtgatgatggtgatgtggtggtgattgtgatggtggtggtgttggtgatggtggtagtgatggtgatgatgatggtgattctgatggctgtaatggaagtggtggtgatggtggtggtgatggtagtggtggtgatgttgatggtgatgatggcagtggtggtggtggtggtggtgatggtagtggtggtgatgttgatggtgatgttggcagtggtggtggtggtgatggtggtgatggtgcttctgatggtggtaatggtggtagcggtgatggtggtggtggtggatggtaatggtgatggtgacagtggtggtagtgatggtagtggtggtgctggtgctggtggtggtgacgatggtggatgtggtggtggtgatgatagtgatgatggtgattatgatggcaatagtaatgacgatggtgacaatgtgaggaccttaatgaactagctgatgtcaaagccccttctagctcccattctgagtgaactagatacacgtgtcctgtttgcttgagtctgggcatgatgacttccagttgagcccttggcatgctctttgcctagaacagtcttctcccagagagagtcaggacttgctgtctctctctattcaagcctcacttcattggagggcctttcctgccctccacccaccctgtccccatcccctgtcgttctggaatctggatgttggttggttggctggtgggtttgtgggttgtgtcatgtctaactgccaggctccatgtgagagtagggacagagtcccacatgttccccatagtatcctgggatgtagagcaggcccagtgcctagaaggcactgaggaaatcctatgcaattctggaactgctgttagttcctggcctggcagggttgcaggaggctggggtcgctggtctccaggcctgctcagccctgacgtttggctctgatggtccacttacagaggaggggggcctggggccatgcagtgccctgacaaccttctcttacttgctgttgccaagtacagctttgatggatggcctcgtctgggactttgagcagtggccatgcccagggcccagatgctgggggaaggtgcttgggagagtttctgaaaggcggcctccgcatgtcaggatgaagctggaaggccacagctctgctgatgaccaacatagtcagggctggaatatgatggctggcatgtgttaagggctcattgaggaccacacccttcacctgcatcatctcgctcaacccttttgcagagggaggtatttttccttccacttttacccatgaggaagtggaggcccaggaaagtgagagaggtggctcagcttccaccactggccagcggtgtggcctggaatgcaggccccagcaactttgcagcctcctgccttaagggagtgggctggaccccaaatgaatcagtcccaggccgggcgcggtggctcacgcctgtaatctcagcactttgggaggccaaggtgggtggatcacaaggttaggagatcaagactatcctggctaacatggtgaaacctcatctctactaaaaatacaaaaattagccgggtgtggtggcgtgcgcttgtaatcccagctacttgggaggctgaggcaggagaatcgcttgaacccaggaggcggaggttgcagtgagctgagatcgcgctgctgcactccagcctgggcgacagagcaagactccacctaaaaaaaaaaaaaatttagtcccaaatgcctctcagctcctgccctatcccagacatcttaaagctcagagctggtctgctgcctatttcccagcctaggtgctcagtggaagttgggcgcctccagttattttctgaggttgaaaaagcttaactaaaatataactttgcaggccaggcacagtggctcatgcttgtaatcccaacattttgggaggctgaggtgggaggattgctcgagcccaggagttcaagaccaacctaggcaacatagtgagacccccatctctacaaaaaataaaaataacaattagccaggcacggtggctcatgcctgtgatcccagctactaaggaggccacagcaggaggatttcttgaggccaaaagtttgagaccagcctgggtaacatagtgagaccccatctctacaaaaaataaaaaaacaacaacaaaaaaggaaagagtagccaggtgtggtggtgcacatggggtcagagtcccagctgctcaggaggctgaggccaggggttcgaggctgcagtgcgccatgatggtgccactgcactgcagcctgggtgacagggtgagaccctgactctaatgcatatttgtatgtgagtagaagttttcccaagatgagcctgcagaacgtgtttccgctgggccgctggctggtgtgctgagctgtcactcccattggtcagcagctcttgctcatccgcagaggggcctgggacagaagctgatgtgcttcagtcgacctgatcttgcagaacacgggctccagggaaagtgaggaaagagctcctcagcccgtaccaagggccctagcctggtcaccgtcccctcctccagtgaagaagctgggcacctgggaggcgcatgagtgtggggtgccataaccttgcagcactgaggtgagctgagttcaccaaagctcctcgcccacagggcagggctggagctttgggggtcaaggacaagctctgtctgcaaatctagacagttcctgcatctcacggtggtggaatcacgcgggtccgagaaggctccagtaaccaccctcgcatgtttgcaaggctgtctgggaaaacatggcaggtgcggttaagcggcttttgtgggattaagcaaaatgaaatgtgggtgaaaggagatgcccaggcctggagcgaaatcactttcttccctctccctagataactgtttaaagtgggtcatatccccagaaagtttctgtgttactaaaatagttgctcagtgtattataagaatatcacttgcagtgggcgctgtggatgaaaggaagtgagggagcccaggggacagcggatgagagctggagactcgggtttgcccacagagttattttaaccataaacacagcaggccgaggctgggcgaaacaaaataagacagaaaccaaacatttccagaataatagcgccgctctacaaccccacaaaataagacagaagccaaatactcccagaaaaacagcgctgctccacaacccccacaaaatacgacagacaccaaacatccttagaacagcagcactgctccacgacccccacaaaataagacagaaaccaaacatttccagaataatagcgccgctctacaaccccacaaaataagacagaagccaaatactcccagaaaaacagcactgctccacaacccccacaaaatacgacagacaccaaacatccttagaacagcagcactgctccacgacccccacaaaataagacagaaaccaaatattccccaagcaacagtgccgcgccacatcacccccaaaacaaaaccaacctctgctgtgcccagaggaagtttcattgtttgtgacctgtcacctggccctccctcagttcactcacctccccctctctcctgggaccgacaggctgccagagcttgccatgtgagcctcggctgtccgtctgctgagacatcttcccctctggggccctgggcagtttggttctatgggagaaatgcatgttagaaatagtttcatattaagaggaagcaaaggctgacacagggccttggtggctgcatctggcagggctgtctgcagagcggtgtggcgttcccagggccccaaggtgtggtgtgcgtccagctcagctgcttcctctttcagggttgacgccatggtggacctgctggacctggacccactgaagaggtcgggctccatggagcagaggttggcctccctggaggagcaggtgggtccgaggtcggggcctccgtcaggaggtgccactgctgggcctggtgggcggctctgccatgtggtggcaccaagaaggagggctctgagtgatggtgaggaggaggccggaacgttggggcagccattcccagctggaagaggcaccctgtgtgtcctccagaaaaccccgcccaagggtttctgtgactgagttccttctgtgtgcactgaggcctccacggccgggctgtgctcctcgctgctcccaggaaacagagtgcttctcccctcccggcctccagggaggctgtgggactctgtgcctgagccctggagaggccgcaagaccgaggtggggaggacttagagacggcctctcagggtctgctcccaccaccccatcaatgtccaccagctgggccgggctgtgctgtccaacaacagcacctgtggccacggcagcccctgcgggcagtgctgagccctgtggatggctcagccaccctgtgctgctgctcccagccttgctctgtggggcagggctgggacctgtgctgctggggcatccaccatccaccagtcctgcccgttgcacccaggggtctgcccaggccgccctctacccctgtcttggccatgctgggacccctgacagggtgcccagcactgagccacacgagtgagacatgtcccactgtcccctgtgggaggcgcatcagcctctggggaggctcctcctgggaggtgcaggaaccctggaagcctctggctttggcggcctgtgacctctccctgtggtgcagaattgcctgactgtgccttcatgctggctccatcctctggcttgtccagtgcagtgacagtcccactgttgtgtctcttggggaggctgcaccatcagatgtgtgacttggcagcccccggggggagccgggtgggcctggggcagcgttctggctggcttggtggctgcctggggaggacgtggtgtctcactttcaaagggcgcaggggctgagtgacaggggtggggctcctggctgggggagtgaagtctcggtgggcagtggggtgtgtaccatgcgtgtgggtggcaggtgctcactgtgtctcgggccatgccttccaggtggcccagacagcccaagccctgcactggatcgtgaggacgctgcgggccagcggcttcagctcggaggcggacgtccccactctgggtgagtgggtggccaggccagcagctggtctccagccgcctgtttcttttgggtctggggtcagttgggaggagaggcagctgggggtggggggctctgtccaggaggaaggcactggctgcagcctgttccaggcagggccagcgccctcaggaactcagcccacccaccgacgctggcgccgaggccccgcccaatccctgacctgacctggttcctggacgtccacggggaggcctggcctgctgtgccctgagctccccacataccgcactgcagagtgggggtgcgaggcgggcggctgcagactgtgtctgaacctggtcacgtaggctgagtgacgagaagcaaagtctgttttcctaaattcgcagccggctatgaaatgcacatcagtagccttcctcgggctgctgagtttcgccggccctcaaggagcatatttgccctcgtaaccgcactgcgagttcagctcattgccgagggccctgactgccgctgcacaaagaggcaggtgccggcggggacgctgcctgagctcccgtggctgtcctccctgggggccctgcccacttcagagctggtgttcgacctgcatggccatttgggctcggggaggtggaggagcccagatgttttggcggaaggaccacagaggaagtccttgtcctgcgggcgggcacctgagcccgggctccgccttgcgtcacgtcttcctgactgtccccagcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggaggtgagcgcctgcccaagcccaaccaggcggagtggccgggcccctggggaggggagggcggccctgtccccatccatctggtattaatcctggctctcagccactgcagccacagggggatctgtgcgtctggcagcccctgtttgacatttgaggaaaccgaggcacagagaagtcaagtcacaggggcctcacagctggaggtggtggaggggcctgaggggggcacactgatccccacagagctcgaggcttaggctcctcccatgaccatcccagggcccagccccccggccccattcccccaggtcatgccctggtcctagaccccacccaccccggtgaatggctctggcccctttccaggtgccaggcatggaagagagacagagacacagagacagagagatggctaatggcccctgggagacccccgccctcctggtgcagggcttctctctggcctatccagaacattccaggctgctgcttccgctgcctccccttggtctctaccacatagaatcctccttgcctctagggtccagcttagccccctgccccactctgggaagacccccaaggcccccaagtcacggccacctgcccttcagctggccccagggtgggggtccctgatcccagcccccggccctgcccagcccccagctctgcctggcacccggatctgcccagcttggagcttctgccctgcatgttgggatgttggggtcgggttcagacccagctgagcagccctttcaccctggtgcctggcccagctttgcagtgggggtaaaaatctgagggaaaactccctgttttgcgacagacggagttcctgatctatgacccacccttttacacggcagagaggaaggacgcggccgccatggaccccatgggagagtgagtatgagccgctgtccgtgctcccagctggccccaaacccagggcctcctaggggctcccttgagaatcccagtcagagcccagcccggggaggtccaggtgagcaggaggggcccgtgggggcctgaaggggcccagctcctactgttgtgtacacccagcctgcagctactcggctgggcccttggtgggggggtgatccctctgcctgtctgctctgtcccacctgcaacacgggcacacagacacgccttctcctctgctcccagcaccctggagccactgtccacgatccagtacaacgtggtggatggcctgagggaccgccggagcttccacgggccgtacacagtgcaggccgggttgcccctgtgagtgtgccccctgcgggccccgccccgtcagcctttggggtttgcctggggggcaggtttcctctctgggcaaaggaagcatttttctcataaaacaaaatcaaaaaaagcacgtgagccaccgaaaggaagaaaacatcaactcactgcatctccgtagcccccaggactgggcttgggggcgtgggacttgccccctggcctcgggcaggccctgccccatggtccctgccgtaatctggggacgtggatttgtctgtgtacgtggggatggctgtgctgggagaggacgatgcctcagaggatgggcaggggctgtgcggcagggaggggacacggagatgggcactggcaggcttacctggccgggaaggtggcctcgcctggcatcctgttccccacaggatcggcgctgcacccatcacacaggtgaggaaacccaaaataaaggtgtcaagtgtcctgtgagcacctacaagtgccctggaaggaaggagcctgggagtcttggaccctgccatgaggaggaggtggaggaggggccaccagaacctgggactggggggttgccgggatgtggggcatgaaccatggagcagaggaaccaaagggtctgaaggacggggggactgcgtggcaggcctttgcagaatgctctggaacagggtgtgggctcctctgcctggagccggaggttgagtaaggaggtggtaggaggcgatggggcctgagagcagaggtcctggccaggtggctgcagctgcaggcggcccgctctggtgttgggggtatgtgggacgggcaagggcgggtgtttagggaggtgcatccggtggctatgggaagctgacgaggagagcagcaggtgcctggcatgggcaacaaggcgtgagcacctgctctcacgggtggctgccacacaggcaggtgtgtcaggacttggcaggacgtggtgtccatgcgggctttagtagtgcagaagagcactttctgtatgcaccatgcttctgttgtggacttgcgaatcatattttcattatatttccttaggtgtgttctctttctatgaaattataaagacacaccttcctatattcatttgatacattttaaaattagtttttttcactgagactttaatacagctgaaggctgattgtataaggtgtgaggaggggcctgatttattttgtgaattcacagagaaagtgagctgcctgacttcatttcctgctaagatctggcccctcccctgaggtgtggctcctccctgaggtgtggctcctccccttaggtgtggctcctccccttaggtgtggctcctccccttaggtctggcccctcccctgacgtgtggctcctccctgaggtgtggctcctcccctgaggtgtggctcctccctgaggtgtggctcctccctgaggtgtgactcctccccttaggtgtggctcctccctgaggtgtgactcctccccttaggtgtggctcctccccttaggtctggcccctcccctgaggtgtggctcctccctgaggtgtggctcctccccttaggtctggctcctccctgaggtgtggctcctccccttaggtgtggctcttccctgaggtgtggctcctccctgaggtgtggctccttccctgaggtctggctcctccctgaggtgtggctcctccccttacgtctggctcctcccctgaggtgtggctcctctttcaaagctctgtatgcctctgtcccagtcatctcatagcagatcatgccactatttgccacagcgttgcagtaatcctgactctgggatagcatgtctttaaacctgccttttctagtcttgagcctttagcttttttgtgagtttaaaagccagtttttctagctccatgacaaatccattgataagaattgtattaaatttatagaaaaatttgagacaatggacacttttatgataatgagtcttctatgactgtatttgtcaacatttatttatgtcttctctttgtccttccctaaagttttataattttgttcataaagatcttacatttttaaataatatttattcctcaggtatttgataacttttgttatttggggtaattataacatttttttctttttcttttttttttttttttttttttttttgagatggaatttcacttttgttgcccaggctggagtgcaatggggtgatcttggctcactacaacctctgcctcctgggttcaagcaattctcctgcctcagcctcctgagtagttggaattacaggcatccaccaccatgcccagctaattttgtatttttagtagagatggggtttcaccatgttggccaggctggtcttgaattcctgacctcaggtgatccactcgcctcagcctcccagagtgctgggattacagacatgagccaccatgcctggtgtataacatttttttatattttcaatttttaaaaatatatataggggcattattaattttgtttgctgactttgtatctaacaactttattaaaccttctcgttaattatataaatgtgtttgtagattttctatgtaaataatatatattctgcaaataacaatattgtctttctccttacaataatcatgcctcattcctttttcttgccttattgtgctgggtaaattcttcagtgtaatttagaatattggtaatattaacaggcttccttgtttctgacttaatggaaatgctatcaacatttcaccattaagtatggtatttactgaagaaatttataaataccttttattggattaggaatgtttctatctagtcccaatttgtcaggggctgaatgctactaaatggtttttctgccattgattgagatagttataagatgtttcccctttagccaattagtgtgtgaattatttttatagctcctttagtgttgagccatccttgcattcctggaataaactcttctgttatatttaacgtactgctggagttaatttactaacattttacttaagattttaaaaaatctgtgttcaaaagtggaatttgcctataatttatatttcttgtactgtcttactttggttttggtatgaggttataccagtctcaatgaatgagctggtcagctttccttcttttctcttctttacaaagaagagaatgtttgtatgaggtggagataattatttgtttcttaaagtctgataatacttagctatataactgttagctctaacatattttgagcaagtggatttctttttttttttttttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatcttctgacctcatgatccacccgcctcggcctcccaaagtgctgggattacaggcgtgagccaccgcgcccggccgagcaagtggatttctaactactttatcttccataatgatttttcgaatcttatttcctgtttcttcttgggtcctttttagtaattgtaaattttctggaaaattataatttcatctaacttttgaaatgtattgtgtcacagatgtccataatattcttttatgatttaaaaaataatataaatatatagtaatttctcttttgagcattgatatttattatgtnnnnnnnnnnnnnnnnnnnncccgccaccgcgcccggctaattttttgtatttttagtagagacggggtttcaccttgttagccaggatggtctcgatcttctgacctcatgatccacccgcctcggcctcccaaagtgctgggattacaggcgtgagccaccgcgcccggctgagctggtcagctttccttcttttctcttctttacaaagcgagaatgtttgtatgaggtggaattatttgtttcttaaagtctgataatacttagcttataacgttagccaacatattttgagcaagtggatttctaactactttatcttccataatgatttttcgaatcttatttcctgtttcttcttgggtcctttttagtaattgtaaattttctggaaaattataatttcatctaacttttgaaatgtattgtgtcacagatgtccataatattcttttatgatttaaaaaatactaatataaatatatagtaatttctcttttgagcattgatatttattatgtatttctcttctttttttttttgattattcttgccagtggcttaattttataatcttttcaaaaaactaacttttggatttgttgattatcttaatttttcgatctcatccatttttgcttttattgttatctttccttcctttctacttcttatggatttgctcttgatttgtgtgttagagctcatttttattcaactttcctggttttctaataagggtacctaagactgtaaattctctctaagacctggtaggctgtaacccttaaattttgatgtgtagggattttattttttactttatgaatttcattataatcttcattttacacttttgttttgctcttttttttttttctttttgtggagaatgaggtcttgctctattgcccaggcggatcttaagctcctgggctcaagctatcctcctgcctctgcctcctcaagtgctgggattacagatgtgagccaccacgcccagcatagtcttcatttgattgtttagtgatgtacttttagctttttttatcttgagatggagtcttgctctgtaccccaggatggagtgcagtggtgcgatcttggctcactgcaacctccgcctactgggtcccagttcaagcaattctcctacctcagcctcccaagtcactggaattacaggcacgcaccaccatgccagctaattccttttgtatttttagtagagatggggtttcaccatgatggtcagcctggtcttgaactcctgacctcgtgatccgcccgccttggcctcccaatgtgctaggattacgggcgtgagccactatgcctggtcatgtgcttatagtttttaagccattctttgttatcaccttctagttttattgcatttttgttggagcgggattggcaacacgctgattcttgaaattgaaatgtcctccgtggcccgtctctaccctgggttgttgcagctgtttggctgtaaccctaaactaacacctaacccctaaccttaaccctaaccctaatcctaacccctaaccttaaccctaaccctcttggcccattcacaacagcagcctgtgtgagcttgtctgactcaagtcattcacacactcagatgccctttctggtataggagtgactgtccccacgtctgtctggggccagccccctcactgtattagttttctatggctgttgtaactaagtaccacaaactggggggcttaacagaaatggattatctcacagttctgagggccaggagtctgaaatcaaggaccacactccctctgagggcttgaggggagacctcttcctgcctctccagctcctggtgttcctggcagcccttcgtgttccttggcttgtgatctctgcctccctagccacatggcctctccctgcacgtgtctgtgtctcttctgttcttaggattataaatcgtactgggtttagggccaaccctattccagtgtagcttcatcttaactaattacacctgcagacactatttctgaacaaggccagattctgaggttctgggaaggacatacatttgtgggcattgttcaccccagtgcatctttgtgctagacccatctcccattgcctttcaaggacctcatcccgggaatgtcctgctcctcctgcacccgggtcctcctgccctcttgcattgctcctgccaacataaactaaacaagcccctgcccgcaagtcccttcctctttcgaatccactccacttgggctttgcttgccccctctttctgagatggattgaggtcaggtcagcaaagattctgccttgttcaacccataggccagctctccacccctcaacccacctgcatttctggagctgagtggatgagtgaatgaacgtgtgattgctgtagccagactgtcgctgtttttgcgctttggggttgtgtgcgtaggtttatggacgggcctatgccttgatgtcgtgatggaactaccgggcacgtggcagggagatgaggggttgagaaccatatggacgagatcatgaccgggggatcagagatcagggcacagtgagagcagctgaagactcaggtgtggggtgggggctgcggtgggaggagggcagcatggtggtccgaagcccctgctgcccggcccgctcaggctgactgagaagcaagggtgcagagtgtttgtttccctcctggcagaagcgagcgtgcatgtggtaggagctggcaggcccctaacctccctcctggctctgccactggccgactagggatggggacagtgagatgacagcagggccctggggcccagagcttcctgtgggggtggactcatgccaggcagagcgtgtggcctcctctgtgagcttcttgaccaatgcactgcactcagcacgaacagcagttacagggagacgaggcagccttgctcccagcagcacgacctctgccttcctctccttctggagctcagtgcagctctgcccagtgccgaatttgtccgtggccttggttctgggttctgcccgctcagtggcgtgagtgcaggaaggagaatggtggctggcaagggcggggtggacgggagtgagagacgggcttggggttgaggggaggcagcagtgaccctcgcagggaccctgactgagccccggccttcgagctgaggtccccaagccttgctgcatgtgttgccagctctgtagctgggtggggccggggctctggtttctgagcagcttctggggaggctgcctgggccccaccgtgcaaggccccccggccacagaggagaccgcagagtgagctgggagggctgtctgagaggcctggccaggtgggccctacacactgggcatgttctggtgcggactctgatcgctgtgggctcgggcaggtctgcgcagaggtgtgacgagagctgggacccctgacagctgggcgggaacagggtggctgctgaggggtaacagagaggaggggctgggtggaggcagggaggccagctggaggctgccccgccaggcagggtcagggacggtagcgcaggcctggctggtggccgccggtgctagaggtggtcagctgtcctggggcagccacggtcagctgtcctggagcagccacgcactgccgcgcagactcaggaggatggagtctaggctgtggggagaggaggccatgaggggtgggtcagaggctgcagctctgatggggtctggaggtcagagtggaatggtggaggaacgataccactgtccccactgtggcatggatggtggtggggactgtggtggggacggtggcggggacgctggcggggactgtggcagagacgctggcagggatggtgacggagactgtggcgaggactgtggcagggacgctggcagggatggtgacggggactgtggcggggacactggtgttgggaacgctggtggcggggatggtggcggggacggtggcagggatgctgtcggggactatggcggggatgctgctggggaccttctgtagacgtggatgccgcccccaccgcacgatagcggcggtgcatttcttccttctgttttagtggtacattcacaggaaatcacccgtttctagaacttgctgtttcatataggacctggtggtgtcagggagaccagcctggccccatgggaagcgtctgtggctcctgctgcccgtggttagcacactctgctgggggtctgtgtggcctatcatctgtggccacacggacgcagggcctctgggtgtctggcctggttcccacactgcccctcggaaggctgccaggatggaggccatgctctcgcgtgctggggcctttggatgcaaagtgctggcccgagcagtcggccagttccatgctccgtggggagaaggtggccactttagcccctcgctggcctgcagtggccggacttctgctcccagggagacccttcccccaccaggtgaccccaagttaacccagagccttggtctcactccttgggggtcccaaagggatcctactccctaggccagagcaggtctctaaagaagcctgcatgctgtcccgctgtgcgccggctcctgacgcccgctgtcccctctcagtccccctccctgccctgtcctgctcccccattggtggacggtggactgactcaacccctctgcatcccaggaaccccatgggccgcacaggactgcgtgggcgcgggagcctcagctgcttcggacccaaccacacgctgtaccccatggtcacgcggtgagttcatgtgtgccgggcaccagcacctcagcaaggcggtcaccccaccttcacaaggggcggctgccattgcccagtgctcaggggccgggagggcggctttgatgcttggcacttggtgcctactggggggatgcgggaggcgtctgtggataaacgtgaatatgcccgaaatggggcaggaatgtccatgctgcccatcctggaggaagatcccaggacccatcccctctcccggggctgccttcactttcctgccggtccctgcccattagagggcaccctccacggggacacagccccacactcacccctaagtctcactcctccattcccatccacggggacacagccccacactgacccctcagactcactctccacacccatccacggggacacagtcccacactcacccctcagacccactctccacacccatccacggggacagagccccacactcacccctcagactcactttccacacccatccacggggacacagccccacactcacccctcagactcactctccacacccatccatggggacacagccccacactcacccctcagactcactctccacacccatccacggggacacagccccacactcacccctcagactcactctccactcctatccacggggacacagccccacactctctcctcagactcactcctccccacccatccacagggacacagccccacactcacccctcagactcactctctactcccatccacagggacacagccccacactcaccccctcagaccctctccatactcatccagagggacacagccccacactcaacccccaccacaggctcattcctccacacccattcacacacagggacacagctccacactcaccccctcaggctcactcctctgcactccagcagctggcccactgctctcacccaaggcacgggccgccttctgtgcaggtgcagacgcctgcgtccctgaggaagctgccgggggctcttgctgcccccattgggcaggaatgggattctggggcccaggcccagctgctgtgccctgtgctctctggggcctctgcctccacagctgggacctccccccagcggaggggcctttggcttcagggtcctcttgctgcccagccactctcacccagtggcttctctggccgtgcagacatggccctggggtgcgagtcactctctgctccccagtcctttggcctctccttggcctgcccaggtggcactcggcaccccacgtcacccccacgtcacccccgcgctgcactccgcaccccatgtgacccccaggtggcacttggcaccccacgtcacccccatgtcacccccatgtcaaccctgggctgcactcagcaccccatgtcacccccacatcacccccaggtggccctcggcaccccacatcacccccaggctgcactcagcatcccacgtcacccccgggaggcactcagcaccccacatcacctcactggattcccactggcattttctaagagtggtcaaactgcaaagctgggtcaaagggcaggtacctctctaaggattttaatgtttaaaaaattctccatgaaggctgggtctctttctagttctaccagctatgatggaagtgaagaaggacgtcccctaagtggttactatctcagtcttttccctggggatgaagaacttgaaaaagaacacggtttgagcctgcagtgggcctgacactgccccgccccaggcagggccagccccgccgcggcgcaggggagggtggaggccgcagcgggtcctgggcagccatggccgctctctccgcaggtggaggcggaacgaggatggagccatctgcaggaagagcataaagaagatgctggaagtgctggtggtgaagctccctctctccgagcactgggccctgcctggggtaaggctgccgcgtgtgggacctctgtccactgggctgtctgtgggtcactcgtccattcatccattctgcccacggactggacaccagccccctgcagccccctgcagcccctgggcagggagggttcgagaccccgcctgttttgtctgtagaagacactcctcctcccttttcctcatgttgcagttaggaaaacccaggatcagaggatcttttggtgcataaacactaacggggcacctactgtgtcccaggcatgggctgggctgcggctggaggccacctgggctccccttgtggagttcagggtgttgggggcagaggtagctcttctcccgtgtctcagacaccaaccagctcctgaccttcagggccaggtgctgagccataaatataggacggtgtcatccaggggtaggggcaggtacaggagtaggggcaggggcagcgacaggggtaggtagggcccagggttgtgcacaggcccctcagctcaggggctggttgtggggctgaggctggagcgcaccccagcatcttgtggggaggggtgcacacaatcaggacagatggcctgggcctttcctgttcaagtgcctccaacagctcctgtttcctcccaggccagcctggcctccgcagccctccagcccgctcactgcaggggatggaagaggctggtcctgccaggaggtctgagtcctgccaggcctggccgtggcgcatggcctctggggtacagcctgccccgcagggcctctcctctgcacctgatccggggagtctgtgacttacaacaactcagcaagaagctgttgcatttctctgaccccgagctcacggcctggtggctgcctctgctgctgtgggagtgtgtgtgccaccacggtgtgcagggcagcagtgccacaagggcctctgggcaggaacggggactccggagcccaggcccagctgctgggtcccagtgctttgggggcctgtctccacagctggaaccacccccgcagcagagggggcctttggccttggggtccccttgctgccctgctgcgctcacccagtagcttctctgcctgtgcacacccggccctggaacacgagtcaccctccgctctctggcactttggcctctccatgcggggtgcgtggggttgggtttgggggtcccactcactggcatccctgtcagctcaggctggtcactgagaggggcactctgaggggcctcctgggttcctggctctgtagggcacgcacgcttgagggtgggagtgtcatggggctgaggtgggaccgtcttgacgtggcctgcaaagtcttcatgagaaacccacgggtgtttcagtgggactttgaatgacaaatagggtgggaaagatgggtgtggggaggaggaggtgcaggccggagctgggtccctgagtcaggtggcgctcgggagcgtctgggagcccagccagccgcagcacaggccggggtgggactgggagagacgggaatgcaaacagggaacccgccgtggcagcctgctgcactgggcgggagctgggaggggcgacgcgggggcaggcgccaggggagcgggaagggggtgccctgtcacccttggggagtctgagctcagggtgggtaccctgggggctgtccctgctcctcagaggttgtgtctgcagcccagtgccccctgctcgggccacggcaggcctcacagatgctgacgtggacggcgggttctgggcaatgtcactgcagcctgagatgccgcctgcctgtggctcccagggctgggccgctgcccacgccgggcaggaggccagtggagacgggtgccagggcagcctgaggtcccgcttcggtgccctgttgacctgcctccgtcctctgtctgtccagggctcccgggagccaggggagatgctacctcggaagctgaagcggatcctccggcaggagcactggccgtcttttgaaaacttgctgaagtgcggcatggaggtattcctggcctgtttgctctgttccacctgtgtgtccccagggctgcaggacaaacacagtgtgatactggggacctgccccagcaccactgggtggcagcggtcccacccagcttcaccaggtgacggtggtcccagcccctgcccccacgttgcacagctcccagaggacccggaagcatagctgtgtgcagggcccctcagacatctcgccctccctctctgttccattttctcctctctaaatcaagggggatgggctgaggacccttgctgccttcgagtgtgacagctgcttggaggcctggtgccgccctcctccccacatccacccttgcctcgagcacagctgcgcccaagggtgctgggaagccagcccctccctcagacctcgccccgactcccaagctctggaggggcccttcccacatgcatgcccagcctggggaccgactgtaccaggactttttatttacttctttagaaacctcgatctttccttagaaagcctccatctccagctctctcacacaaatgcatgcacactttttttttaatttttatttttggaaacaaggtcttattctgtcacccaggctagagtgcagtggtgcgatcttggcttgctgcagcctccacctcccgggctcaagcaatgctcttgccttggcctcccaggcagcaggggctgcagcggtgagacaccacacccgtctaatattttgtatttttagtagagacagggtttggccatgttgcccaggctggtcatgaactgggctcaagcgatctgcccacctcagcctcccaaagtgctgggattacaggtgtgagccactgcgcccagccctttatggacgctctttataaaagcaggctacacgggccgggtgcgctggctcacacctgtaatcccaacactttgggaggctgaggtgggtagatcacttgaggtcaggagttcgagaccagcctggccaacatggtgaaaccccgtctctactaaaaatacaaaaattagccaggcctgatggcgcacacctgtaatctcagctacttgggaggctgaagcagaagaattgcttgaaccaggcggcggaggttgcagtgagccgaggttgcaccactgcgctccagcctggggaacagaaagagattccgtctcaaaaaaaaaaaaaaaaaaaaaaaaagtgatcaatgccatggtgtggagcacttcacaacattgtgcagccaccacctctatccggttccagaacgttccatcaccccagtcacccccagctcctccccagcactcccgcatctgcttcccatctccttggatttgccggttctgggtgtctgttatgagtggactcctacaacaggtggcctttgaaactgtcttccttcactgagcagacgtttccaaggcgtttccaagatctctgcagggcaaggacgtgtctgtccaggatgaagcccgcattgggctgctccgccttgcaggcccaggcaggctggcgggggctggggagagctgggccggggtcctgtgtgtgctggaagctgtgctcagagctgggtcagggtggagggcacgaggtgggccggggcaccgctcaggtgtccctcgctgtcgggcttaccctgccctgcccatccaggtgtacaaaggctacatggatgacccgaggaacacggacaatgcctggatcgagacggtggccgtcagcgtccacttccaggaccagaatgacgtggagctgaacaggctgaactctgtatgtgcctggcctccctggaggcgggagtggggaggcagggacgggtatgggcgtggcctccggggagggggttggcagggatgggggtctggattctggcaggctgaactctgtatgggcatggcctccggggagagggaaggcggggaccggggtctggattctggacgtgcctcgagggcttccaagggagggacctggccgtgctcctggggcccagggccagaaactggaggctacagggtcagagtcttgcccagaaagtgacaaagggggcaccagggagaggccggggagccacctcaggtggccagagctcacagggctggccaggcgaccatgagggccctgtgtagttctgggacctgggtcctccagggaggcctcgaagatggcatccaggggtgaggctggcaaggccccctcagcccccggctgccggcttttagctctttatggggatgtggattcccagtacttggattaatcctgcatgctcctaattcagaactgggatgggaaattccataaataaccccgggctttaaatgcgggctaaatagctcccggcaaagctgcacctgcatcttcttcccctgaaggatcctcagggccttgtgggtgcatctctggtgcacctgacgcaggggtcctgcctcccatttcacagaggagtaaagggagggtgtgcaggccccaagccctcgaaggctgcagtccgtagggctcagctgggcagaggcagggctggcggggagggtcagctgtgcccttgttcttccagaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccaggtatccccctcaccccatcagcgtcaccaaggacacaactgaccccttatgccctgcttagaatcagtcccgtcaccaacttttgtgacggagtcaccttggggtttgataaaaatgtagatcttcaggcccctcttgaagctcagaggcagcagggctgggaggtcctggaagctgcatctgtggtcagcatccgccactcccaaggggctcgcaggtggcgggtttgaaccacaaagcagcctggatgtggcccaccccacccctctccagctccctctcctgctgcagccaatccatgctcccttccacggtgcaatgcagcctccacgtgcaatgcagcctccacgtgcaatgcagcctccatgtgcaatccagcctccaggtgcaatgcagcctccacgtgcaatccagcctccaggtgcaatgcagcctccacgtgcaatgcagcctccacgtgcaatccagcctccacgtgcaatgcagcctccacatgcaatccagcctccaggtgccacagggaaggcctgtgactcctcggttactggccgtgggtccagacctctgccagggaccatgttgtgctcagtgctcctgtttctagctgcaccatcgggctgagctcccactctctggggctggtctcggctctgtgtctgcaggatctagaaacacccatgctgaaggtggcacccagggaaggggtgggggctgtgcctgggggtcagaccagagagggacgccaccaaggggatgggcgtctgctctgctcacttgaaacacccatgacacgaacttcgccattggaaccatttcagctgcacagtgcagtggccgtagacactcacacggctgtcccccatcaccaccgtgccccctgctctgcccactcctagaagcgctgctcctccaacccggggctgctgcctactccagcagcgcccccagggggccccgtggctgagctgtctgtgggtgcctgcttgggcccagccacacaccaacagcggccctgtgggaggaagttttgcctccttttgtagagggacctggggtgcggagagggcagagggcttgctcagtcctctcagcagctgctggcaaagccaggcctggacccagctctcctcggctgtgccgtgcagcagccacagaggtcagcggctcttcgaaccaaatgggaaaccaggacatgcctggtggaccacggactttttgcgagtcaggcatgaggccttctgatcattcactcatcccttcctacctggttgctgagcctgtctgtgccctggggatggggatttgaggggtgcagtgatgaataaaacccatccctgcccgagggcctcacaatcctggatgaagtccactcaggaccgcaggagccggaccgggtcggaggccggggaagagcaggcattccagcggaggagtcagctggcttctccagtgaggcggctgagagtgaagactccaagggcagaacaaacagcaaatgggagacaggcaggggcacgttccacagcacagacgtgggccagcccgctgggggcagtgtggagcaggcagtgccctcatccaggacctcagcattgaaggaagcgagggttctgtgaaccgtggtctcttagaggtcactgccctctgagggaagagctcacagtgagcaagatctgggtgggggctggcgggagggtgagcggaagctggctgaatgcagacacgatggccagagctccagcagccttctggggccatgaggatgaggcacccgctgggtgtggtggagtgggaggtgacaggctctttagggccccgccctccagagtcctttcttatgtgagaagggaatactgtgtgttaaagccactgttattttgggtgccaaccaattttaacctaaaattggttaaatatgcagccaaccaattttcatggaatcactagacaacccagaaccatcaaatgtttgaggaaaaccaatcactaccaaaaaggggccccc

SEQ ID NO: 16972 - DNA, 14340 bp, Human
acatgtcatcaggacctcctgaggctgtgtcatgggcttgtccttaaccttgacaaaataaactttctaaacagattgagtcctgtctcagatattttggattcacagctgctaagctgctcggttacaattgaaggctcatgggttaggggttgttcaaaggtagtttggtgaacagggggctagggcatggggagtgctgattggttaggtgcgagatgaaatctagctgtccttttggtccttttgtgctgcatggcttctgggtggggccacaggagctgttggcaagacatttagctggatccatccgtgtgagacatgcaagaaacctgcaaaggtacaatagtgatgttacctgcaggagtaattggggaagtagcttatcttgtgacctccagaataatggctgacgaatgtttacatctgcatcttagtggaattcatgctcctctatccttctaggctggtagtgtaaccgcccaatgggttcgccttgcccactgcctagacagaaccgatttatcaaggcaacggaattgcaatggagaaagagtaatacacacagagctggctgtgcaggagagcagagttttattatcactcaaatcagtctccccaagcattcggggatccgtgtttttaaggataatttggcgggtatgggctcagaaagtggtgagtgctgattggtcaggtcgaagattaaatcatagggggtcaaaatgagttctggctgacttctgtccctgggtgggatcacacacatggttgagccagattatccgtttgggtggtgtcatctgctgcatctgaatgcagggtctacaaaatatttcaagcactgaccttaagttttgcaacagtgatgttattcccagaagcaatttggggaggttcagactcttgccgccagaggttgcatggcccctaaactgtaatttttaatctcgtagcttaatttgttagtcctacaaaggcagactggtccccaggcaagaagggtttttttgggaaagggctattatcaattttgtttcagtttaatctataaactaaattccttcccaaggctagtctggtctacacccaggaatgaacaaaagcagcttagaggatagcaggaagatggggtgggtgaggagatcttcccctgtcataatttcttcagttatgatttttgcaaaggcggtttcagtggtctcattagctttacaaaggctgtttagttttgaggaagggctgctatcacttaaactataaatgtctcccaaagttacctttgcttatccaggaataattaagggcagttttaaggccaaaggcaagatgggggttggccagatctccttcaaggccaaccttctctcaccgatacaattttttgcaaaggcggtttcagaacgtcagaacgcctgtcttaatgtaactgtggcccatgtaacgatgtttagagggtcttatctgatttctaaaaggttgaaatgcttgtaagggctctgctggacctgcccgtgcgtctttcctataaatgcgtcttttctgtaaatgctgggagggagggagacaaggaatcaacacagccccagggctgccctgggtttattccaagagtttgaatcgcgtaacttggagctgtgtagcgcccatgccatccacgctaggcctgcgctcagagtcaggcctaggcactcggccatgatgcgcgtcggaccgagcccaccccgctcggttcctgggagcagcagttcagccctcactgggccgactcggggaccgccacctgcacccaccctctgctcgctgcgcgcttccggggtcgcgttagaatcgcgtcagagaagggcgccccaggccgcgcatgagcaggagcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggtgaggcggggcctggccgcggccgccccggggtggggggaggagccggggcggggcgagggcggagccggagggaggagccggggcggggagagggcggagccggagggaggagccggggcgggacgagggcggagccggagggaggagccggggcggggagagggcggagccggggcggggagagggcggagccggggcggggagagggcggagccggagggaggagccggggcgggacgagggcggagccggagggaggagccggggcgggacgagggcggagccggagggaggagccggggcgggacgagggcggagccggagggaggagccggggcggggcggggcgggggcggagtggaaggggggaggggcaggggcgagggcggcgaaggagccgcgggtgagggaggggaggaggccgggggtcggggtcgcctgggcccccccccatttcccggcccgcctttgccccgggtgccctgtgggctgggtctgttgtctggggttgccagcagtcactgggaccaagtcgaataggagagagaactgagctttccaggactgagtcaggaaacacgttggtaatcagtactgggggcggccgttcccagggtactcctagcaggtgacaggaagggacgtgggtgcggtgggacccaggcaggctgaaaggcaggtaatgctgagtctcactgagccaaggaagaccaggagcttccagaagagggagcctggagttgaggcctgcaagatctccagggttccctggggactcagcagagtgaccgcgccgtgtcaactggcctcaccgtgcaggcgggtgtgggggtcagcgagagcagacgcttcctcccaggggtgtccgcagactgcccagagtgagctcttccctgttaattaaaaagcttttctctctgccctggcatatctggtgttttggctacaattcccgtgtcatttgctttcaataatgcatttctttgttttgcatggggtggtcagtactcccactaagctgggagaaacaacaaccctgtttcaggcttttaaagtttgcttcataagttgcctgttcaccctttgaacttggcctcttataaagacgcccttgtttatgtctgtcagtgagagaaatgaaccttctgctactcagggaccatgaggaagagttcatctttttgtgtcttacaaatggagcaaccctgctgctccttatctaaaaagtaccaccccaacgtcaaacatacagtttagttgaaaatcagctaaaacaattgtttacacctttgccagttatctgggcaaccttccttttttgccatgccattaaaatcctagaatcttaaggtttgtagggagtcatcggtgatttttggaatttttgtcttcagtgttttttattcaactttaacaaaattaaagtatgtatcttttctctccccaggggcagccgcctcacagatgtaagtattgcctcacagatgtaagtattgcactgatcatctccaaatagcctcaacccaaatgttgtagcttctttcccaagagaatttttaagttgacaaaactgcacctatcaattcagtcccacacttggtactttgttcacttagcggttttcattctgcagaaccactaatggaaaaacaattctctagtgccaggcttattttgcagttcccgtcaacatccctataaatgaaacaccctttgtcacttggtcgcagaggaggggagcaatagtttggaacttgctctcacctggaaaggaatcccaggagggcttgttttactttgttacggggaagttgaaggtctacaccccctcttcttggtcacatctagccttgtacccccttgccgctgccccaaaggcaggcagagaataagccctgctgggagaacttgagtgtgtgcgtctgtgaaagatttttttcttctctccctcattgtctttctcagtccaaaatgtccccaacttacacagggatcgcataccaattgtttctttcttttttttttttttttacacggagtctctctctgttgcccaggctggagtacagtggcacgatcttggctcactgcaacctctgcctcccgggttcaagcaattttcctgcctcagcctttgagtagctgggactacaggcacccaccaccatgcctggctaatttttgtactttttagtagagatggagtttcactgtgtcggccaggctggtctcaaaccccctgagttcaggtgatccacctgcctcagcctcgcaaagtattggaattacaggtatgagccaccatgtccagcgcaattatttatctctttattttcctttgtttttttaatttgaactgtaccttttcttaaagacaaaaaaaagcctggatacgtggcatctgggtgtaatctgttttgtgctgtaactgaaatactgcatgtttagcagtgaatatacaaacgtaccatgtccatagacacgagtcacttatacatgggacgcatctgaccaggctgtgagctgctggtgccatgcctggcgtatggtgggctctcacatatgtgggagctttgcaggttgtgaggctttgtggaccaccccgggcacctcacccctgaattgacagtaccaatgtgatctgagatccagtctcaagcctgtcttccttttggcctagacctgttatcaagaagggatttccatcctttccttgctttctatccctgcgtaggggacattggggtccccttacctgatgtcctttgagggcatctaaagtaatgaatgctctgtctccactgctggcagcatctgacagcaacgatgctgtcgtaaaatttaataaagacagagtgcgtgcaaggaggagcctcacatttctccttcagtctgcggggcgtctgggctgcaaggtggtgtcagaggagaacctggcatactcgtgggcattcatcctgggcacactggctgagcagggccgctcccctcaggccctgggcattcaccctgggcacactggctgagcagggccgctcccctcaggccctgggcattcaccctgggcacactggctgagcagggccgctcccctcaggccctgggcattcaccctgggcacactggctgagcagggccgctcccctcaggccctgggcattcaccctgggcacactggctgagtaaggccgtgcccctcaggccccggaagtgggttggccgtggcttcgacagttctctgtggctgatggcagtgcggccgcgatgccctgctgtgccatgcttgctagtcatgttcttttcctcctagatctccatttgccaggagatgcccagcctggaggtgatcacgctcaggtacctcgctcctgctgtcatgctcagcctggggcctggaagccggggcagagcctcacgtccctccagtgggacccagcactgtgacataacctggaaacctccaacacagactgagggcggcttccagaaggggaggggccgggacagcgagagctgggcctaccctgtggcccccatgttcagccctccttcctcagagcctcacctgggcctcctgatggctcctgtcccctgcctgccctgctgtacgcctgcccacccttggcctgtgtgctccgataagccattgctgtgttcactgggccagtcggtggtggagccctcctaaggattcacggtggcccgccctggccgcccccacggtggccacatctgccctgggacccccagagtcctggcctcttctgccccccagtgccaccactgcctaccagtttctctgcaccccatgacctgtgcccgtcttctggggtcactgccctcccagcagactaagggaagcttgaatgaacaaatgttactggactttcaggcagttggggtgtatttgggggctctggggaagagaagagctccctttatccctgaattccctcctgcctactgtgggacccacggagggagcagacgctcatggctcaccactgcccaccagacgctggatgggcgccttctgtgggtttccgcatttaaaagctcacaagggtttaaaccctgtggggaaggcccacccctctggcagctcagaagtctctagggcttgccctctgagagtgggtattgcaggcccctggtccctgactgtgacctaccttcttgatctcacaggcagccacggggtaggccagcccctgcccatcctccgtaatgccctctgaggttggcattgccatgttgatgcccgtgcccagcctgctgcccgccatgggctgaggccagtccatctggtgttcaggcatccccagcgcgggcaccagcctgtcctgcccgagccttgctgaatgaatgaaatgggcttggaggcatgctcatgggtcaaatctcagccctcccatctattggctggctaaccttgggcgaggcatggccctctctgtgcctcagtttcctttctgtaacatggaggtattacaagtgcccaccccacagggagatgaggaggagatggagcccgagtccagaggttgagcaggggtgcgcgtgcccgcccagaggttgagcgggggggggggtgcgcgtgcccgccaaggttgagggggggtgtgctgccgcccagaggttgagggggggtgcgcgtgcctgccgcggggctcgtttcactagtcaggcgacacagtgaggctgggatttcaggcctgcctccgaaaggcttacctgacagggaaacgtggagcttgtggttcccacggtggcaggaagcttggggcggggctgtggatccagccctatccctgccgctcactgagtcacccaggggccacagggcctccgagcatcaggccgctcgtgtgtggggccatttctgtcacatctcgggagggacaggaccccaggggtgttgaccgagctcaggtgcgtggtgcctgcacgcctgactgcactggagcggagcaggaagcctcgaggccgcggacgcggtcggtacatcacgctgctgcctgtgcctgaggcagaccccatcctggaaagagtcccacagccggagttttgctcttggtaaaatggggcggcctcatagctaggagctgcatgagacctgggaaaccccgagtgaagggatggcatggggaggggggctcaggacggcaggctgcccatgggggcctggtgaccgcccttctgaggcgcctgccggacgcgagtgcagccctccaggcagggggccctggctccgcgcctttgagggcctgcgggagcggctccgcgtgttcgcttgtggaggggacggaccccacgctgcagggtaaagcctgcaggtccccgctccaggcctgctgtttctcttctctgacgcgtccacgttctgtagaatggaaatgaggcccatccccagtgttgccgccctcaagtgggggtttggaaggtccgtgctcactcccatgtcacgtggagctggctcctagtttttgccatgagtttttctggccgctccctgctttggggcaacatgatatgtcccctgagaggccttaattttcctcacctgtgaaggagggccacatcccccacctcccgcactctagcgccctgaggagctgatgtggagcgtcgggccaaggggctgttgctggtggggtccaccccagtccgcctttgagttcagggcctggccttcctacagctctctcctcggcccaggtcctgctgcacgtgacttgtgacatccgatttaggcttctcaggagagggcagggacacaggtcccatgagtgccttttactgggggtggggattgagaggtggccctgggggccctggccacgtccctcgctgactgtgctggtctccgtgcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccagggtaggtggccgcagcggagtcaccggccctcccaaaacaatccctggaaggggatgtccccagccctcttttctcttctccttttctgcaaatacctggtctggcgggacatagatgtgtcctgtgaagtctcctccagaggctgttcccctggcttctgtgtctcctcttgatcccgccacccgaatgcagcagcgcagcgtagggtccctcctgggactgacagtttgggtatcccccaacgaccgcaggacctggtagcaaagcaaaagggttccttcttttgcttctgtgagtagcagccctgctctgaccatcgccatgcgccatggcgagcgggggcgtcagtatctggcaagcagcatcgcactggtccacagggactgggcaggctccacgggccactgtgaacctagggtggcggtgccatcgcgcccctgccgtggggaggggccgtcccagcaccgcagtgcctgctgctgcgctccacctattggaggcgctcgtgcctcctctagccagcgccagcaccgacacagttttccaggctgtggtttcatgctgtttgttcatccttggcattctcagcacactagtgtctcatccttgtcaggtatacggacaccactattttctcccagacaattttattgatattaataatataaacttcagggaaattgatatatgagagaaatggaataaattcaatatggtctgttcctttttctattgtgtcgtagttgaggttttgaggagtatttgcttctggccaaggctggtgttgagattcctgagcagccctccaccatctgttgtgtgtcagcctgtgccaggctggggatgggacagtgaggaaccggctgctactctgggagttgtccctggaggtggatacacgtgcatgcatttcacaagcagactgtgcctgaagccacagtgaggacgggagctgcagtgcatgtggcctgcacgtgggtgaggccactcatgctgtcttctgtctttcatcccaaagctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaacgtgaggctggagggcagcggggactccgcagcccatccctgtcccccagggtcctcccacggggagtgaatggggcttcccgtgagctgcgtctctgggaagtgagggacagggattatccggggggagtgtctgttctcatccatattctctgggagtgactcagtgcccaggtagtgatttcagtggcaggtccatgttttgcccaacagcggatgtgccagggagcaggagagggggtgagccaggccccgtgccctggcacagagaaggctcacagcaccagagctcgtgaggtgcagggagcccctggtggggggggtggcctagggccacagtgactggaatggtttgtgggcacggccatcagtgcccgtatggccttgggcctgggggccgtggaggggccacagggctgactctgcagtgagacgccggcgcctcccagggcagttggcagcgggtcacgaacgcatttgacagaagctgggcacttctctcctgcttggcagatcacacccgctgctggtgcctgtggtgggggcatcgggatgtgatctctgttaggcatctgccatccggcacagggcctgaccccatggtcaggagctctcccccggcatttgtgtgttcgggtgccccccaccctgcccctgaagccctgggtggaaggtgttacagctggggagccccagggtgccgggagggcgccccacaggtgaagtaagtgccgggctctccaggagctgccatctgtagcccctgacctcccaggagttgcctcccttctcttgcccccgtgtgccaggtgggatttgtatgagcccctcctttgcttggatgcgacccgcagacagggtttgcagaggcccccccggtgccacgagccccctgaccctcacacgcctttgtctccctctcagcagcggcgcccaggatgaacgtggcctgaagccgccttcccggggccagtttccttccctctcagccagggatgcctcgagcagccacaggggcagggtgagtggcgggccgctaggggccgcggctgcctctgcccactgcacccactgcacagaaaccgtggggagggagcatggagcctcacagggccccgtggggagggagcatggagcctcacagggccttgaagagctgtgccccagggggagctgcgtgtgcgggtctgtgaatgcgcacacacgtgtaacacgtgccccgcacggagccgtcctggcccctcagcctctcctgctgtcctggtctgtggaatgtgggcccgggccctgctgggctgagggcaacaggagtcacgtggaagaggtgccacacacgcgtccacaggcggggctcctctgctcagattctccgagtgtgccggtcagtcacttggacggcccacacccccgggaccagtcgctccgtggtggggcaccgctggccaggccccagcccttgtggagggaagcagcctcgccgtgccgggtgggcttagtccgcacccctctgccctcagaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacatctgccctgagctgctcagcaggcaggcagcagcctcccgcacccatgggagagagttttgttttcttggccgggctgggcaggtgcgccttcctttctctctcctgtgaagaactgcaggagggccctcagctgtgaggttgtggatgaacaggcctgttcgccctggggtccgggcctggcacaggaagcagctagactaggggagtccttggagcatctgagaggggttttctttcctctgggaagagtcgcaagtcttatgaggatgccacaatctgggcagtgacccgtggccctggggaccttcctagtgccccccaaaaccaaggaagcattcacgtgagatggggagtcagccttccagctggtgtgtaggaaagccaggtccctgggcccttgtcccatgtggggttgagatccagatctccatgagatattcccatcctccgccgagcggtgatgcgtgaccgtgtgtgcaggccgctgttctcccaagctcggggccatgccgtgccaccgtcaccagagccagctgcagcactggggcagccactgtcgccggacttggggaagcccagggtgaagacagtcactcatccgtgcaagctctccagaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggttgaggtcgttttaaattgagtcccttccacttcccccgacatgggctgccgtggacatgcggggcttacaccagcgccctcctgccccacatcatgcacaccttgggtgggacctgtgggggcagctgcctgccttcagccccacggttccccctaccccgtccccaccattgccgcctcctgcctgttcccctcccggcacctcctcacccaatgcacccagccatggaggacagccagaagcacgtccagcccggggcaccccacagtcccactccactcctccccaagtcaccccaaaaatgggttctcaagccgagcagcactggcatcacactctgtcccattcacccagttcacaggagaggaccaagggcccaggaggtcgcgtcactctgcccgaaatgccagaaacgccaactccacgcagccagaagtgggcctgacgcaggcgctcgccacaccacgtcgcccaggagggaggcagccactgtcccgggcatcagccacaggcgaccacctgggtgcagcagctgagtggcagctgaacaggttctaacacctcatcaggcagggcaggccgagggggtctactcagaactgagtcctgatcccagacggtgtgacacaacggaggcccccagagcatgcctgtgtggttccctgggcctatgaacctgtttctctcttcctttgagacagagctgcagaccccggagcactgtccttggacaactgtccactcctgggcctggccccaggatggcccagctcagaatgaactagaaggccactaggtgtgggcccctccaccccagctcgagttaagcaatctggaggcctccggcactagggccaacacagtgaggggctcttgggaatatcaaggtgcccgagggcaagagggtccccagccccttcaccaggtccctaggccaccccactggcctgagctcaaccaggagactgcccaggggccctcaaagtggcccttaggcccctccaagccagggtctcccttgagacacctcctgtgtcccaaaaccacatccccagggtggcactgcgggcaggaagcagccctcttgggcaagcacctcccacgttcatgatgcagagcgcaggcttcgacgctgaggttaacaggcatcctgcaagcagggcgtccaccaccccgtagccgcctgcaggactcagccctagcccctggtgggcgcagctctgcgctgccttcttttcccctcttgcgtgtccaccatcaatgtctcctggatactggctcaagccagccaccagcctgcaggttggagacccccactcaggctgaggttggggagacagaggagtgaggctgtacccttctgcccccaggggaggaccaggaggggctcaggtcaccctggtggcccccagggagtcctggagagcacctgtggcctctcagggcacatgtccctttgacctggcccaggcactggccagagggccctccacccctggggctgctgcccactgggctggccgctcggtgctgctcccccctctctctgaggagttctgcaggctgtgctctccggagaccgatgcaccccacagtcagggtgattttatttctagaaaaggtgacaggtgctgcacgtgggcaggagcaggtcacagtgaggcagggccaggggcatccccctctcaacacaacctaggcgccagcagcctaccggccaggtagagcaagggctggcccatgtagtgagcccagcatggggagacgctgagggcccatggggcgccaaagccagggggcagcagcctccaaacaccgacagcgccacgtcccctgggcaggaaggtggatgccccagggcactctgtcctcctgctggagggcctggcaggctggtctcaagacaccagccggagggaggcctggcaggtggccagggatagaggcaggggatgggctgagcagggacgcagcccccacctgcctgcaggctccag

SEQ ID NO: 16973 - DNA, 19826 bp, Human
attcagcctcccccacgcatggccgtcccccaggcagccattgcccccctccctccatacgtgagtctcaccttttctagagcggcatagccacgaaattacacggtagggtcttttgtggaaggcgtctttcgctcacatgatgtgcttcagactcatccatgttttacatagagcagttcgtttctttttatcgctgaacagtgttagtgattgcacagccgcctagctcacctccaaaggagagacacgtaaaacagccttttgtgtttggaatgccttttccagaagatcccttgatacgagagccgcatgtttgctattcttgatgccctgctggtatcgtgtgagtgttccagtctgtctgtccaccctcctacagagtgacatctgggctgtgttcagcttggggctgtcacggagccttcctgcgcaggtccatctgtggatgcaggcgccttctctcctggatgaaatactaagagtggaattgctgagtcataggtggtcgcatgtttgtttaggagcagctgccagaccttctttgcaaatggttgagccatttacacttccaccaacactgtgtgagagttctgttgctgtacatccttgccaacatttggtattgtcattctctttaattttagccattctggtaggtgtgtagtcatctgtcatttggagttttaatttgcctttgtctggtgactggtgatgagcacagagctcttttcagcgtgcactgtgtttgtgtgtgtgtgtgtgtgtgtgtgttatgggattggagtaggcagtctgtgtgtgtgtgtgtgtgtgtgttacgggattgggggagtacgcagtctgtgtgtgtgtatgtgtgttatgggattgggggagtaggcagtctgtgtgtgtgttacgggattgggggagtaggcagtctgcgtgtgtgttacgggattgggggagtaggcagtctgcgtgtgtgtgtgtgtgtgtgttatgggattgggggagtaggcactctgtgtgtgtgtgtgtgtgtgtgttatgggattggagtaggcagtctctgtgtgtgtgtgtgtgtgtgtgtgttatgggattggagtaggcagtctgtgtgtgtgtgtgtgtgttatgggattgggggagtaggcagtctgtgtgtgtgttacgggattgggggagtaggcagtctgcgtgtgtgtgtgtgtgttatgggattgggggagtaggctgtgtgtgtgtgtgtgtgtgtgttacaggattgggggagtaggcagtcagcttggttgcatgttggaagttactcatgcagtcgctcttgcttctgactggcttgagttccagagctgttggctgcgtggagtttgaccccttccttagtagcagcgctttgagtagtgggcagagtctcagggtgttctgtgtggttggagcaggctggtgtgccgggcctctcccttggtacaggttggtacagggagcatagcccagtctggagtgaggctaccaggggactaagaccttgctttgtcacatgagatctgtaggtgagtccgaagacacaagtgtgctgcgtggcagtgtcgctggcgttgctgtggcctcggatggaggctcttgggttcccaaaagagtgcctgctgatgagcagaaggtcccagcaggtttgtggttagtgattacacagccacagggcacacttcctctcacagagagatctgaaacacagccttctgtgttggcactcttctctcccagaagagcccttgtggataggagccgcatgtttatactctttgtgccctgcctgcagcggggttcctgaacactcgttccacatgtcttgaagaaggcttgttatcagcaggggctcaggaagaggaccttcatttggtaattccacatcagaggttcttggtgccacacccctcactggtgcccaccctgccctgctggactaatatttacactgcctgattctcagtgactgacttgtctcttgcctctttcctgcagcttgttctcagaacacaaacaaaacctgtgaagagtgcctgaagaacgtctccgtaagtagcacgtggactagagaccagagtgccgtccagaccgtccaaaggcacacgggctttctctaggtccagggattcgctgggatgtgtggagggctctgttgtttgggatttggggggatgttttttggaatcgttatcaaatgttattttagccatttcaggtatattaaaccttctcatgaaaactgcagttactgtctgagcatggtcagtatccatgatttcactcctatgcagatggggccagcactgcgtggccagtcttcctaacgaggcccatagcgagaaatttggctgtccgcaaagctacaccctcaggttgtgagcccgtgttttcccaggctgtcgggctgcagcagagactgctttctgagctgctcacacaggattggaaggggcacagcaaggagagagaggcaccagccctctgggccggtgggccaggctgtccatagcactctctggtcgtgacctggggctcaggtttggattttaactacctgtgtgaccttcaacaagagggtagcggtctggagcaaagttccctaagcctccacggcatgaggtggggcccgagactccccggggtgccttcccgatggagactgatgcagatgcccacctggaagaaggagcacccgtggtggggaagcagcatcacagtgcaggtcttgttaaagacgtgtgaacagggctgggtgcagtggctcacgcctgtaatcccagcactttgggaggccgaggcaggtggatcacgaggtcagcagttggagaccagcctgaccaacatggtgaaaccccgtctctactaaaaatacaaaacaattagctaggcgtggtggcgggtgcctgtaatcccagctacttgagaggctgaggcaggagaatttcttgaaaccggaagtcggaggttgcagtgagccaagattgtgccactgcactctagcctgggcaacaagagcaaaaaactgtctttaaaaaacaaaaacaaaaacaaaaacgtgtgaacagggtcctttggttttctctgcgtggtggcctgcgcctgggccagcctggctggcacctcttgggcttgccttgccacgcagctcttggttcggcagcacccaagtctcctcgcagcgctatgaaatcagcacgggaaacctgagggaaggcccacggcagcgggaagtggttaggcagaaaacagcatcctgtggggcctttttcttaggattcctgatctcgcccaccccttgccccttccagtcaggagtttaccaggttttgagaactgcagggccagaggcttcctttccccggcaatgaggtttcatgatatgaggaggccgggaaagatgtattcgatgatttctattctaaggcatgagccatgttcttaaaaactcttcttcctccacgagaccgtagcgtaggtttgaggaggccgggaaagatgtattcgatgatttctattctaaggcatgagccatgttcttaaaaactcttcttcctccacgagaccgtagcgtaggttcgagacacaccctgtcagtttgtgggacttaagtggatacttgcatttgctgattaaaaattgaaagacgctgtttctgtggtttcagatcttgacattggtgatgttgaacttgctctaatgcgcctggtcctggtgcattttctagatggtgcttctttttagtctctggatttttctattggaagtcatttcagctttaaacatagctcactattgtatgtggctttgtagcctagagtgcgtttttgccatagtaccctgtgtaaccctcaccaccctgggcagggtgtggtgatgacagccatctcgtggatgaggcggctgagggacttgcccaggtcattgtggatggggccagtccagaagggctgaaggcctgactccagttctgaacccagacagggcggtgaagagggccgcttgccctacagtagctccaggcgtgtgtgggtgtgctcttgggcacacaggaggtttctggaaggaggtgtcagtgcctgggaggtctcaagaggaccctgcgtgttggagcagtggctatggtgggctgtgtccacgctcctgaggccgtggcgggctgtgtgtctctgtgttgccgaggccgtggcgggctgtgtctctgctgctgaggccgtggtgggctgtgtctctgctgctgaggccgtggtgggctgtgtctctgctgctgaggccgtggtgggctgtgtctctgctgctgaggccgtggtgggctgtgtgtctctgtgttgccgaggccgtggcgggctgtgtgtctgtgctgctgcctgagctgcttgctatgtgcatattacttcatcgatcagaaaagcagcacaaccaccagagaacaccgtatcctcccagtgcagtcctgtggctcatggtaccactgtcatggaaaaatggaaaatcagacatttacaacttgagccacttgaaaagggaggattagccaaaaatcgttaattgcaagcaaaacccctgaaatggaagatactcccaaatgaccagaataaacagggtttaactgttaattgttacattatgctggaaaccacttaaacacgacactaaggtggtcactgtataagtagccctgggaaagaaggcccaggggacattgtaattaatatttttttgtaatagacttttgccctaacctgggccaaaaacgccatgactttctatcctattaaaaagtcagtaacactgttaatgtggagattgggagtaacaggcagtctggacttgggtctggacttgggctggcgcatgaggtgctgccgaacggcagttcttttttttttccttttgagacggagtttcactcttgttgcccaggctggagtgcaatggtgcgatctcggctcaccgcaacctgcgcctcctgggctcaagcgattctcctgcctcagcctctggagtagctgggattacaggcatgtgccaccacgcccggcttattttgtatttttaacaaagatggggtttctccatgttggtcaggctgatcccgaacttctgacctcaggtgatccgccctcctggcctcccaaagtgctgggattacaggcgtgagccaccgtgcctgacccgaacagcagttctttcaccccttcctgtgccatctgcctgcgtgctaggctgtcccctgtcacgctcagtgcctggctcacagaccgctttcgggcctcgttgtgtactgctgtggcatgggctgggcccagctctgggctcttacacacacacacacgggtgtgatggtgttgtctccacaccactgcggcctcacacctgacgttcaaggggctcagacaagagcgtctatgaggttctctccagctgtcagtttagggcgggctgagccgtagttgcatcatctttcaagctgtgcgacttagtgcagttgtgaaggtcagaggtaggaagcatggtccttgctacagatggtgaccatgctcacccaagtccattcaacacaaactcagtgagtgcctgtgatgggccaggctgtgtcctgtgttcttgggagacttcagccagtgaagtgcacaggtgcccggcgtgtggggaggagaggtctacggaagcaaacctcacaggaggtgaggaggagggggtggaggcggctggttgtgtccagtctgttgatcgaggcagggcccatccagtcagtggggagccacacagatgtggggagagtgctccaggcagaaccggcaggctgagctgaggctgagagcatgaggtggggttggcagcactcaggaggctgccaacacagaggccccgtggcctcagcagggtgagttgtggaagaggcctgagtgacgcgggccttggatgagtccgtggagagctgacagggctgctggccgctgtgctgggtgtggaccgaagggcgctgagggtgaaggcagagatgaggcgttgagggggaggttgagcctttacagccatccacagagcgatggcagcactggcgggctgtgggcagagcctggacagttctttggtttttctgttgtttctaatgcttgcttaatgttggtctctttcagtgtctttggtgcaacactaacaaggcttgtctggactacccagttacaagcgtcttgccaccggcttccctttgtaaattgagctctgcacgctggggagtttgttggggtaagtcattgttttcatttgctgcttgcaaaatcgatgcttctttgaaaatagtagtatgggccgggcgcggtggctcacgtctgtaatcccagcactttgggaggcggaggcgggtggatcaagaggtcaggagattgagaccatcctggctaacatggtgaagccccgtctctattaaaaatacaaaaattaggtgggcgtggtggcatgcacttgtaatcccagctacttgggaggctgagacaggagaattgcttgaacccgggaggcggagtttgcagtgagccgagatcgtgccactgcactccagcctggcgacagagcgagactgtctcaaaaaaaaaagaaaatagtattatgtgctcagttagcagaagttgctagaaaatgtgctgccagtagctctgtgactcccagggagaggttgggaagccaggggtgatctgctgaccgggaaagcagccctggggaacctggaggacctccttcaaggtggtcagccccagcactgagctctatctcaccacgttacagaaggtgtggggaaaagggtgagtttgaaggcaacgtgtttgacttctctgctcagtatgttttgttcatgtgtcacccctgaaactcacctgtgaattcccctagaatctccagttttcccagcttaagaatccctgcttgcgtagacagccctctttttttgtgtgcgtatctttgtatatttgattttggaggcgtttttaaattaaggaaatcagctcttgtgagattcaagttgttttctagtttgcctttatttatttatttatttatttttgagacgggctggagtgcaatggcactatcttggctcactgcaagctccgcctcccaggttcacgccattctcctgcctcagcctcctgagtagctgggactacaggtgcccgccaccacgtccggctaatttcttgtattttttagtagagacggggtttcactgtgttagccaggatggtctcgatctcctgacctcatgatctgcccacctcagcctcccaaagtgctgggattacaggcgtgagccactgcgcccagccccgtagtttgccttttaaatcagtttgtggtgtgttttgtaacctagaactcattattatgtagttgaatttattaatcttttaggcttcaggttttggggtaatacatagggttcctaaactttgtaaagaagcaatattttcttaaggtgttttgatgattctttttgtttatttgcatcttggatccctctgcaacttacgtcttacttaccactcttctaattgatttccatttcaaaatctatcagcctccatctgaaacaacttgttgctggtgttgaggccctagagaattcaaaagtttgtgtggtggtggtggttgtagtgtgggatgtctggcagggggtggtggtggtgtgtgtgcaccttcatgtgtgatgtgtgtactgtgtgtgatgcatgtgtgtttgtgaactcatcccttccatggaacttctcttaatgaccactctgaagacacagctcctggacctggggagccttgccctttggaacacctgttctggaggtgtttttaatggcatgtagcttctcatgaagtgcacacatctgaagtctctctctgcatggactttatagcctacataatgcacacatgtgtgcctgcatggaccgcagtttatagcctacataatgcacacgtgtgtgcctacatggaccgcggcttatagcctacataatgcacacgtgtgtgcgtacatatattcagtgcatttttgcatacgtatacaggttatcaccactcacagcaaagtaggtaggacttccaggactttcagaaggcccaattcctgtcaggacccccatgggagccactgactggacttcccgtcaccacagattaatgttactggttcccgcctttatgtggaggaaatcctgtgctttattggatgttttattcagcatgtgcccgagattcgtgtcaattgcctgcaccagttatctttctcgtgcagtgttctacagctgttcagccatgctgccactcagggacgcctgggtccttctggtgctgctgtgagcggtgttgtgttggtgccggcacaggcgctcacgtctggaggagtgtaggagtggagttgctgtgtcacggagcatatttgtgtttagccttagtacgtctgccaaatgtttttggagtggctgtaccagtttggcctccctcaggcaatgtgggacttggttgctccacatccttcccaatgtttagggtaaccagtcaccctaagttcagtccatctagtgggtgtgtagtggtgtcttgtgcttctcacctgcatttctgcagtgactagccgatcgtgctgagcacctttacaagtggtgggtgtttttgacaattctcttgtgaaatgacatccccacgctaggctgcagaagtggatggacacacaacacccagccctgcacatgagagcggcagcaggtgactagtcacagtcacagtggggagggggcaccacacgccacgcagggtcccgcaggggaacagggctcggggaggcagccatttcgtgacaggagggtggggtgcgatgggcttgtttggttaattctgaggctgagagggaactgacacctgctcctccgggagaaacagaaagtgtgcctggccctgccgggaggaggaagaggctgtctgagctgggaccttgtccagccttgcccacgggagcagagtggggaggagcagttgtggccgggccctcagggccctcctgatttcaccagatgccgcggcgcacatgatacccgttttaggtcttgcaccacaggtccttgtttattcttacaggtaaccttagaaccattttatccagttctagccaaaattattttggagctttaattgtaatggcctgataaacatgcttacttgaaggaaaatgaaatgtctacagcgttggccgtttgtccagaggcaaagatgcctctctttcaggcctctcccacatcctttggttcaagttcaagttcatgggttttaccctatggaatcagcaaaaggagcccagagtttgtttcccattgtgacaggatttctgtttgtttttaactagttttagctgctaatcagaaaagctatctgaggggtagatatgttttaaggccagccatcttgttgatctcattggagttctccagtcagaaaatgacatcttctgccaatgaaggtcccctctgtagttctccctcttactataatttttgcaattctacgcttccagaacaggtcagaggaggaaaaaacacaggattaaaagctcaaaaggcatttgatcagatgtaacctcctattcctgattttcaaactattttaataaactaagaaatgcggatctcagcgtccggggcagcagaggggtgaggctgcgggagccccagaggcctggccgtcggcctccttgccagggcccaggcatgcagcaagtgttcaactcccagcccctggaggtgagacggtgtcacctgtggtggtggcacagctattaactgtagttaaaaacagtgaatcatgcggtaatctactgcccaggggagtttgcttataaagccatcttcaggaggctggctgggtgttttttgtttgtttcaagatggtgtcttgccgtgttgcccgggctggagtgcaatagtgcaggcacggctcactgcagcctcaacctcccaagctcaagcgatcctcccacctcagcctcccatgtcgctgggaccagaggtgcatgcaccacacccagttaatttgttaaacagttttgtagagatgggcagggctgggtctcactttgttggctgggcgggtgttgaactcctgggctcaagcaatcctcccgatttggcctcccaaagtgctgggattataggtgtgagccactgtgtccagccaaggaggctgtttgaactgcatgattgaaaacacatttgcaaaagtagttttagggtattttttaattgcctctggtttgaactgaatggaaaaatcttggctgatttcaatgtatagatcttcaaaagaagtttaaaaggatagtaagatctgttttaaatgtgcacgtgtgtctgaaggctggttaaggaaatcataacagggtttgggaccgattagccagccgttcttcagccccaaggtcctcaaaacactcagatttgaagatgatcccgtcttgttccgtggtctcgtccgctcctccacggtcattcttttcgaacctggccgccagtatgtgccctgagagtctatttctcttgtaaatcattgtaatattcttgactttggtttaaataaaaaaaaagaaagctgcatcaggcttaacctccatttctgtgagtttagaatgtcttacgagagtctgagtatgtagcttggaattttggttagttaacttttctcaggcttgaaataccttttcaaactcagctgagacagactaccctgtcacttcagttcattatggttaatattataaattgttaataaattctaagtcacagataggaacgtgtggctgaaaggagacttggagagggcgggaccctgtggggtggaggcagggccacaggctctccacacgccaggagccagcagcctggccgaggcggctttcctccttatgctcctgtgtcctgaggttgttccccaggggcgagggaaggctgctgtgctgggtgggttctgtgtctggggcggccctaactccaggtgcttgaatctccagtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggtgaggtggtggtgatgcccgctgggaaggttacttcgaggggattcagatctgcaaggccatggaaatcacatggatacatcctgagttttcctcagtttttagaaattaagaatgtgtatagtgcccaggggatcttctaggtcgtggtagagagcgagagactgtgatgggaacctagcagtggctgcgaaccttgcttctataggcttcctcgcccggtgtcctcccatcggtgcagtaaggctgagtctgtgcgcggtgacacgggtgtgtgacggctgctaaggcggctcgtccaggcccagcatttgccaagagcaagctgaggctcagaggggacagcgtctgactgtggctgggtcagctctcctgtcgccctttccctggtgacacagcactctcctgagtgcttgctggggctctggggcaaccccaggaggaggtggtgtaatccacacctggcaaaggagaggacctgaggggccaactgtcaggttggcggcgggcgagggtggaagcgggacagattttccatgtagtcaccttgaagtcacatgctactaagtaaaagctgacaatcgcattttcctcaccatcttcagaacctggtgtatgatttttactgtgttttctttgtatgaaaaaagctttttaaaaatcacggtattgggcatttgaattgcttttattgaaaagagtagagtaatacattggaacggcctttgaagactgggttcgttgtcaccttgcctgtcctggtgggtatgtggcctgatgaccaagcttgtcctcaccctggtttcactctgggaactggagggaagccaccagaagaaacctggcgcccccactgagggacacggaagggcgtgtctagcagttacaccaccgtgcgctgtcgtttggtgctcataatgttcctctgtgttttaggagagcagagatgaagacaagacatgatgaaatcagaaaaaaatatggtaaggactggtcacgcctcctttttgtctggttgggaggcgatggcacgctgtctcggtcctcgttagtgccagtgtggcctgagatggggctgtgggttcacccatcggaacagaaggacgtctctccagagaggagcagctggcggttgtccccagcggttctgtggtgaactcactcctaagaatatctttatctcagccagtcgtcttcatgaagtctgttttctcagatagctgtttgcttatcgagtcccaagacttctgggctggaagtctgcagctgttctgccgtcgtgtttggcttcctgtgggcacgcctgcgtagccgaggtgctgtgagtttcagggcggccctctcatcctcgggagcgttgctcgttgccatcttctgagtgtggcaggcgctccttccaagcactccccagcaccggccctgctccttctcgcccagcctcggcgttctgttcttgtttggttgtgtctggagagattttggagaggagctttgaaggagccagaatgaatgtatttgccaagtgtaaaccttttatttagttggagtgaattggaaatacacattacgttatctatactcccccaaaccacgtgatgttcactgcttaacactgaacaccaccacccagccgtgcttcgttgattctgtatgattttaaagtccgcaaagagtctagtgtctcccgcgctgggtttgtggttgtgtggtgtcatgggcgtctcccgcgctgggtttgtggttgtgtggcgtcatggacatggtgggaactgactcctcgcctgtgcgaggtgcgtggtcctgggttcatggcagccgtgggcctcaggaatctgtcgtcctgcgcccacggtgctttccttgaagcagtatattaaaggctaaacctaattggaaaatttcagagccttttctgactaatgcacgtgttttgagtcttctgtttgttttagggaatatcatatatttgtggtattttagggtcccacccactgggggcatgaggacgtcgctgcggttctcggtcatcgggtggggggtggacggcaaagcccagcagccactgtgagcggcgcctccgtcaggtgcaggtgattggcgttgggttccctctcatgggggctgcagaggccccatgctgctggtgccctggactgtaaacgctgggtggctctgcccactggccgggacgtcccctccctgtcagttctggcctccttggaaagtcacctccatgtgactgtgctgtgacctgaggccacgtgagtcctgccggtctcgaagtgtcggcttgggggcgtgaggctgccttggctgctggcctcgagatgcccagtggctgatagaggctttttcctatgtgttcccgcccatcagtctcctgagtgccgtgtgcttgggcgctgactctctgggttctcttcactgctgccttgtccttgccccaccctctctgtcgcctgttgtttcccggtgtgtgtctggagtgggtggtgaccgggtacctgcgtgtgactgtcataaggagcagcaccagggttgccctcctcagcgagtgcatgcctgtgtacgtggagcgtgggcccagcagcatctctgcaggccttggctggaggcattgtgctttccttgaaatggaagagtcaagagctttttggcacctaatttttttttttttttttttttgagacggagtctcaccttgtcgcccaggctggagtgcagtggcgcgatgtcagctcactgcaagctctgcctcccaggttcacaccattcttctgcctcagcctcctgagtagctgggactacaggtgcccaccactacgcccagctaattttttgtattttttagtagagatggggtttcactgtgttagccaggatggtctcaatctcctgacctcgtgatccgcccgcctcggcctcccagagtgctgggattataggcatgagccaccacacccagccagactaatgttaatgtaaataaaagacaaggtggatacacacacacgcacacgcgcacacacgcacacactgcccagcacctgttatcaccaagcacaagctgtgtttaagttgctcgacctttactgtgccctgactcccagcgggtgtgaggctgtgggtggccggccaggctcttggagtggtgtcttctgtgtcagggccctgattgacttgcacttgccattttggtggttaatttggccctttaattgcattgatgaaatgagctttttgtgccagtttgtaataaagccattgaatggcctgtgctttggaaagcctcggctagttagaagaattcctaggaattcctgatgggagagtgcgagaaagcatgtgagtccacctggtgcagttatataaaataccagcacgcacgcaaaaacccttcttttggttttggttttccctctaaactggaagtagactcaggagcgagtttttcaataagaacttaaccagcctccttgctagtatctgatgactctttcccaaaaccgactttgagcctcactcccaaagcctgatgcctgtggccctccttgacaggcaagaaagaaacatggctaggcccttccttaccatccctctgcttccccgccgcctcttccacccagcccccagaatacatgcagtgagtagctttgttgtaatcgctgcagataattttagtgtacaatacagattgttaaagggagagagaggccaggcacggtggctcacgcctgtaatcccaacactttgggagaccaaggtggtggatcacctgaggttgggagttcgagaccagcctgaccaacatggtgaaaccccgtctctactaaaaatacaaaaattagccaagtatggtggtgggtgcctgcagtcctagctacccggaggctgaggcaggagaattccttgaacccaggaggcggagattgcagtgagccgagactgcgccattgcactctatcctgggcaacaagagcaaaactctgtctcaaaaaaaaataaaaaataaagggagagagagtgtgtgtatgtgtgtgtgtttctgcagtgtgaagggaaaactcctggtctttgggtaagtagcacaggtttactcttatgattaaatacacattttatcccagttttgtcagagtactcgagagttagattgatggtcatcttagttctttctgtagccttaattccaaaggtttaagagcagctataagcacaaagtaaggttattttgtttaatagtagccatccactgtggaactagccaaccactgtggaaagaaatacttgccttaaatttcttttcttcgccgagcatcaggaagtaagtgcttatctcttaggatctgttagagttcttgtttctagtaaattttatttcagttttaaagtttaaagtggtttgacttcaaaaaaggttaagcactgtatgagagcctgcttacaacgcccgttgttgctatagcctcagtaaatcttcttataaagcttggtttgtatggctttctaagattttgtttctggttgaatgaatgaagttatgattcaagtttattttgtttcaggcctgtttaaagaagaaaacccgtatgctagatttgaaaacaactaaagcgctccagcacatcagtcccgacgcttcctgtgaggtgcacactccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtgtttagtatgccgcgtgttcctgtgttccatctcagtggtgtcgacatgaccgcttggaatgctgggaggcaggtaggcttttttgggtaaagtgggcctctgacccatcgtgggatgcctgggcagtctccagactaaatgcctgtggctgtcagaacggaccaggctgtgtcctaaaactgtgcccacgggcctgcctcgcaggggaggtcttggctgtctctgccctccacagctgccctgcgcaccgcatgccctccactcgcgctgggtgccgagggccgggggagaaggcagggctgcctcgggaagggcgaccttggcccccccgtgtgaaacgcacacctgcatgaggctcccgcgctccctgctcccctcgcgtccttccctgggtgtctccgtgccaggtttttagggagtgcccccccaccccggcccccttctgtgttgctcctgccacttcagtcctctgggacacagggttgagtccgagcagcagagtattggtatgtctgtctgtcccgtggacctgccccgcagggcccagcgtttgtggctacgagcaccagcccgtctgcggcggaaaccccctgtgctcgacccgcttccggctcattcaggaatgtgtggcaactgcagacttgcatctggaacggggagacgtgaggttgcgactcctgcccccagacacactgccatggtgctgcccccagacgcactgctatggtgtggtcttagtgcccagtatctcgtttgagaggctcatccttgtcagaaacattaggcttagaatcgtttaagaagttgcaaattttctggccgggcacagtgctcacgcctgtaatcccagcactttgggaggccaaggcttgtggatcactcaggtcaggagtttaagaccagcctgaccaacatggtgaaaccctgtctctactaaaaatagaaaaaattagccgggcgtggtggcgtgcgcctgtaatcccagctactcgggaggctgaggcagtagaatcacttgaacccaggaggtggcggttgcagtgagctgagaccatgccattgcactccagcctgggcgacgagagcaaaaacactgtctcaaaaaaaaaaattataaagttggaagttttctgattacactgagacttctgctttaaaaggaatggttggtgagtaaaatacttcctctctgatgtctgctcttcaaaaaaaaaaaatattgtgcaggttaaaaatacagtcactggccgggcgtggtgcctcacacctgtaattccagcactttaggaggccgaggcgggcggatcacctgaggtcaggagttcgagaccagcctggccaacatggtgaaacctcgtttccgctaaaaatacaaaaattagccgagtgtggtggtgtacgcctgtaatcccagctactcgggaggctgaggctggtgaactgcttgaacccaggaggtggaggttgcagtgagctgagaccatgccattgcactccagcctgggcaacagagcgagactctgtctcaaaaactaaaaataaaaatgcagtcactgtgggtgcccaggccagcgtccctgttagctggtcttgtgtgccttccaaagccagtctgtccttcggcctccgtggggcaccaggtgcagggcttctcaggaccgtcagggtcctcacccagtcccacccgtctgctttgggaggcgtagcttccacctgcagtccagttcgtgctgcctcggtgtggcatttgactcagctgtgaggtcagcttctagaagtagaattctggatcaaagggtgtgtgatgtgtacttgaaacgttgactagaatctgccaaatttccctccaaagaagatgcctgactgtggggatctaatccctggcaggacagatggaggggagtggggtgtccagtgtgttcagcacactcgaggacagacagactggggctggcctgggcagaggcgagaacatggggaccacagcggctgaa

SEQ ID NO: 16974 - DNA, 15101 bp, Human
aaggatgaggtccatctgggtaccctgggtatagggagtgttgttgaaaaaaagccaaacactataaaatatttgaagatatttattctgagcaaatgtgaggactatgacctgtgaaaccacctcagcaggtcctgagaatatgtgagcaaggtggctgggtaacagcttggctttatacttttttttaaaattttcaggtcttttctgtagagacagggtctcaccatgttgcccaggctgatctcaagctcttcagctcaagcaatgctcccaccttggcctccgagtatgctgggattataggcaacagtcaccatgcccggcctggttttacggattttacagagacagatgttacaggccaaaaccataaatcaacatatgtaagatatacattggttcagcctagaaacagggttggcaggggcagcttccaggtcataggggattcaaagatttcctgattggcaagtggttgaaagagttatgttttgcctaaagagttaaagtgggattactcacgcctgtaatcccagcactttggaaggctgaggcaggcagatcacctgaggtcaggagttcgagaccagcctggccaacatggtgaaacaccatctctactaaaaatacaaaacatatatacacatatacatgtatatatatatacacatatacatgtatatatatacacatatacatgtatatatatacacatatacatgtatatatatacacatatacatgtatatatatacacatatacatgtatatatatacacatatatacacatatacatgtatatatacacatatatacacatatacatatatgtatatacatatatagtgtatatatatacgtatatatatgtgtatatatacactatatatgtgtgtgtgtgtatatatatatatacatacgtgtgtgtatatatacatattagccaggcgtggtagcacgcgcctgtaatcccagctacttaggaggctgaggcaggagaatcgcttgaacccaggaggtagaggttgcagtgagccgagatcatgccactgcactccagcctgggccacagagcgagattctgtctcaaaaaaaaaaaaaaaaaaaaaagagttgacgtgagtggacaaaaggtgcccgacctcctaagggaaggagcttctctagaaaacgcgaatttcgccccctcaagagacagctgtgcagtgccatatcaaaacatgtgaaaggaatgtattttagggtggaatactttgcctgccttcgggcctgctgtctgccacgtgaggctgtgccagtgtgaggctggaatttgggatctggaggctagagccatcggtgaggcctgagtctctaagcacagcgcccagagggagagggcggagcgggtccgaccccctttgcggcagggcctgagctggttttccaggtttctctggaagccctgtagaggagcggagggtccattcggtgggctggggactttgaatttaaccttggtttgcaagaggcttccagagaggatgtctgggagcgtctcggagggggacgagggggcgccgggaggagcaggtgcaggagcccacggcgcagcgccccgcgcaggcctggacgcggggacggccgcggcggccgggacaggggtcaccccgcggggccctccagggtgggccgccccacgaccccaggccaggccgaaacgggaatcctccagaccccagaagctgggccgggctgaccccgcgggcgcgagcggcgggaactgtaggcgcggcaggcgcaccaccaccccgccccccgcccgggcgctgtgcgcgtgcgccgaggttgccccgcccaggccaggccccgctccgccccgccccgcgcacgccggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggtgaagcctcaggggccggggctcagggacgggcaggggtcgcggcgccgaggtcccggggcctgtggtgactttcgcgctcccctgtggcccccacgagccccttgcgccccccgcgctggaatgcacctgtgccgccctgcgcggcctcctgcacggaccacccgcctacggggcgccgggctccggaggtgcaggggacccggggcagaggcgccagatgcctctcccccatatgccaccctgggttgtaccttgaggactgcagactgaccgcagcctccctggagacggggcggggcggggggaggtagtgctcattcggggcaggtggaattggggtctgtactgagcgcccttgttgctggagacctaggtcaggcctcagagcccccgagtctgggcgagtccatttccttagggacccctttaccacctgtgaactgggggctttaaaagtttgctccagcggctcttatcacaggccctgggctgggagacccctcgagaccctaggagttcccatgtccctgagagaggaggaggcatggggagtgggtcggctcacccaccccgggcctggggttgtgctgtagtgaggcccacacgctcctcaggccgatcccctgtgccaggtgaggccaccgattgggcctggatgggatggggcccggccatgcctgaccagctgggcagaggagggccatgctgcagtctgctttcttgaccccctccccagcccttgcaaggcagcccgcattcccaggaggggtatgctgacccatcccattgggcacctgccccacccttgctctgggcctttgtgggagacctgggatctgcgatgggtccactgccttttggcaggtgggtgaggtcagaaggctgcaggggctggagctggctgggccagctgggtaggactgagcctcaccaaaggctgtggggaatggcccgggggcgggtagccccaattaaagtcgttgtgggggagtagccacaagcctgagcctgccttgaccttgccagcctatccacaggcctcccctctccaaggaggacagacacagcagaggggaaacgatcctggggcttcttggagggaagggtagctgaatccaagccctcacccgattccagctcttgtgcgactgatactattacacctgcttcctggtccctggagggcgtgtccctcccccaggacaaaacctggagctcttccagcccaccagctcttaggcaataatctcatcttccgggatcacgcccctgacaagccaggaaaagccagctatgaccttgtactctcaagtccctggggcagggaagaggttttatttaagtgattaaaagcccaggggagcttccttggaacaaggagtgggttcacaccaaggggaaggccagtggccctgggggaggagcagggacccctctctctcttactcgcttcctgggtttagaactcaggaccccgatctcagtctggagctccctcctgcaccctggctggcggtgtgctgggtgacaggactctggaggggtaccctgagtgcagctgtcggaggaggcagggcggtggggggggcagcacagaagcctctaaggccccaggtgcagtcctggacctcgtggagccgcatggagtgaggagaggtgcggatgcccagaaacagatgtgggatgagggcactgggcagccacagggtccatgtggaggaggacaggtagtcaaggagggcttctggaggtggtgtggagggcccatctgatggccagaggaggccaggcagagctgccagtgccagcctggaggtggggccaccttcgtgcaggtgtctgggggtggagagcaggtgtgatgggggctgggtacagtgggctgcctcagagcactttgggcaggagtgacaggtacccgccagcaccctgagcagccatgctggccaccatcctggaagagaccagcgcaggtgcagagggaggacgggagacccttgggggctttggagcctccagaatggctgaggagaggagggttgggcacactggcccccaggttgggtgtgtggggctgaggtgggtggcgggtgaccacttcttaggactgtggcctgtgcaacctggcggggggcaatgggttgccattcactgacttgggggagctgggccagcagtttccaggtgacaggcaggagtttggttttggctgtggcgactctgagattccccaggggcctccaggtggatgtgcagcattggcagcgtcggccggcaggcgggagggcctccctgatatgccccgacccgtggttgacaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgtgagtatgaggtcttagccctgctgcaagcggagccactgtcaggagagctccgtggcagtatggggaacattcccacctcctgttctcagcagcgcagtttgagtggctcacctggccacggtggcgtcccggctcagccacactcctttcttccccattctggaacctcctgccactggcccctgtcattgcagggtcttggtcctgctagggcctgggagggtgattgggagtggcctcgggccttggtgccagctcgcctgagggggcggtccttgggcctgcctgagtgtggccggctgacctggagcctttcactgctgtcctgctgggaggcctgtggtgactcgtggcctccccagcccctccccatcttcttcctctcgcaacagcccctcctgtgcccactactccttcagggggaagcaggatccaaggtggagcactctggaagccacctagcaagctggggcttggtcagcctggtcccagctctatggggtcagttcgaggccagggcctactgtccagcctcggggctctggcccactgtgggggagccttgccctctgtcctgcttggcccgagtcctggctgtgacaggaagcccaagactcacaggcatgtgactgggccaggggggccctggggggaaccaggcgccgtgtgcctggtcccgactggccagttcctgattgtcctagcgcgcgagcaagcagatgcacgcatgcgcacacatgcacacacacacatggaaatttgctgagtgtccccctgccagtggtcacttctgtggggccatgagtcagcagctgctgctgctccgtgaagccaggcggttggagaaacattgggctgggctggtgccaggaatctggtggctgacggtggcccaggctccaatcctgggggaagcgggcgcccaggcgaccccaaactccaggaccctcttactctctgcctcctgagaggctcggcggcatgggaccccttgtacttgcctgatccctgagtcagcacccccacctgcgcctgctatccctgtgtacacacggggaaactgaggccctgggccattaaggcagggttgctgggcaggcagtgattgtaaggcttaccttctccccttgaccagctgaacccctctgcctggaagccctccaagcctggggttcaccctggagggcagggcaggcactgagacacccagaatcagaccttgacatggccccaacctggggaggaagtcacttcctttctcagaccttggactgcgggccaccaggggagtcttccaggccgggctttcctgcacccggggctcaggctgagggccacgtctgtccccaccctggcttgacctctggccttgtcttttccgtggggaagtcctcagcctcaccatgtattgagcaggggtaggtgacagaagccaggggtctagagaccccaagtacccgtgggcattaggaccgagggctggggacctggcccatcttccctgcaggctgagcaggtgggagtgggtggctgttggcagctgtgggccccgtgatgcccctccctccagtatgggccttggctctggggacagccgggccttctgaggcccagtggggagatggggccccctctcccatccctgacggaccctgtcccctgccaggcccagtactacggggagattggcatcgggacgcccccccagtgcttcacagtcgtcttcgacacgggctcctccaacctgtgggtcccctccatccactgcaaactgctggacatcgcttgctgtgagtcacgaaccctggccccgtcgcccaggtcctgcccttccgggatgtcgctgcagggctgcctcaggaatcacttgggcaacgcaattctcctgcctcttggccccgtgagccaggccagccctccaccctgctccagccactgactttctgggtgaaccaccagctgtggtcttgctctcagcagggctggggctggggtggccacagagggagccggctgtggctgggagggaggcccggggtcacagcccacagtcccggggctctggcatgatggtgggcctcagatcccctccaaatcccaccctggggaggcagcttggggggtgcgggctccatggtagattgtagggggatgggagggctaaggccgtggcgtgggctgcgggatgaccggcgggcccccttgtcgcccggggcagggatccaccacaagtacaacagcgacaagtccagcacctacgtgaagaatggtacctcgtttgacatccactatggctcgggcagcctctccgggtacctgagccaggacactgtgtcggtgagtccctctggggcctttcccaggactcgagggtgccagggtgtggggttcacccaccgtgggtatgtggttgaaagggagggctcggtgatcccagcccaaccccagccctcaggtggccggggcagtcagcagggtgaggaggggtctgggaatgggcctggttgtgtgcaggctggagggacagcctcaaacccagggggtacaggggcaggggtccccggagtcaggccacaatgagtgggagggaggacagggcagatcgatcgggctctttttggcacattgggtttgaggtgccagcaggtgttgagggctggacctggggctgcacagggtccctgcagcaggccgagggcttggggaggcttggggttgggaggatgtaccaggaacccgctgtgggggctgctggcggagagtcaccggcaggagcctgggagggcaagggagggggagcagcagtggctgttgggggccccgcctgcatccaccatcctcagggccctgtgcagagcaactccctgccctaggagagggtgagctggcccttgtcaccctgcctgggcctcagtgagttctcacctcggagctgtctgctgggggtggaccaggccacaaggggttcaggagttacgggatggtgacacagcccccagctctggagcgggccaggagggcagcagagcccccctgcaggcccagggacccgggaagagggccccttcctccagctgaagctgctcctaacagttccctgctgggctggagtccagtctgtactgggggctcctcagagccctcctgtctggaccctgctcagcctgaacaggaaattgccccgtctgccctcttccgccctcttctgccccctccgccccgtgtcagcctcaagctgtcgttcccttcccacatcctgctctggccgtgttctctctctgcagcctcatccagggctgggggaggggacaggcagagaaggggaagggggcagtatggctgtgagcttgggatggggtcggcaggttccccatctctcgggctcctggcccaggctatgtcttgttcccagcgctgagggcaggagcaggacctgcctgtcattggtggtgggagtaagaggtcggagcagggagcggagcaaggggcctgcccgtctgtgctcctgcctggttcccatctcgtgtaaaccgagccctgatgacttccacgaagagggccccgccataccccgtgtccccatccccagcggtgttcagctcagggtttccagccctttcttctgggccctctgggccccatcgtgtgtgggatgggcatccattgaactgggttttgtagcctcatgctcagggagtggtgtagggctcagcctgtctgctgcccactgactctgccctggcctgcaggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcaggtgggcgtgtgggttccctctcgctccgcgttgctgggaggcagggcggggctggacggggagccttctaggcaccccctctcagtgctgccccctccctgctgctgtgccagagctcctgacctctgacctcagggcatccgggaggcgggggttggccgcccttctgcagaggagtaagcggcagcacagagaaagctgtttggccggggtctcccagtgggaggggctcgggccaggctgtgggtcctgggaccttggcagctgggcctccctcctatgagaatggacccaggtcaggggtcgtggcagttcctcttggttcagtcggcccgtcggtccccagacctggtgatgggcacatgtggtcctggtcccggggttgctgatggtggagagggtcatggtgcccaggggaccggggatccccggggaggtgaccttgggtgcgtatgggtccccggcaccacgctgcgagcagctctgtgggcgtccccagcaggtgccggctgccctcgaggaggaacatagggggcccttccttctgggaaaagggttctcccccagggcccccacctgcagccgctgctccagcttgggtgacccatggtcaggtgaccttgggaaggggacgtcggactcagttagtttcctcttctcggggcagacctgagtggagggttccacataagaggggtgactgggggttgggggcttttgttttgggggtgggcagcgtgtcagccggcggcctcctgccctgagctgcgcctggtcactgccccacactctccagggctgacaggggcaggtttacctcacgtggctcacttggcacttggagtctctgggcctgacccctaaccttggatcgcttccggcagaattccggctgtagggctggctgggcctctttgctctgccccttgcctgggcagtgaatactccttagcaacacccagggctaagctgctcactagaggccaggacacaggtgaaccggctgggccatttccccaggagccttggggcacaggggaggcagccaggtgaaaaggggtcccctgagggcaagagggcatgcaggcatgagtgcccacatggggagggggcacacagcctgagtacccaggtcagggagggggacacaggcatgaatgcccatgtgggggaggggcacacagcatgagtgcccatgtgggggaggggcacacggtatgagtacccaggtcgggggaggcatacacaggcatgagtgccaggtggaaggaggggcacacagagtgagtgcccaggtgggggaggtgcacatggttgtgagtgcccaggtgtagtctcaaggcagcagcttgggcaggaagtggagccaggcaggagggagggtctgagggcttctgaaagcatgtttggtgaggagaggaggggtgggaggcgctgatcaggtttctacacttgggattgcagaggtgttgacaagaggcaaaggcggaggaggctggaggagggcggaggccccaatcggtgttgggaggactgggtcaggcctggcactgcctcgagtgacaggcagtgggatggtggccagcttagctgcagacgctctggcgggatggcagaaccgccccagacacagagagcttctctaccaggaccggcaggatttgctgcgttgaaagctgtacttgagcaatgtttagaaacaaacccgggcgacatgggttgcaggtcctaggaagtgcagtgcgctcctgcccaggagcaccttggctggccatcagtggtctggatgagggggagatgagcggacgtggctcggggatgcaggtggagggtgttcccaggagcagccagtgcagaggccctgcggccagaaccagccatcccaacttcccagattgtgccatcactccctcctggaagccttctttggttttttcttccagacagacagacagggtcctccccagtggagctcctggcactcacttccttgtctgccgctagccttgaccctgatgtctggctgaaccttggctcctgagcagaccaggagaacctgagggttgaggaaaacctcttctgggccaggctgggcccacgcagagcagccctaccccgggaagaagggagtctgtccctcctcctgccttctgggcctttccatccctgcagtttcagaaaggcccctccttcaggaagctctccctgattgccacattcaccctcttactcctgacctggcactcttgtgcttggggggtggcgtggcagctgactcctcccttttcctcctagggacccagatgcgcagcctgggggtgagctgatgctgggtggcacagactccaagtattacaagggttctctgtcctacctgaatgtcacccgcaaggcctactggcaggtccacctggaccagtgagtagtggctgcagtcggctcccctgggttctgtgggcgggggcggtgtgcggagaccctggaggaccccggttctgcaggtgggggttgcatgtggggagtagtggagctgggcaagaaagagatggggtcagaccagccctccatgcccctccttgcccctccatgctccccatcacctccatcccctctattccctctatccctccatccctccatttcctccatgcctctgtgactctccatgacccaccatcccttctgtccatccctccatgccctccatcccctccatcccctcatccctctgtgactcttcatgaccctccatctcctccatccctccatcccctccatccctccatccctccatcccctccatcccttcatcccctccatcccctccatccctctatgcccctccatcccctccatccctccatgcccctccatcccttcatcccctccatcccctccatccctctatgcccctccatcccctccatccctctatgcccctccatcccctccatccctccatgcccctcaccaccacctgagggtctcccaccccctctaccactctgtgtctcctctcccaccctcttccctggagggcttacagccggctgtgcttccaggagccctgaggggaggagagtgcagcccagccaggggaggggctcccagggaggggcactgggcccccagggcacactccagtcccggcaggggcttcacgccctgactccccgcagggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgaggtgagcgccgggggctggggctggggctggggctggcagggggagccccaaggccaccactaccaccctgacactgctgtgacccctcttagtacatgatcccctgtgagaaggtgtccaccctgcccgcgatcacactgaagctgggaggcaaaggctacaagctgtccccagaggactacacgctcaaggtgagcgggcaatggggtgccgcacgccccaggtgagcgggcggtgagggggcgcacgctccaggtgagcgggcaacaggtgggggggcgggtggtgctaggcctgggtactgaccaccagggccgtcccaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctctgtgctggtgtgctcttgtgcctggtcaggggtggctccaacttgggatggggaaggagggtgggtagtgcgaagccagcacggcagctgactcggcagcaccgggacaagcatttggggtgccccgggcctatggccccctgccctgccctgcccagcccatgggctccagcctggtcggccagcggggactgacttgttcccaggtctggagcagtagccggcaggatgtggccttggctggggtttcagggtgtctagtgtgagtgccagccttgaggagtgatttcagggaggtggcccagccaggcagccacggcactcgaacagaggctatttctgctctcggggaccctcagagcaggcctaccagtcaccctcctcagccctcttgtcccgggaaataaatggccccaggtggcgtgggggggctggcctagctgggccttcttgcctcccaggccctagaagcggttttgtgtgcagtgagctgagctggcaccaagcaagcctgcccagggtccctggttgcagggattggactcagaagtcccctccagccacagctgccacagtcacggatccccgggctgataacgcggtgcgcttgttccgctgggaggggaggggttgggagcgtgtgcccggatgcagtggtagcagcccctggggttctaataggtaagtaggagtttgtgggcatgtggtggtgggagcagagttccttttgggatcagtagctctggagtcacttagagccccctcgagccccaccccaacaggttagaagatgaggcagatgtgacatttgccattatcttgatgcctctgcctgagggtggtggctgccttggccttcctcccaaggggctgcagggctttcaccccagagccatgctacggcagacacctggagcaagaacatttacccagggtggcacggaggcttggaaacacatgcctggcgtttggcatgcctgaaatctgagcagagctgggcagaactctgcagggcctggcagggcttctggggagacaaatgtcctgtcatcagatgctttgtgcactgaggcctgggagggcagagaggtacaaggaggcagccataccctgttgtccctgccctgtcccactctccccatctccctccttctgcagcttgtcagctccgtccagctcccatcttcatggctgctgccctggggttgctccgagggctccctccagcccggcaggattctcggggccctggagtctgaccccgggttcctccgtggttttctagctggtgactggaccctgagcctggagtccccccctgtctagactgtgggttgtaaccagaaacccctagcaaaggggaagctggagcccaggcccttggggagcccaccaacagtcacatgaatgctggctgtgccaagtttggctcggccctggctctgccctgcgacccctggctccctctcagtggtgtttcctggcctcagaggcagccccaaggtggcctgaggccgggagcaggccctggctcccctgtcacctacccagtgaccctgggcaggccctggaccctcgggcccaggcaaccctctcctgctatggaggcctcctcactgcctgaggccttcagggcaaactggggtggggcagcactgggcagaggctgtgtggcaggccagggtctcccagaaggtggtggctggccgggtaagcccagctcagatgctggggagacatgggggcatggcacacaggccacactcagcctgggatcaggccccgtctgaggacaccgggtccagttttccctgggccaggcccttggaaaggaggagggagttggggagggagaacggaaccctggttctccgacaggccccatccacccacggcctgtgggctccagggagagcatggccagggtgcccaaggagacgaggaggaggctcctcatgcttcatgacccctcctgctcgttagggtttatcaacatcatt

SEQ ID NO: 16975 - DNA, 28355 bp, Human
ccaaaaacatgttttgccaaatatgttttaagaaagaggaggaggttacgtgttttccatatttgagcctataaaagtacccttggaatgagtatgacttgtctctcctcataaagcttcaaggtaagtgtgtgtgaggacagggctctgtctggaggacggtaagggatgtctggctgcccgcgtgcatgccacacatcctggctcccactgtccctggcagccctgccagtgaagcaccagcttactccgtagcaattttaattagatgttgtagtcttcccagtcatttcctggttctcagttaagaattgttctataatcgggaattgttataatttaatcagaagaggtttgctctttttcttacagttctgatccactttaaggtcgcatctctacggtaagattctgatttttttttttctcattcctcacagagtgcaaggaatcttctgcagtggtttggacagtggtgaggggcggggtgagggaagtgataaaaaaaatcatttccatttcatggttgatcacgcttctcttaaaaaatggagaatgactttagaaactggttctccttaactcatatccctcgcaatatatgaaaatgctttctcagagtccttgggaattttattcacaatagtgaatttcattcactatttccagcattgtagtttatcttttaaatgactgcattacaatatgcaatgtaacatttcaaagtgttactcaattatagagaaaatttaaattttctataccatggcttttcctcagcactataaatataaaaacctatgagagatgatgtctaattggataaatagaatggtctgaatctttgccttggaaaaagttgcttaactgcatgttgtttcacaatctataaaataaaaattaacgaatatatacacacacacacacacatatgtatatatacacacacacaatacgaaacatgattgtcagcatattcagcaagatgaagcattttaattatgttatctgagtcaacatagtttcaatgggagaaatgtatccaaatgagcttccctggaaaaggtatctttattattataaagtagaatatacatgaagattattgacagcattaatgaatgctagctaatgtggcaagagggggatcctgaaaagaacaagttttgtgaaattgttataaaaatgttaataatagagcaagaaaacataggtaataacgttttataataaatatttaagaaatgctaaagatcagtgaagaagttgagtttgtcaaaattattatacagagacaacagaaattgatggataacagaacattttttaacaatgcaaaacaaagagccacacatttctgctttcctgtatattaggaagtcttcgtaactcccaagtttataatgaaaatatttctgtcatgtacagaatagttcctaaaattatagcaacatattcctattgttcttttaattcaccaagccagctttgagcctttctctgtgtccagcatttgttctaagaggtgtgaaggataccataaaaagaagagtgctccctgcctgcaaggtgcttataatccagttgggaagataaaaactataagtgaaagaactggagactatcctgccaccattatagctttatgttctctataagccaatgataggcagcttataaagattaatatacctaacaaatgaaacagagaaagcagctaagagactgcaataggtgagccagaaacaacagtctctttccaaatgcatgattaagtgtctgtcagcactggcacagaacaaggagactgacattttatcctcaaccaagccagggaggtggtcatacccaatgcaatgctaagcactcaattggtcagtaaatttttttttaaagttttaaatgtgaatctaatggtccagtttcttaatttctacaatttcttttcttcctctcccagccagggtccttaactgggctaccatcaataacctgcagccatgagttccgactctgagatggccatttttggggaggctgctcctttcctccgaaagtctgaaagggagcgaattgaagcccagaacaagccttttgatgccaagacatcagtctttgtggtggaccctaaggagtcctttgtgaaagcaacagtgcagagcagggaaggggggaaggtgacagctaagaccgaagctggagctgtgagtaaaaacacctggagctgattagactctgcctcattttgggttaagttagcacttactttttgatctggcctctcttgtttgactggacagactgtaacagtgaaagatgaccaagtcttccccatgaaccctcccaaatatgacaagatcgaggacatggccatgatgactcatctacacgagcctgctgtgctgtacaacctcaaagagcgctacgcagcctggatgatctacgtgagttctttctcacggtcttctactcatgagagtagttaatagtttttgaaaagtagtagatgattaaggtccccatcaaataattctgttcctcccttttgttttgggtgcagacctactcaggcttgttctgtgtcactgtcaacccctacaagtggttgccagtgtataatgcagaggtggtgacagcctaccgaggcaaaaagcgccaggaggccccaccccacatcttctccatctctgacaatgcctatcagttcatgctgactggtgagtggctcagctggttttcatatgaattattttaccatccataatcacaaaatattagaactaaaaaaagacctttagaaaaaaacccaattcacgcccctggttgttcagcagaggtgactaaagcacagagaagtatatactgtcaaagctcgtattaaaacacagctctcctgattacacctcactgactttactaggccatgctattactccatcccattaagtttaatttgtttatggtctccttgcttggaaacacacaatttattttatatatttaagtaataagagccaagattaagtaacaactgaatcatataaatcatgtattatctgaatagaaatgaaaaataggagttcaatccttttggtgcctcagtttcttgttaattataaattagattcttttacaagtactgtcatctctttaaagttatcagagtacatctcagatataatatcctctgtttgaatgaagatgatgttttggggctacacacatataaacagaaattgttttccccccttagaaagattttattttgattgaggcatcctctcttacctcatctttctttaacacaatggtacactttggggaaggctgatcgaagttagggctatattgaagttagtctgtggccataagatagtaaattttttctctttgtgaagtcatctgacacatttagaaacaaaatctcagtcatggcttgattaacactatttcaatctattaaataatagtccaagcctttagcatattatgcatttttcagctatatgcattaattagcagatagcatgccattgaaatctacagatgacaactacggaatgtatctagctttggagaatactgctctttatattaaaccagcaggacacacccataactttaccataatatattgaaaaaccccactgaatacatgacacttatactcaaatgccctgtttccctatagaaagttttgtttgtgtaactgatacatatgctgattttccactgtttttcttctagatcgggagaatcagtctatcttgatcacgtatgtattcctattctgagatttattggcagtttgttcttactggaaaaatgacaaaccaaaaaaagaaattagttaatgttctctactaaagcactgaatgatcaacctggaactagatattggtttagctttattataaggtttacattgcattagaatgtaaaataataatgttctaaatcacctcatttgctggtcttgaaagttccacagaactttttggtgtgtagaaagtgtaaaatgagctgggctggaacccagtatagtgcaatgagcagcatacagccttcaaaaggtacaacagtttggaaatactactagtggttcatttttaaggcccacttagagaatgtctgttccttcaaagaccaaacttgagccatgtctctagtccgaggaaatggaaaaacacatgcacgtttcatagagtttcctactaattgttccattcactacagaggtgctgagtagctgcttttcagacccctcaagcccaggcctcagcacccagaaaaaaagctgacacattataaacactcaagaaatacgtgttaaatgaacaatgactgattttttctacttcttgccagtgcaaagcaaaagaaataatacgagctatatgtaggctgaaaagaaagatgtaaaaggctctctaatagagatataaagacaaagccatgaggtagttgtagtttcatttgtcacagtgcttaatttctcatacgtttggtctttgacagcggagaatctggcgcagggaagactgtgaacaccaagcgtgtcatccagtactttgcaacaattgcagttactggggagaagaagaaggaagaagttacttctggcaaaatgcaggtgagtctgattgttagtcagaatccaggctctgtcgggactctcaggtaggaaattcccaagccccagatgcaaggactgctcttgcctttgcaggggactctggaagatcaaatcatcagtgccaaccccctactggaggcctttggcaacgccaagaccgtgaggaatgacaactcctctcgctttgtaagtctcttggttgccaaagggtcttctctgcctttagatgccagagaaagcatgtctgaattatttcagtggcatccccactacgtacttcaagctttgggtataacatcattttttttacttacaagggtaaattcatcaggatccacttcggtaccacagggaaactggcttctgctgatattgaaacatgtgagtaacaggacctcctaaatagaatccaagaatgacaaatattggtttggaggaacactttgcagctcctgctgaacatggagcttgtaaagcaccagtctgctgccaaacatgcttgtggttaatgtcagtcttatccatagcccacagtatgctttacccactccagtcatgaggtaatgcttctgtgggaactgccaggaactgctgggcatgtccaaagtattccagcctcagaatgatttcaattttttttttaagaaaaaactaacactagaagtaaacaagttgtccagggattgaggatatgtgatttattcctagtctgagctttaatactgttgcttttagtagtccctctattatatggcgacaggaccctgcagagggagtctcaggactcaattatattccaaatgtcaaggatcttctgtatgagaagtgaatatcttgagccaagcatatttcacttttttcccaggaggcaggaggaactgcaatagtgtttgtagagacataatatgtggtacttcacaggaacattcagttgaaatctcaagaggccagtgagatttagctaatgatcccaagtcctcaaatcactccaggacattgtgtaatttttccccataatctgatgtctactatccgttgcagatcttctggagaagtctagagttactttccagctaaaggctgaaagaagctatcatattttttatcagatcatgtctaacaagaagccagatctaattggtaagaaataaattcatagctagaagattgtcactgtactatcttctaatgtaaaacatatgccctgaattctgtgacccagaaatgctcctgatcaccaccaacccatacgattatgccttcgtcagtcaaggggagatcacagtgcccagcattgatgaccaagaagagttgatggctacagatgtaagttatacatgaattttaatttaaaatccattatgcatgggaatggcaataacagccatctatatgtgtgtaaaagatacagtataaattctcttgtgccctaatctttgtcttctcatctctcatggtagagtgccattgaaattctgggcttcacttcagatgaaagagtgtccatctataagctcacaggggctgtgatgcattatgggaacatgaaattcaagcaaaagcagcgtgaggagcaagctgagccagatggcactgaaggtaccaaatgaatctccatctgggtttaatgagagaatataggcaaaaatgtccattccaaaattcaagtcttctttacagctgagctcctgatggacatactcagatgtacccacacacagactttctacaaagttatttactcaatactatgcccctttgaactgtgggtcccagagtaagtcatattaggtatctgaattatgtttctgcagttgctgacaaggcagcctatctccaaaatctgaactctgcagatctgctcaaagccctctgctaccctagggtcaaggtcggcaatgagtatgtcaccaaaggtcaaactgtgcagcaggtaagtgcatgacctcaatgaatcacacacatcccaggccttcatgacatgtctttaataacaccaacaaactttatctgtgaaggtgtacaatgcagtgggtgctctggccaaagctgtctacgataagatgttcttgtggatggtcacccgcatcaaccagcagctggacaccaagcagcccaggcagtacttcattggggtcttggacattgctggctttgagatctttgatgtgagttagcagaaaaattgtaccaaaaaagtttccaacaagcaagcttgttgctgcagtcatatagcatgcctgtagtcacttatggaaagggtctatgaaaaatagctgcactataaacttaactgacacatgaaagagcaccaaaagaccgtgaaaggaagtgaactttggaatgagacagacctggattcaaactcctgctctgccaattactagctgtgtaataatgagaattgtacctgattgatcattgggcaaattcaactaggacctgtaggtaaagcacttaacattccagatcacagattcacttctgagatctgtctgctagtttcaagatttctgaattttcagccgttaacacagtccccaagcatgcaggcagcactcagtaaacagtaagatactgagggcaacaatagaatcaaagatagcagtggagaagacaaagtctttaaaagaaagactttgagattctgtttgccgagaaatgaaatgtgtttaattattaggataacctctgcaatacccaggtattgagtatagaaatggcatcgtaaataaactcaaatttgtctgcctaaggaagaatacctgctacacagcttaggaaatagggctactgcagtcctccacttgacagcagtatctcggatgtgtctcatttagaggtcccaattctaaacttttatctgtgtacggactgattgaaactggatgaaattttagaaacggaagcacttccagacatttccaagccaacgtggaaagaaaggaataatctgtcatcaagcaggaacagaaaaagcaatccacactttttaaaataagagaactaatgacagggtacttgcaatcattttgagctgcttctttttttttttttgaagtaacagctttatcgagatataattaacatatcatacaattcacctatttaaagtataaaattcaatggtttttagtatattcacaggtacatgctatcatcataacaatttcagaacattttcatcatcccaacaggaaattctattttgtcctccccctaggccacagaaacccctaatctactttctgtctctggttttggctgttctggacatgtcttataatggaatcggataatatgtggtctttgtgactggcttctggcacttcgcatatgcttgccagattcatccccctcatagaattcctttgacttttgtgtatggtgataatgcccttaaacaagggcatcctcaattgtgtttctatgtaggtgtcccgaataataaagcagggcaggtctactcaagttctaggagtagttacaaacactggctctggcatcaaaatgttggggttcctgccatgacccttactaccatggtcttacacaagttacttagcctccctaatagtgtttcctcacccatgaaatgagcaaatgataccacctacaaaggtagctgtgaggattaaatgcagtaacttatacaaggcactcagcatagtgtctactgtagagtaaatgttcaccaaatattagctgttgaatttttattattaaggacaacatacagaccataatggctcagatctagcaaatttagctagtttacaacataatcataatcattaagaaacctctgactaacaaaaacaaatactataaaaaccaaacaacttttaaaaaaaaaacttttaagttcaggggtccatgtgaaggtttgcgacataggtaagctgtgtcgcccacgtatgaagcctagtacccataagttattttttctgatcccctccctcctcccactctccaccctccaataggccccagtgtgtgctgtttccctctatgtgtccatgtgttctcatcatttagctcccacttatatgtgagaacatacagtatttggttttctgttcctgcgttagtttgctaagaataatggcctccagctccaaacaacttttttttattgcataggaaagcatcattcagagcttgttgacaggtgttgaagagacaattttaacaagtatgctaacagcagcaaaaacttcattgtgtaggtataggtaggacaaaacgataccatcctaagagggcaatttggctaactaaaaaaacacccctttcaaagagaagatttcattataaattgaatgctaatttgtattttcaactcatttagttcaacagcctggagcagctgtgcatcaacttcaccaatgagaaactgcaacagtttttcaaccaccacatgttcgtgctggagcaggaggagtacaagaaggaaggcattgagtggacgttcattgactttgggatggacctggctgcctgcatcgagctcatcgagaaggttggcttgctttttgcagaccacagatcatactgctgtacagtatttaaaagaaaatcataaaatcttgatataggcaatggctaaatatttctacttgtgaaaaacatgaggagaattccttattttgccaactctgaagtagatattctggtaaaaggagattaaatattttctatagagtccagaacacaacacttacccacagtttgcaatacaaagtcttacatttaaagtcatctttccttacaaaaagtgcactgactagaatattttttacttactgttttttgtcatcctaaagtcattattactgcattcgaagtatgaatttctactactgtacgttaaagcagaggcttttaaaatccagtgtgcgaaagacccaccaagaatacttggtacaattgcaggtttcccttgtctcacccctagaaatattttctggtaagtgtaggatgaaacatcggaatcctcattttgagcaagtgattctgatgcagctaattcgcaagtcacacttggagaaatattgctctcaggtctttggggtaaagacacaaactccacaggagcacagccttcatctgtcttactctgtcatatcccagagcctgatacagcacgtggctcctgatcagcacccaataaatatttgtgaagttaatgacttctgaccaaaggaacgagttttcgttaactctgtagaattaaaggatgaatttactcagatgggataattattaatgttaaatgttatttctataagcagacagaattcaagtggcatttatttcttttcattcttccagcctatgggcatcttctccatcctggaagaggagtgcatgttccccaaggcgacagacacctccttcaagaacaagctgtatgaacaacatcttggaaaatccaataacttccagaagcccaagcctgccaaaggcaagcctgaggcccacttctctttgattcactatgctggcaccgtggactacaacattgccggctggcttgacaagaacaaggaccccctgaatgagactgtggtggggctgtaccagaagtctgcaatgaagactctggctctcctctttgttggggcaacgggagcggaagcaggtaattatcaatataattaatcttttacctaatgtataaaacataactagaggccagacacggtgcctgtaatcccagcattttgggaggccaaggtgggtagattgcctgaggtcaggagttcaagaccagcccggtcaacatagcaaaaccccgtctctactaaaaatgcaaaaattagccgggcatggtggcaggtgcctataatcccagctactcgggaggctgaggcaggagaatcgcttgaacccaggaggtggaggttgcagtgagccgagatcatgccactgcactccagcctgggcaaccaagagtgaaacttcgtcaaaaaaaacaaaaaaaaaacaaaaaaaaaaaaccataaccagagaaaggctgtcctatgattgctttctttttcccctcagaggctggcggtggaaagaaaggtggtaagaagaagggttcttctttccagactgtgtctgctctcttcagggtacaaacttcattttctctgtctaattagatttaggatattaaatgtactctatggtgtgggggaaaaaactaaccttgcaaggattctagaactgatgtgactcaacgagatagttcagctggtagtggtaagactgagttttagggagcttgaggatagtttggaagaggggatagtttggaagagatacctcactattcagaagacacaggagtcaggagagatgaaagcgaattgcagaagtcagtattagacggcaaaattcgattctggggcctgagaatgaggtcatttaacccttaaaagactccagtgggataggattaagtaaagctgagacttgcttgaggctttgggagcctccaagtgatttaggtgcttaaagatacattggtatagaaccgaaatgagtagattttgaaagctataagatagaacagtggtgggaattggagcctgagtcaaaagaaggaaataagaaaccagatgtgataataaatagcacttttaaaaaaattacggccaagcacagttgctcacgcctgtaatcccagcaatttgagaagccaaggcaggcagatcacttgaggccaggagttcgagactagcctggccaacatgatgaaaccccatctctaccaaaaatataaaaattagccaggcatggtggtgcacacctgtaatcccagctactcaggaggctgggcatgagaatcgcttgaacccaggaggcggaggttgccatgagctgagatcatgtcactgtactccagcctgggtgacagagcaagactccatctcaaggaaaaaaagaaaagtctatttttcttttggcaatcccatttctgattccatctctaataactgatgctgtagatattcggaaaaaccaggattttcaaaagatggaaaactttacacgcttggtaacatggctgtcagttttctaccaattcccagaataggcattaataaaggccactttctgtggaataagtaggaggacacagctctatatctatggcaaggaatacacatttgatagacacacagatacaagtgaaagtcaggtaaagaaagaagtgagtgtgactgggcaccatggctcatgcctgtaatcccagcactttgggaggctaaggcgggtggatcacttgaggtcaggagttcgagaccagcctggccaacatggtgaaaccccgtctctaccaaaaatacaaaaattagctgggggtggtggcatgtgcctgtaatcccagctactcaggaggctaaggcaggagaattgtttgaacccgggaggcagaggttaccgtgagccaagattgcgccactgtactccagcctgggcaacagagcaagactccatctcagaaaaaaaaaaaagaagaagaagaaaagacaaagaaaaaagtgggagaattagaggaaggcattgattagtagtaaaatcagaccatgtatctaggcaaaaaaagaatgggtagagtatttccatatatttagagtgtcatagtgaatttaaaacatatactaggaaattaaacagcagcgaacagtcacttcaacagcaagtagaaaactatgcttctaatgcacaccaacagaaaacagggggacatattaggaatgtggaaattccagagataactctttgaaaattttcatctggatactattcattagaattaaaccactgtcatagatctcaataattatgtctataaatatgaatgtagaaaacagtacattttttaaagtataaactcgcatggttccacaggagaatttgaataagctgatgaccaacttgaggagcactcacccccactttgtgcggtgcatcatccccaatgaaactaaaactcctggtaagacatttctgatatccagacaagctccagtgtgtgtgtgatagaccacgaagtatggcatgtggattcattcttttaggtgccatggagcatgagcttgtcctgcatcagctgaggtgtaacggtgtgctggaaggcatccgcatctgcaggaaaggcttcccaagcagaatcctttatgcagacttcaaacagaggtcagacatttttgctgtaaattattttaagaggtttttattactttttaaacatttttcaatgaaagaatcctttatacctcctcttaaaattgaagagaagataaactcacttaacaaactccatattgacataagaaaactctgaagtcctttgaataaacagaggatagataaaggggtagatatgatttcttgtttatttcagattacccagtggctatgttgtttctatagccagacaggaagatttcttgtctgtggcaacagccatatcatttttttgtctggcttaaacagatacaaggtgttaaatgcaagtgctatccctgaaggacaattcatcgatagcaagaaggcttcagagaagctcctggggtccattgacattgaccacacccagtataaatttggtcacaccaaggtaatattctgtaaatcctacctgatgctattcctgtccctttgaactttatgtaaattttctgatctgaaattcttcccacacataggtctttttcaaagctggtcttctggggctcctagaggagatgcgagatgagaagctggcccagctgattacccgaacccaggccatgtgcagagggttcttggcaagagtggagtaccagaaaatggtggaaagaaggtattaataagaattctttacttaacctcatcatcttaggtgttttaattctgcttcttattataatctgatttggacatttctgttcctatgacagagagtccatcttctgcatccagtacaatgtccgtgccttcatgaatgtgaagcactggccctggatgaagctgtatttcaagatcaaacccctcctcaaaagtgcagagacagagaaggagatggccaacatgaaggaagaatttgagaaaaccaaagaagagctggctaagaccgaggcaaaaaggaaagagctggaagaaaaaatggttactctgatgcaagaaaaaaatgacttgcaactccaggttcaagctgtgagtatcccgaagtcatttcctgcaatctgatgctaaaacttcagctcagtggtcactaaggagagatctagattctaccaaataagggacagattatgaatctttaataatccacaactccttagaatgttctatagaattccctatacaatattactaaaaatcactgtggtaggattctttgatgtcaagaagggaaaaataaaagcatttttccttcccctctgttgttttctacagcagaatgtgaacaggaaataaagtgagctttgctccctaaattctccctactgaaaaatgcaaataagagctgtgaaaaagaaaaatattgtcagtgaagaggaaggagactttgatgaaaacacattaacttgaaatcaatattctgagttttgtatctacaatccccgagcaactttgtgctcaactttatttttagaaacttttagtacctgaaagagtaggattatggcaagaataatggcaatgctttctgtaaggataatggcaatgccttccacagataatgtctatttttatgcaaagtatgagagatagggttgatattcttattctaatgtcccagtaactatccagaggcttggagagaaatatttgatcaaaagccactatctaacccatttttgtaacacaaataacaagacagttcaattgctgccaccaaaaccaacagcagaaacattaaaagttaccatcccagttctctgaattcagaaagggaattgactagtcccattgtgcctacaagtttgggacacatatttagaaaatctaaagtatgatgaattgcaaatacctaggttggtactgtgactttcctgtactttgtatagatcagggttttccacattgaggagtggttcatcgtgccttcaagaaacaggagataatctatccaagaatactcctctcctttgaggatagtattataaaacttctgtttaacaatattctatcaactatccactaataaatattgggtgaagtcccggacagggatgtaagtttgaatgagagacatggtccttccctcacagtttatctcaactcctatttcttcttatgagaaatatgcttgctacttctctaagcatcaccttgaacatgttccattccctttgtctactctgtcactggatgacatttcttcctgttaaggcacttttctgatagtacccttctctcccagcaacctgctagaaacccaatccttttgtctattggtttttcatatattgaatgctcctgaaaataaatattaaataaagaaaattggctgacccgaaattatataccaacatattatatatgttataacaaatataattgtaacataatttcaccaggaactatgacttaagttcctttttttattaccggactcataagtgcccaatatttactgaatggtagaaagctaataaaaattaacctgaaggcttaaaacaatttacttgtttggtttcaaaatattaataaaatctgaaaatgtctaggaattttcataaaatctaaaatatctattgcctcttctcaggaagctgacagcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtatcaatcatattctacagtactgtatagaggttctgccacccaacaaaggtgctttagagcaactaagctgctttcttcacctttgtaggtgaaaaacctcacagaagagatggcgggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatgtaagcctaacattatataaaaatgattttttaaattttgtaacaaactaagtaagcataagtttgtgtcgttatgatatagtgagtacttatcaagtgcctcctatgaatgaggaatatggaacatcatccctattacaaggtctaagatgtacacacaataaagtttttaaaatcaataaagaaagttaactgtgaataatagacaatacgggtaaaaagaattgatggaaaggaaggttaatgtgttcacaaagaaaagctatacaagcaaaacaggtctttcgctgggcttgaaagacaaggggctatgtgcaaaaagaaagaagagggagggtgttctaagaaggcagcatagcagcagcaaagaagttgtaatgatcaataaggttttctctcacagaaacaaaggacactcagaattaggaatgtggaagataaatttggctttaaacatgatctgatatctaatagagaacccactgaaaatgcctgagtaagggaggcgttaaaaaagttcatggtttggaagtattagcatggtgtccatcccagctggaaaagtattggattccagtggggagatgcagaaggcataatgtctcactagtaacttattgtaacaacgtgacaaagaggcacattttaccttttaaacgatgactttttcgactaggtaaataccaaggagaatggaatcaatgggacaaatctgcctaattcatagaaaaatagtttgctgcatagatataatgtttaaaaatttcatctgggacaaaaggtgctaccattctaagaaccatattcatggattattaacttttagcttgaaggatctttggaacaagaaaagaaaatccggatggatctagaaagagcaaagagaaaactagagggagacctaaaattggctcaagaatccacaatggatatagaaaatgacaaacaacaacttgatgaaaagcttaaaaagtaagcagttttaggtcaacagttttgtggggaaattactcttaatatttctgagactgacataaagggcttttctaataggaaagagtttgaaatgagcggtctgcaaagcaagattgaagatgaacaagcccttggtatgcagctgcagaagaaaatcaaggagttacaagtacgttaaatgattttcgccaggctaatttaacatcgaaaagttactgacaccaagaagttgagttcgtattaatatttttcaccattcccaggcccgcattgaggagctggaggaggaaatcgaggcagagcgggcctcccgggccaaagcagagaagcagcgctctgatctctcccgggagctggaggagatcagcgagaggctggaagaagccggtggggccacctcagcccagattgagatgaacaagaagcgggaggctgagttccagaaaatgcgcagggacctggaggaggccaccctacagcatgaagccacggcggccaccctgaggaagaagcatgcagatagtgtggccgagcttggggagcagattgacaacctgcagcgagtgaagcagaagctggagaaggagaagagtgagatgaagatggagatcgatgaccttgctagtaacatggagactgtctccaaagccaaggtacaatcaacacttcacattgattatttggttttttgtttttccctttagcacaaatatgatttgtatctcaaaaacgtctcatgaactaaatcaggcaccctttttctcatatcacgtatagtacaacttagtaaagtagttagattaacaagtaattcagtggctgtatgcttggactatgtatcttattagtctttccattcactatctaagacctttgctggttttgtttgtaaagatagtttcttctcaaaataaatgagtactgcagctcatatggaatgtttagattactgaaactttctttggtccaactacttacttgagatgccttctaccactttttgaatgcagggaaaccttgaaaagatgtgccgcgctctagaagatcaactgagtgaaattaagaccaaggaagaggagcagcagcggctgatcaatgacctcacagcacagagagcgcgcctgcaaacagaatcaggtgggccatgtaccagtactgaccttgaatgacaaattcaccctgcatgtgtaatccactgaaaaactctgcatttatttacttgaggtcatatactacctccctgggagatccccactaatatgaacacattattgaccactggcatgaggttgctttctttcatatatatacgagagaaatatatgtgtatatatatgaaacatatatatccatatatatatttgtatatatatccatacatacatatatatatatatataaagagagagagagagataaatagaatcaggcccttctatttttgaagactttaagggagacttggctttaatcaaaaagttatcaaaaacaaagtgcgtccttacagtacctcttttcacttttcaaaatgctttcgcaagctatgtgttactttattttcctcattagtctgtgtaatactatccccattttaaagacagtggattatggtagtgatgaagcaacttgtccaagaatgtttactccagtctttttcctgaagtcttgccaattactggtaactaacacggttaagtagggaaatattcaagaccacaacccagctgagaagcattcaagtaagatttgtagatttttgattagagaaattggaaagtctctgcatttattccccctcctactgacgtgtccaactttctaccagagttgtatctccccaggtagaggtaacaaaatggaaattgttttatgggtaatttaggctattaaagtaataggcaggttaaagtgttggaaaatcactctacacttttggtattcaaatactattctttctataacaaagttcagaataaatatttattataattcttattaaatgccagagataaagttcaagataactagtataaaaatggtgtggaaaagttttactatctttctaacataatgtagtgcattttctgcattatggtgcttaaaaaattgaagacatgtgtaaatgccatttagtttggaaagtacttatccagaaaccaattcattctggggatgggagaccacttaatcatttcttaatataaaaatctttccagaatttctcttgactatcatttctacttacagaagacattgcccaaagtctcttattttccacagtataaatcctttgtttcaaccaactttcaatggaaggcaaattagacaacactactgccttacataaaataaaaagtactagaatattttgttggcttgatttacatttttttcatgtttcttcatcaattttgactacgatcaaataatcgtaaatatctcttgaaatcttttgtgctgttcacaagcatgtaatctgcctcaaatttctccatgcttctaatttttacatggatctgcttatcaaggttaaagcggatgttggtggtttgttgtcacccatgccctccatcaagtttcaaacttggctccctttccctgctcaagtttttattttagagttttaatttccaaagtaaggttgagttttctggacttggtcttttacaggtgaatattcacgccagctagatgaaaaggacacactagtttcacagctctcgaggggcaaacaagcctttacacaacagattgaggaactgaaaaggcaacttgaagaggagataaaggtaagctccacttgtcattcttgtcattattgttcttgttatttgtttttcgcttacttttacagactttcttctggtggcctataggagatcaggaatcaaacatcactttaaatatataaaattaagtcatcaatctctatgttctcaggccaagagtgccctggcacatgccctgcagtcctcccgccatgactgtgacctgctgcgggaacagtatgaggaggagcaggaagccaaggccgagctacagagagcaatgtccaaggccaacagtgaggttgcccagtggaggaccaaatatgagacagatgccatccagcgcacagaggagctggaggaggccaagtatgttccagacttagttaaaatggaactataagtttccttgctcccaaaacatatgaaaaactagggaaaaaacattctgggaccatatacagccatattgttggaattaatgttttggtagatgccttagaagagattctgagaggagttctcgatgcaaaatgtatattgatgtgggaaagcttctttattattaatggattaattaaaaactagcacaaataagggatacaattagacagacaaaatcaagtatatttcatttgaattcaatttatccaacatttgagcccttaatatgttggacagcctacaagaatacaaagattagtacagtacagactctccctctggggattaaaattatgtggagacacagaaaaacaaaccagtaattcaaggtagatattaatattctacagaagaggaataaaccagctacctggaagggtaaagtgttagctcatgcttgtcatggatggccttaaagccactctatgaagtatggcaataccaaaactggggttgtttttggtatttggtggtaggataatgggaatgagttaatatagaactggacctacaaaacaagcttgagaagcaaagtattaaagaagtctgattgtggaattcactctcttgtacccactttgaaacacccaattcagttgacagccattcacttttattgcccatatttcataggaagaagctggctcagcgtctgcaggatgctgaggaacatgtagaagctgtgaatgccaaatgtgcttcccttgagaagacgaagcagaggctccagaatgaagttgaggacctcatgattgatgttgagaggacaaatgctgcctgtgccgccctggacaaaaagcaaaggaactttgataaggtattctctccagtttttgcttcaactttcaacacagaattaacaatagcctgctaccttcagtgtgcccaattcaaaccatctgagggctgttctcagtagctcttaacccatcagcagctgtctgtggagaggggaagtgctcctatggtttctattcttctcattcataattttttttcagtcccagaacacctcaactctgagaggtgctagaatagatggtttttatctcatcaaattttgtccactaaatttcttgtccattccttgaccttcagatcctggcagaatggaaacagaagtgtgaagaaactcatgctgaacttgaagcttctcaaaaggaatcccgctcactcagcacagaactatttaagattaagaatgcttatgaggaatctttagaccaacttgaaaccttgaaacgggaaaataagaatttgcaacgtgagaacattttaccttttctttaacaataaaagatttgaaagaatcttttccaactataaacaaatttctatattttttgttcaccaacagaggagatttctgatctcactgaacagattgcagaaggaggaaagcgcatccatgaactggaaaaaataaagaagcaagttgagcaagaaaagtctgaacttcaggctgccttagaggaggcagaggtaagcattttattgcatactctaaaacaattagaagaggaattggggtctattaaatgtaaggaatggtgaatcaagagaaacgaaaaataatttttgctccatgaactagggatgagaatggagaactgatcatgcatacaaccaacataaccatatgtcaggaactgtgctacacactgagcaaacaaagatgaatcagttaaaggccctgctttcaagggcacaatctacctagggagataaaagcatataaaatcaacaataacattcaataatttgtagaaatgtctaaaacaacaaaataaaaatgtatgatggcagcacaaaggcagacagtgtgtgtgttagagaatagcaagaaaatgcaaaggcatgaaaatgacactcttgtttaaatcttactactacttagaaatctatttataaataaggtttcatgaatgataaatcattcttatctctagaatactacacacttccattactctactaatgtcacctcttgctgtcattaaggcatctcttgaacatgaagagggaaagatcctgcgcatccagcttgagttgaaccaagtcaagtctgaggttgataggaaaattgctgaaaaagatgaggaaattgaccagatgaagagaaaccacattagaatcgtggagtccatgcagagcacactggatgctgagatcaggagcaggaatgatgccattaggctcaagaagaagatggagggagacctcaatgaaatggaaatccagctgaaccatgccaaccgcatggctgctgaggccctgaggaactataggaacacccaagccatcctcaaggtaaatatgtccaacagatgatcccaggacaattggggtgcctgcaaccctgaatacatggtgtctcaatgacggtttgttccacaggatacccagctccacctggatgatgctctccggagccaggaggacctgaaggaacagctggctatggtggagcgcagagccaacctgctgcaggctgagatcgaggagctgcgggccactctggaacagacagagaggagcaggaaaatcgcagaacaggagctcctggatgccagtgagcgtgttcagctcctgcacacccaggtgcatgtaataatagaatagcaacaaatacaagggtatgaaaatgacattcttgctgaaatcgtggtactattaagaaatctatttataagatttcatgaaggataaagtttaaaatattttatttttttgattatctatattcttatctgaactataacatccatagttgattttttttttttttttttttttttttttttttttttgagacggagtctcgctctgtcgctcaggctggagtgcagtggcgcaacctcggctcgctgcaagctccacctcccgggctcacgccattctcctgcctcagcctccggagtacctgggactacaggcgcccgccaccacgcccggctaattttttgtatttttagtggagacggggtttcaccgtgttagccaggatggtcttgatctcctgatctcgtaatccacccgcctcggcctcccaaagtgctgggattacaagcatgagccaccgcgcccggccagttgattgtcttttaaacatatgtcaactcagataatttatgaaacaaggaggaatattaatgaattcatttagttaattagtttatggttcattagaacatgaggtttcctaatttttctctcatgtgcctaatatttctaaatttcacattttaaacagaacaccagcctgatcaacaccaagaagaagctggagacagacatttcccaaatccagggagagatggaagacatcatccaggaagcccgcaatgcagaagagaaggccaagaaggccatcactgatgtgagtgaagggtaacacagtggtggtcaaacttaaatcttaatgtgctgtcttagctgtcttaacccattctgttttactgctaattaggctgccatgatggctgaggagctgaagaaggaacaggacaccagcgcccatctggagcggatgaagaagaacctggaacagacggtgaaggacctgcagcatcgtctggatgaggctgagcagctggccctgaagggtgggaagaagcagatccagaaactggaggccagggtgggtctcctaatcagcatgtatttctatctcattccaatccaacacacgattctgaatacctagcactgctagatgatgtggggcatactgagatgagggagagctattccctcatgcccaaaagctcataataaggaaaactgaactagggcattaaaaactacatataaagcagagtagaagaagtatgtgggtcatgtgaagaagtagaaattcgtcaaatgaatgtccttaaaatgtccatcttcttgtaggttcgtgaacttgaaggtgaagttgaaagtgaacagaagcgcaatgttgaagctgtcaagggtctacgcaaacatgagagaaaagtgaaggaactcacttaccaagtaaggaaaatggcctgtctaggttttcactttagtccacatgggattaaaagtcatatgtatgacaaaatgtaatatttgtactttcaagaaacttactcttgaaaacattatttcagactgaggaagaccgcaagaatattctcaggctccaggacctggtggacaaactgcaagcaaaggtgaaatcctacaagagacaagctgaagaagcggtgagttcacaaccccttggggtgatttttctcagacatgaccaggccagtttagttaaagtgacaaaagaaaagatgagtaaaatgaggaaggatcaaaagaaaacaaatggctacatggaggtccaaggctgaggtaaaaccaaccacctgacaagccagcagaagatgttctagagatggggaagagcaaatgcaaagcttttgagtgggaaagagtctggctcaagaagcagacaaaaaaaggaggaaagcaccacaactgggactggagagccaggcaggaggcagctcatagggtcttccaggccatggtaagaacaataaggtactgggaagccagggagggttttaatgtgggtcagtcactacctgatctatattttttaaaaagagcatttgggatactatgtaaagaatcggttactgggtaacacaagtgggtgcagagagacatgttaggaagcttttcaggtcggttctgtggcttggataagagagtggagcagagagaagtggagaaattcaggacatattttggaggtagaaactacaagattgctaataggttgcacttgggagatgaaagaaaggcaattaagagtaatttatcaagtttatggtttgagtaaccaagtggatgatgtaacacttaagtggggaacaaagggaagaacagaattgcagggcaagaaagaaacaggaattctgttttagatacataataccatatatacacaagtgaacatgtcaagtaaatagttaaatataagattctgaaactcagaaggtcttggttatgttcaaatcagtagattcttaacactccactttatctcatttccgtatcccatgattcatctggattaataatcaaatagtttcaacttcctacatataaatattcatagttacatatcacaaatgagttcctctgttcattgatggtttttattttacccctgacatctaaggtaagagagagagaaagatgggaatggaggggaatgagggagggagagaaaacaaacacacttgtgtgcacggacacacacacacgctactgtccatacctcggacaaattgcttaatctttctccagttcctactttcctcatctgtaagaggaaaagctgaggttttttctcaagctatactatttaatgattctaagctttatgtctgttctaaatttgaatgccacattttggaggttcttactgagacttttaaataagaatgattaccagagactaaactagaactgacctgctcaaattctctgctatatatttaagtataatcagagacagctcagactattttaggaaacaaacttcttgcttaatttctaaacttaagtggcaataatttatactcacatggcaataacttatattcaagcttaatggtttggtttggtatagattgcatacttgcactcttaaaaggtttggttccattctcaggattctgaaaaaaacaaacaaacaaacaaaaaaaaaaaacaaagctggacacctggcatatttagtagtagctctaggatgttctgctgttctaaaagttcagatacaaaggtcacctgtccttccttgttatctatgagttcaagaagctaatgcaaaaataaaaaaaaataaaaattcaagagcatttctctaggtttcttaaaatatctgctagagtgaatcatttttaagtaaaaaggaaattcaagatccactgacctaagaatggaaaaattctgaactttcttccctcataaatggatttccattcacaggaggaacaatccaacgtcaacctctccaaattccgcaggatccagcacgagctggaggaggccgaggaacgggctgacattgctgagtcccaggtcaacaagctgagggtgaagagcagggaggttcacacaaaaatcataagtgaagagtaatttatctaactgctgaaaggtgaccaaagaaatgcacaaaatgtgaaaatctttgtcactccattttgtacttatgacttttggagataaaaaatttatctgccaaaaacttgtgagtctctttttcccctctatgtcaatttgtctttagaagtactgagaaaagaaaaacatctcaacattttggttacattttacagaaaagtgcttagtcaccaatattaagacatgatagagagcagctaggcagacccggtaagtgccaccatatgcgtccctataggaagtaggtgaacctaaaggtataccacaagccataaaacatagaatatttggtaaaccttacttgacaaaacatagctagtttctgtcaatgaaattattgattttcttcataaaatgataggaaatccttcatcctaaggctgagtaaaaataaattaaaacatgttatttacataaaatgagaaaaatttaaaaattagattaaagtactgtcaaaaatatttaaaatgcaaactcttcactataactatatgaaccatttaattgggattagaatcccttgagagggaagcatgttctgtaggttttctggccctttgtaaatacaagagatttttagttttttgttatctacagatgtttagtttgctggattgtgccccctccttggttatcacaatcaaatggtaaccaagagttaaaaattgttaagaaatatgtttctattatgtcttctatctctttggctacttctgtattttacaaggatttcttccttgtaagtatattgatagcaataggtcacttcatattttttaaagtcactaccctactctcattactttatatttagatgtctgtattgtgcctttctacagtgctatggcaattattgtcatcattgttgtaaccatggtattactactacaggtttacctgtactgagggtagcatgggccttccacctatgtcaatttttcatacaacatgagcaagtaaaatagcaagtatctcatccattaaagacataacaaaggtcttggagaatagtaaccagtctacttaaaaggaacaatatacaattaaatgtttctaatcttatgatccagtaggttaaaatatccagtcatacatctctggacctcagttcctggggaagattctctctgggtcattatgcacctccacttattttctattgattactggaaacaactcgctattgtaatgctatatcttgggttggactttaaaataattttaatagactttaatatccagttttctcccaaagtttatatcctaatattcgaattacacattgccatttcctttggttattcacaatgagaaaaacgataaataaatgggcatatgttaagcaaagagtcaggaaaagatggaaggatctgattatggtagcaaatcttagctgtaccctcacttaatattgaccctcctggaaaacatgagatctcttatgctctttggaatattcccctcaacccacttcttggtttaaattgaaatctgcctccccctgataaaaatccttccctgtaagtcttcttaagaggtggccattattctctcatggttcaagaactccttagtcctaagctagaaataatacccctctcaattccccttgttgcttatcctcctatagaagactcttccttctttgaagttcatattatttagctattccacatacctactgtggtcatttactaacttttcattcatcaaagattttggcacctgcttttcctttccacccaatccttaccacattcctgggagatttcaatgtccacatggatgattcatagactatactaacttccacctcgactaccttctctgccactacccctcttccatagtctcatctcactctagaaaatatcacaaaactgcccaatctccattctccaaactaactacataaagcatctcctttctgattttctaccttacttgttggactattcccgacataacatttcttcaaccccattagcacctgaatatttggtctctttacttcttaactaaatcagcctcttttttatctttatttctcttcccatttaa

SEQ ID NO: 16976 - DNA, 113283 bp, Human
cctgtgcatgggatacttctctttctctcaacatgcacgcgcgcatgcacacgcacacacacgcacacatgcacgttgttataatcctatttgtcttgcatatattttggctatcttccaatcctggagagtccaaagcagtgagagggcccaggtaaacctgcccagatgtgggcttgtgcttactggacatgctggtgagacagcaacctgcgaccctggtgggatgccacaccgtgttgatcctggctgctgtccacctcactgtctcctgctgtcttagaagacagtcttccatacggaatcaaacgggcactgcaggttagcaggtgtaggagatggagcgtccagggcataggggaaagcttttaattaagttgtgaaaatgcattgtgaaacttacaccgcagctacgcagagggcagaagggaggctgtgtttactcaaagtccccgagcagctcagatttactcgttccctccaatgacatgcagggcactacgggaagccacggcacgtggttttgcaaccttcacaaagcgtgagagtagcctgggagctgtgtgtctctgctgctctctttcattctgttatcttgttttcctaagcgggggtcaccagggaccaccactatgggcacagctgggggatactgaggacatttgggagccgattacctttactgtttgtgaacagtcccctggctttgctgagaaattcatggctactctcttcgtatggctacaattctgattttaatcaatttacttcaaaaggcacagcaatcttacgggctaatttggactctctgtcctaattttaaaatgttctttagctaacaacttttatttctgtgtttatgggagaaaatttagggggaacagatatgtagaaaggagagtataataattgcctgtaatcccagcacccagggatcgtggctgttttttgtttgtttgtttttatatttttgtttgtttgttttgagatggactctcactctgtcacccaggctggagtgcagtggtgcgatctctgctcactgcaacctccgcctcctaggttcaagcaattctcttgcctcagcctcccgagtagctaggactacaggcgcacaccaccacgcctagctaattttttgtatttttagtagaggtggggtttcaccgtgttgcccaggctggtcgcgaactcctgagcttaggcaatccgcccgcctcggcctcccaaagtgctgggattacagacgtgagccactgcgcccggccatggttgttttttttttagcatctgtctactagatatctagtttctttgtatgtcatatacatttttctctgatttgttttttaacgaaaagtaattctatacatggttaaaagaattaattgcacataaatgcatacaatgggaagtcagcgtctgctctgtctccgagtcctcgttctttttgccagagtgatctggacccttggcgagagaagctccatccagctcttcatggattctcagcattattatagaatgttttgcatctggctgtgggatgacttgcattaattacttctgctaggtttgcacagcaagcctggggccttgtctgctgctgtgcttcgtggtctgggaatttcaggcttcagatttcacaatgggaggtggtggagtgacagggcccccttgcaagctcagcaccccgtgagtgattttctagggggccgtggagaaagtctagctccattagctgaatggcattttcctctctgctcccagaggagctgtcctctgtgcaggggctctgaatgctcaggtgcttctcactgctcatgctcacgcaaccccggaggtcacgtgtgtgctgcctctgacctcaggggtttatgggccgcagacttcccaatgtcacgctactgtagggtgaattcatcagcctttgccttcctggtttaaaaactcttgcaaaaatgccaaatgggtgtgaccttttctttcttctccaacagaagcctggaatggtcccccctccgccgggagaagaaagccagacggtcatccttccacctggctggcagagctacctgtcgcctcagggccggcggtactatgtcaacacgaccaccaatggtgagtcccgctcgggggagaatcctgcaccaaccccctggcattctggctctctagaggggcacgttttttctcccttcttcgcctctctgtttgggggttttttcttcttaagtctatgctcaggggctacagtaaagtcttactcctcccactgtgctgggtggtaggggtgcaagtctgggtctgtagttctgggagtatcttggaaggaaggctgccctttatggtttgagtcttccttggaccctgacgtccaccctgggtatctgtgttaaacccaacctgttcgtctggggctgggttttctgaagggtgtctcaaaaggttctatggtcaacagctggcttgaataaaatgaacgaggcaaagtcactgcatgatgtcttggaattttgaaggttttaatgatcttgaagcttcaatacaggggttgcaaatgcgaggtttccctaatttcactacaacgtcatctttttccttaagtatctcactggctggcatttctccagatgttttttgggaaatgccgggggtgcttatgggttatttatcccatcaaatagtacaggttccatgtgcatctgagttgaataggaccacacctcaatgaccccaataattagggacctcccaggccttcaaatgaccccaggatccccagaagtttgctgtggatggtttataaaaggggatgcaccacgtggcaggttctgtaacaaggtgagcaaagggcactgttgcaggctgtggtcttgggcagggcaggacagggtaaaccagctgaacagagctgtgtcttgacctccgtgactccccagagaaattgccatgagagaactgagaggatttaaaccaaggaaagttagatttagtgggaatcacagacatgcgttccaaggcaaaagatgaaaatcgtacccaagtccactgctggctcagccttggcctctcactcctctgtgcctgcctgactacatgaccaccccttcccacctgggggtatcgttactacagctgatgtttataagcctgcaccaggagggggtcctagtgacaggggagccagctactgtttagcagagacacaaagaaggcagctggtttattcgtatcccctggcaacctgaccttccacaggctcaagaggggtgttctagcgcaagaggtaatgaagtttctaggaaaagggaagtaggactatttctgaccgttctaatcttacacttcctcaaaacaaacacatgaacagctttgcactgttaccggagacttgaaatttcagaggagagtgtgtctatgtatgcaacacccatctgccaaacacagaatttggaccgtaggatcatgagatcatcaattatttgggacaacattggatccaaattattggaaggtcaggttgctaggggatatgaataatttggatccgttattgtcccaaataagctactctattgcaaaggggcatggggggaaatggctttctgaatttcagcatctttatctttttttaagttagagactagtttgttttcacggtaaaaaattcagtaagtacaaaatgatttcaaataaaaaataatccccggtctcaccttttaaacatatgtatacttattcttttaaaataaattggaaaatattgtctatgttgtcctttaagttactttgacagtgtatgtggacatctttctatactttgtacatttcagtctaacccattcttttaaacagctgtgtagtaatccatcgcatgggtatgctattaatttcacctgcactctattaatttaagtcatattttatatcaatagacagtgtctggcagcttttttctgggactcagactttagcagatgccactggtgacagctttcttatgggtcctgagatattgtgatcccacagaggctccaggccaggggtcagtgaactttttctgtaaagggccaagtagtcagtatgtaggctttgagggtcacatggtctccatcccagccactcagctttactgtttcagcatgaaagcagccctggatgataggtaaacaaatgagtgtagctgtgttccaataagactttatctatggatccgaaaataggaatttcagatgacttgtgtgtgttataaaatatcatcgttctggccaggcatggtggctcatgcctgtaatcccagcactttgggaggccgaggcaggtggatcacttgaggtcaggagttccagacaagcctgaccaacatggtgaaaccccgtctctactaaaaatatcaaaattatccgggtgtggtggcgggcgcctgtagtcccagctacccgggaggctgaggcaggagaatcgcttgaacgcgtgaggtggaagttgcagtgagccgagatcacgccattgcactccagcctggtgacagagcaagactccgtctgtctcaaggaaaaaaaaaaaaaaaagtggaagatgattttcgttggcaagttcactgggccatatgatagttggtttgaccagttggtcccttggaccatagctgctggtccctgcttcaggctgtctgttggctccacaaggacttgtcctatttgcccttcctctctttatttatttatttatttatttatttatttatttatttatttatttttttagacagggtctcactctgttgcccaggctagagtacagtggcacaatcatggctcactgcagcctcaacctcctgggctcaaacactcctcccatctcagccccctgagtagctgggattgcaggcatgtgtcatcacgcccggctgatttctttatttttttatattttttatttatttgagacagggtctcactctgttgcccaggctagagtgcagtggcacgatcatggctcactgcagcgttaacttcctgggcttaagtgaccctcccacctcagcctcctgagtagctgggattacaggcatgtgccaccacacctggctttttgtattattattattattattattattattattattattattattttttgtagagatgttttgccatgttacccaggctggtcttgaattcttggcctcaagtaatctactggccttgaccttccacagtgttgggattacactatgcctaaaaacagttttttttgttttgttttttttttttttttttttttggtagagacagggtttcagtatgttgcctaggctgatcccgaacttctggcttctacttctgcttcccaaagtgctgagattataggcatgagccaccgtgctcggctctctcctcttttatgctaaaaataattccagcacctaccttggtcttacattctagatatatgccagttttattcattacttgtttaactctttttttttttttttttttgagacggagtctcgctctttcacccaggctggactgcagtggcgcgatctcggctcactgcaagctccgcctcccgggttcatgccattctcctgcctcagcctcccaagtatctgggactacaggtgcctgccaccacacctggctaattttttgtatttttagtagagatggggtttcaccgtgttagccagggtggtctcgatctcctggccttgtgatccgcctgcctcggcctcccaaagtactggcattacaggcgtgagccaccgtgcccgaccttaacttattgtttatctgtttgattgaatcattccttcaacacatagtttgagcctcaaatatgtaccaggcagagtgagtcttgggatactggggatttaataagaacaaagtctctgccctgcaagtgtttatcttcttatagtgggaacagattttaagtgaaaacctatttgatcaatcaggaaagggttgtgaagcaggagtccagggtgttttaagagcatgtcacagagagaccctggggaatcaggggaggcttcctggagaaggaagctgcaggatgggaagggtaaggaagggctaggggatggggagtgtcttactgatggcaaagagtcagctgtgtttgtagggatcatgcagcccatgaacatcatattaataattttgctcggcagtctaagggagaaggaaagcagctatctttctgattctcctctggaatcgtttcttagacttgttttgtttggctgtagggatgttttaaatatattttaatctgcctgcctttctgcaggaaggcatctatgagaatagccactcatgtttttcttacctcctgactcctggaggcacctgagcttgtgcctcctcactgctgggccagctgcatctatctgcctttctgcctggccccttgcttaagcatctttgctctgtcgctctccaggtggcatttcatccacatgctagcccagtgcccagaaagtgcagtcccggttctaagcaggccattcttctcttcctctttgtctgtctacctttcttccagacgcttctagtctttctcccttaatccctaatctcttcttttccagagggtgcctggggataataggtgttctgtccccatttttacacctataaccagttgaaagtctaatttacatttgtattaccttgccttggctaatctgcttcttttcttttcttttcttttttttttgagacagagtctcgctctgtcgccagactggagtgcagtggtgcgatctcggctcactgaaacctccgcctccccggttcaagcgattctcttgcctcagcctcctgagtagctgggattacagacatgcgccaccacacccagctatttttttgtatttttagtagagacagggtttcaccatgttggccagcatggtcttgatttcctgacctcatgatccacccctcctcagcctcccaaagtgctgggattacaggcgtgagtcaccgcacctggctggctaatctgcttattttcacatccatttaggattttatggatgaggttgtcactgtgctagccactgagccgggctctggggatccaaaatcaaactagatgctgtctgtgatctcagaacctgcagttctaatagggccagagacacatataaacctataagtgttacaggtattcgtgtggaaatctgggggctcgaggaagggagtagtcagcttgatctgggtattaaccaagtctttgcagggggagggggcggccttgactcaggcattccaagccaaggttacagcatgagtaaagaccaggcaggagagaaaaacagcggatgtgtttggcattggttaaggaagaaagaggtgagagagagagtcaggggccttggggcattttgaggagtcaggtctttatcctgtaggcagcgggaatccatgggaaatttccaggcggtggcgtgacatgatcagaatattgtggcaaggctgcttgtgcggcagagcgaaggctttaaggccggtaagcgtggaggccgacagactaaatgagaggagaaataatgaggtcaaacaccaattctacagcagtggctggagaggaggaggtagaatctgtcagacaggatgtggctgtggcaggtcagggattggaagtgcctggattcctccgggttttctgccttgtgtgatgggaccatacagtgagtatagggtattcaagggaggaacaggttaggaagaaagaaaaatgagtccatgctgagtgtgtggttccctggggtgcgttctgggagagatggctggcatttggatggctacggtgtgacttagaggacttctgagctagagatgggaacttggtgagccatgtgggtacatggcctggccactgttgcgcagtgaccaacctgcccagccacagagggtggcccaggatttgtgtttcatcagcagagaggtgaagtgatgaggatgtagaagatcacccggggccttgcagcacaggtgtaaggcagcagccaaggagaccttgaaggaattgtcagagatacaaggaatccaggagaaggtaatgtcatcaaaggcaagggagaatagatagggaggggtagtcagggacagactgaaatatagatcaggtttatgataagagtgttgttttaaatcactggggaaagcatggattatttagtaaacggcgttgggccagatggctaacaggaagtttcagtggttaatgcagtaatgccgttgctttcatataaacttgccaatgccatcagagcatgctccgtggactttgggaagtccccatctttcttgtggctctctggaaatttcatcatgcagagtggccttcagttcagccccaggaactcccagggttttggtatcaggaaattgcttgtcttgtgctgtccagggaagctctccattcccaccaaaagttgcctgtgttgctaacggtttgggatagtgagctattatcaatagcctaccccatccagggacctcagctagtgttaaggagactgtcttagtctgtgcaggctgcactaacaaaaagccatagactggatgacttataaacaatggaaatttatttatcacagttcaggaggatgggaagtccaggatcaaggtgctggcagatttggtgtcgggtgtgggcctgctttctggttcataagaacagctgcattctgacgtggtggaaaggacaaacaagatcctctgggtttctctttttttaatttttttttttttttttttgagacagagtctcggtctgtcacccaggctggagtgcagtggcacgatctcggctcactgcaacctccatctcctggattcaagcgattctcctgcctcggcctcccgagtagctggaactataagtgcccgccaccacgcccggctaattttttgtattttttagtagagacggggtttcacagtgttagccaggatggtctcgatctcctgatctcgtgattcacctgcctcggcctcccaaggtgctgggattacaggcgtgagccaccgcgccctgcctgggtttctcttttaatggcactaaccccatgatggtggagcctgcatgacttagtcacctcctaaaagtgccgccgcttcatactggcacatggggaattaggtttcaacacgtgaatttggaggggacacaaacattcagaccacgacagggacctcttatttatacaacaaataattatatttcaagagatatagcacaacattttttgctccatttatgattgaaaggtcggctgggtgtggtggctctcacctgtaatccagcactttgggaagccgaggtgggcagatcacttgagcccaggagctcaagaccagcctggggaccatggtgaaaccccgtctctattaaaaatacaaaaattagccgggtgtggtggcgcacacctgtagtcccagctacttgggaggctgaggtggaaggatcacttgagcccaggaggcagaggttgcaatgaaccgaaatcacaccattgctctccagcctgggtgacagagcaagccactgtctcaaataaataaataaaataaaaatataactggaaggccaggcatgcatgcttcttcacttaatatagtcataggtattcaggccctctttttggagagatgctgaccttttagatatgtttaggatacattttaccatttggacattagggatatttgaagccagtatagatagatggccaagattagtttagtttaatgtattagtcaagattttacttcttatttattaatctttttatactctaaatccagtagttttatctgtgccattctttttttttaaacaaagagtaccatttgagatggtatcttttgttttttttttttttgagatggagtttcactcttgttgcccaagctggagtgcaatggtgcaatctcggcccacacaacctccacctcccaggttcaagcgattctcctgcctcagcctccctagtagctgggaccacaggcatgtgccaccacgcctggctaattttgtatttttagtagagacggggtttctccatgttggtcaggctggtctcgaacttccgacctcaggtgatccacccgcctcggcctcccaaagtgctgggattacaggcatgagccaccgcacccggccttgagatggtatcttaaccctttctcccccactataaagcagagcctgatgcaaggattgagtgttaacaccttatttaggaggtatcagtacaaagtggtgagggtaggtatgcaagggaaggaaagccaaagaacaatgccaagtgatgctggctggtgtttgacagtgaaatgcagagtcccagccggtcacttagtggatatgttcacttctggaagggctgcaaggaggagccgtagcctggagtagtctgcaggaaagcagagatgttttatctactcacctctgtcttgtctcctatttcacactggccaagcccctccccttgcacagctatttccctacacatttggtttgtaccatctgactcctaccaagctctcagaaagccagattccaccatgcagagtgatgcttcatccaagcccaaggcagtggtcagcagagcatgagtgaggtaccaagcaaaacagaaggtggctgttgatggaactatgaagagtccagtgcctgtgtccctaggcagagactctcctagaactgagtgctgtggtgaacatctgtttccaccctcagaccttgataacttgatctttcataaaagtgggttgcagaggctagtgattttgcttcataatcatcctaggaggaaacttctaaatcctctaactcaggggttggcaaactgtggcctatgggccaaattcaactcacagctgtttttgtaaatgaagctttctttattggaacacagccatgcccttttgtttacatattgtctatggctggttttgcacggagattgtagagctgagtacaagctgtctccaacttaaaatggttggacttaacgatctgacttggtgtaaaagtgatactcattcactagaaactgtactttagttcagtattcaataaattacaagagatgtataacacttcactacaaaataggctttatgatagatgattttgcccaactgtaggctaacggaagtgttctgggcacgtctaaggtaggtgaggcgaagctatagtattcagtagtttaggtgtaatacatgcatttttgacatacaatatttgcaagttacaatgggtttctcagtatatagccctgtcataagttgagggtatctgtagttgcagcagagaccacgtggctcacaaagtgaaaatatttactctctgacccttaacagaaaaagtttgacaatacctggtttaagaaatagaatcaggctgggcgcggtggctcatgcctgtaaacccagcactttgggaggctgaggcgggcggatcaccaggtcaggagatcaagaccatcctggctaacacggtgaaaccctgtctctactaaaaaaacacaaaaatttagcccggcgtggtggcgggtgcctgtaagtcccagctactcgggaggctgaggcaggagaatggcgtgaacccaggaggtggagcttgcagtgagccaagatcacgccactgcactccagcctgggcaacagagggagacgcccccccaaaaaagaaagaaaaaaaaaaagaaatagaacctgtttgttttacatatatagaaatgaagtccctgcatggtaaagggacttgatccaagctatctggtcatttataagccaagctgtgaccagactgcccagtcttctaatcttttcttttttgcctcagtatttggaggaatgggcatgggtggcagtgacttaagttggaatgagaataactgagtttgtggattagtagataaagaaaaataatctgaaataacaattttttaagggaaacctatgcatctttttaaagcatgaacccaagtccaggagagttgaaaattgtttttaagcttttttattttattttatttttttagttgacttcctgggctcaagtaatccttccaccttagccttccaagtagctgggaccatgggcatatgtcaccacaccaggctactggaaaaaaaaaagtgttttattttttgtttggttttttttttttttttttgagaaggggtcttgctatattgcccaggctggtcttgaactccgggctcaagcaatcctcctatcttggcctcccaaaatgttgggattacaggcatgagtaccacactcaggcttttaagctctatagatttatagatctatatctataaatgtgttatgtttgtgagcgaagcttggaggactaaaccaggatgtgagcttttggattcctttgccaaatagtaattttcttgatttcttgctttaatttttctttaaatgagtggattcccatttaactttattatgccaggaactaatgtgagtttctggataagttttccagtagaacacttttttttttttttttttgacggagtctcgctctgtcgcccagactggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggccccagtagaacacttttaacttttctttgttacaaataattggatccttttctaactccccaaatagaatgaatggccctgataattccgtgttaataaaagttcctctgagaaggttctgtacccaaaaacatacatctatttttttctgtccatctgtgttgagcaaatgtgagactaaaaagatgtgcatgtggtacatttggttgattaaattagggttgcgtgcgtgtgcgtgtgtgcgtgtgtgtgtgagagagagagagagagagcgccagcctaatttatataaagcctaattttggctttattatttttctttaatggattcttagtggaaggctgttagagcttaaagcttcctattaatccgctttggtgtgggttttgttttctcttccaggatatccgttctaacatgtaatgtttaggtaatacttacgtgcataacacacccctcatttttcaccagtgtttaaggccaataatctcccatttgtggcaaatgccaagtggcttaaagtcagtcacactgctagtatgaagttgaagacccacacaagtaaaaagacaaaagagacagattttgttgtttgctctattctaggaagttgagttactttgcaagactgtttactggtaaacagtgtgagagcgttcctcactgtctgttagctggagtcagtgattagcagcatgtggttcagatatggaagtggaacaaaaacaaatgtgtagaataggatccagaaatcttctagaatattcagtgacccagaatattccactcctagctgtatacccaagaaaattagaaacacacgtccacacaaaaagtgtgcatgcatgctcagttcagaggagcattatttattatggccagcagcaaccaaaatgcccatcaactgatgaatggataaacaaaatgtggttttagccatacaatggtatattattcagccataaaaaggaatgaaggtgctggctgatacatgctacaacgtggatgaaccttgaaaacatcacagtaagtcaaagaagctagacacaaaaagccgtgtgccatatgattctgtttatatgaaacgcctagaatagagaaatccacagaaaaccaccctggtggttgcgggggggagctggaattaatggcgagtgactgctgatgggtacagggtttctttttgagacaataaaaatgttttaaaattaggtagtggtgcaggttatacaactctgcaactacaccaaaaaccattatattatatgcttttagagggagaatataatgatatgtgaattatattgcaataaaagtgtcattaaaaacaggcttgtgtgggcatggtgggcgtttatgactttcttggcatcctttagaaactgttctttttttttttttttttttttttttgagacagaatcttgctgtgtctcccaggctggagtgcagtggtgcgatctcagctcactgcaacctctgcctcccgggttctaagggatttctcctgcctcagcctcccgagtagctgggattacaggtgcccaccaccacgcctggctaattttgtatttttagtagagatgggatttcaccatgttggccagactggtctcaaactcctgacctcaggtgatccaccagcctcaccctctcaaagtgctgggaatacaggcatgagccaccgtgcccggcctagaaaccattctttagacgtcttggttagggagtctttctgtctgattgccaaactttggtgggtgtcagaaatacctcggaaattgagtttgtttaaaaaacaaaacaatacgcagattctatcacagaccttcagaatctatttggaaagagaaaaaatgtcaactttatatttttcaaagttttctaacagtcaccacctatttttatttgcaaggacactgtgtaataataaaatggtggaggcatagtcaaatatgattaagttgaagaacaaatttaaatccaatttcctcttatagaaatttaatgagaaaacacaacttctttaaataggtaaacatgtatcgtagccccaaggttaaaggttatataatcataaacaattgtagaatctcatggtggagctattgaagacaaacaactcaattttatggtgacaagacttagaatgagtataaaactgccaagaaaggcccttcacctggccagtgtttatattcttaagtgtcatcagcgtggctgacttgtgtatattttccagcctttattcctgtctgtataagaggatgtaatggcaggtcttataatttcaaagctttaaggtcaatagctcaaaaattgtttggatctcagcatttttgctattaaaaaaaaatacgcatgcactctgctttcaacttagctgaggctaagtcaaagaatttggggcggccgggcacggtggctcgcgcctgtaatcccagcactttgggaggccgaggcaggtggatcacgaggtcaggagatcgagaccatgccggctaacatggtgaaaccccatctctactaaaaatacaaaaaattagccgggcatggtggcaggcgcctgtagtcccagctactcgggaggctgaggcaggagaatggcatggacccaggaggtggagcttgcagtgagccgagatcgcgccactgcactccagcctgggcaacagagtgagactctgtctcaaaaaaaaaaaaaaaaaaaaaaaaaaaaaaagaatctggggcttgtactgttttcatttgtacattctgcttagcaccctggcatccggacaagatgaacagcattcctgccttcaaggaacctagagtctcgtgtgcagcagttcaggccttggaggtttggaggagttgtaaagtttcttctttcatttttctcttctatggagatctttagactggggcatcctaatttgcctctactttggttaggatgagtgtgctggcctgtagtcacttgtctctttaccattcattacatggcagagcccagtggcttagtggagtccaggcactaatcccatagcaggatctctaccagtcattagatcaaccagtactcgttaattacaggccaaaggaagtacaggtccactgtgcattgtgtacctatcaggaatgacttttgcttgatttgaactctttttgaaaagtgctggtctgtgattactggactcctagggaaatggcattataatgttttggggatggcagggaggtggcaggcaggcaaggtcaggacctctggaatccaggagagctgtcttgcaaagacacagggagggtagatgtcacttgctggattgtcattagactagagactgtcaacagaagcttccattctgtgaacacagtgcttaaaaatgttgttagttttcaacattgaaaaattgggagtttttttcgtaaacatctggatatctatcttctttcagaaaatcgtgaggtgtggccccaccagccccaccttcctgcatgaacacagctggttggggctgagaaggttaccactacctgccattttttttaatactcaactgggcttcatgcatgtgttttccgtgtttagttctgtgggtgtctgagtttgggcccgatgaaaagagggtgcctggtgattttacatcaagtattgcgggtgagggtggcatcagacacaaagtcaggaagatatatatatatatgtgtgtgtgtgtgtgtgtatatatatatgtgtgtgtatatatgtgtatatacatgtatgcatgtatatacatatacatacatgtatgtgtgcacacacatgcatgcgcgcacatacacatacatgcacacgcgcacatgcacacacatgcatgcgtgcacatacacatacatgcatgcgtgcgcacacacatgcatgcatgcgtgcgcgcacacatgctggtatgcgtgcacacgcacacacatgcatgtatgcgtgcacacacgcatgtatgcgtgcatacacacatatatgtgtatatatatgtatgtatatatagagagagagagcgagagagagagatgaagtcctgctctgtcgccgaggctggagtgcaatggcgcgatctcagctcactgcaacctctgcctcccgggttcaagcgattctcctgcctcagcctcctgagtagttgggattacaggcatgcgccaccacacctggctaatttttgtattttttgtagagacaggatttcaccatgttggtcaggctggtcttgaactcctgacctcgtgatctgccctccttggcctcccaaaatgctgggattagaggcacgagccaccgtgcccagcctaggaagacattttatgaatgaagttggaaatgagagattatgaaggggaccaagcaagagaataaaaaatctagggcgagcagacttattagtcaacaggtatgaagcaccagtttcgagagggatcttaaaacccatcctactctgcctttttttctggggcttttatgtgtgtccaacattagcgcaggaagctctgccattctggggcttgtgtggagcctgtggggtggggtgtgggaatgggaacctgtggtgcggcgggaagttttgggctacagggaggatctgtctggatggacataaccagagtgagcttttaaagggttaggtcccagcgagtcagtgaaactcctagtatgcattgaaatgatctgtaggttatattctaataagtgagtgggcaaggaccatgtgaattgattatcaagtaacaagtatttgctaaataccttccctgtgctgggctctaattaaccacttggatggcttcttgcgggggtggtgtgggcgaacacaatgcgaatggcttcttgtttgcaaagacagaatgcttcctgaagtggatatgagattgttaaaatgagactttcctttgggttggagttcatttcctttcctgcctgagtattgtgctgaaagtcctttccacctctaaacaccctacgaggctgtgagttgccactcctacgagctcatcacccaccagtgtttgagacggtgcctccctatgcaaagctggcatgaggtcccatcgatgagattgttattgttggaggaagaccttggagtggggtaatagcttttttgttacttcattctgagttggattccaaagtaggtagcactcatccaagaggtgtaggaggaggaaaatggggtgagaagttagtcatgcaggatgctgttgtttactacctgcccactccctgtgagcactgtgcccagtggcgcagaaggggagcagaaggggcactgagatggcatgagggtcttgtcatccttggacagatgatgcgccgtgctgtgcaggtagcaggcaccctggatatttctgtggcatgaagcttctgccctcttgccagctgtggttaatgcctatctgcgtgcccaaagataccctcagccccaaaagagtcgcttctgtgaggtcagtcgaaagccaagccatttattgagtggtctgccagagggatgaactattggagtaatatgttgggatagggtcctgctcccactctgaaagcttggccagattgtggggaccccatggggggccttggtggctggtgacatatggagtgggaaggtcggagcaaaagcagttttccaactggtacagacaatgtcactgttttcataatcaatattactgtactcatgggctttgggtgaacacctgcatggacttgtgctgtggttggagtatggctatcctgtgctttctttactgcccctctgggccatgccagacacctgcggtctctgctgcggaacccccaggctcctctgtttctcatttgtccagactttctcatccccagatcaacttccaggtgttaggtggacctctatccaagcctcctatcacccccagccagccccagccttctgcttcatgttacgggttgagttgtgtcccacaaaagatgtccaagttctaattcgccagtgcctgggaatgtgatcttatttggaaataagatctttgcaaatgatcaagttaagatgtggtcttccagtgtggcaattcctcaaggatctagaactagaaataccatttgacccagccatcctattgctgggtatatacccaaagaattatgaatcatgctgctataaagacacatgcacacgtatgtttattgtggcgctattcacaatagcaaagacttggaaccaagccaaatgtctaacaatgatagactggattaagaaaatgtggcacatatacaccatggaatactatgcagccataaaaaaggatgaggtcatgtcctttgtagggacatggatgaagctggaaaccatcattctcagcaaactatcgcaaggacagaaaaccaaacactgcatgttctcactcataggtgggaattgaacaatgagaacacttggacacagggaggggaacatcacacacccgggcctgttgtgggatggggggacgggggagggatagcattaggagatatacctaatgtaaacgatgagttaatgggtgcagcacaccaacatggcacatgtatacatatgtaacaaacctgcatgttgtgcacatgtaccctagaacttaaagtataattaaaaaaataaaaagatgtggtcttcctggagtatagtggacctatatccaatatgttggggtcctcatcacaaggaggaaatgtggactcagagacagacactcatggagggaagacgctgcgaaggcacagggagaaagccatctacgagccaaggaatgcccaaggccaccacaagctaggagagaggcctgggacagattcttggaaggagccaaccctgccagtatcttgatttcagatttctggcttccagaactgtaacaatacgtttctgttctttaagccacccagtaatgtggcattttgttatagcagccccctggaaactgacacacttcccccgccccacactagtggttatctttgagcactgatagctaagcagtggtatcgtgtccgctaggatgctgtaaacaggttgcaatctgtcccctacatttcaatacccggcatgaggttcaggtggcatgagcagcaggaagggtggcttgttttcccattgccttgccaggccatcggtgaatgtggggtgcaggctcttgcttagaagagctgtcttggtggcagttccaagagagatggatttttttaaaattatgtgtttttgttttttggtacaagctgcagaaaagagggacttaaaaaacaattaatttccaaatacttttgatccttctcttggctgctctgaaccataccagagaggacttggctgaaggtcttgcctgcagctgtgctgtttcctggttatgttaagctcttccttgcatttccagaatcctgaaattgcaattcccccatctctaaaagagagagttgggctagtttttaaaacctttcaggctctgtatttcccctgagagacaaccctgatggccgctgcaggggagcgctcagctcctgcctccacttcccttttttccccgattcctgctggctgggtgtctcccggcagtgagacgacacctcatcaagttggggagaaggtgcttgttcacagtgcttctttccaaggcatgggattagggagggttttatttcctctttttacttttctgttttccagtgtttcttccctggacctgtattacgtttataagtaggataaaaataatttctctgaaatagaggagagggctggagcttagcaccaagactttcttttgcttcccattccctagcataaccctcttgctcctctgtttctcttgatctttctcagatttctgtttttattcgtgtcctcttccctctttcctgctcgaatcttctagttgtattttggggtgttgctacgttaaacaagtggtcttatgttctggccatcaggggtttgttccagggccaagctgtgtgaacgtgaacctgagcctgaaaaggcccagggctttgtttgtttgtttgtttttatatgatacaaggagcatccaacaatgcccagcccgtgtgctctctgccactggagaaggagtgtgccaggctggaaggcaaggagatgatgactccttgtctcagaccaagacttcgcttgctttctgctcctggtatatacaaatggtatgtgctgattgggtagatgggtgccactgcagaaaggtacggagaagacagagcagacgcaaagccttgggaagcggaagaacagaaagggccaggggcacatggtgatttttgaatgctgcgatcccacctagctggctccactctttcgtatgaagagtagattcttataacaaggtgtgcaaacgcagaactttcttcactagcagaatttagagacagagatgaaaatctcaaggaactttcatgacgacctgagtatctgggaacctggctgatttcatgactctcagtgaatctgccctgttgcgttcactcttcttttcctagatctctctgaccaacctgatgtcatttctgtagttttcatcattaccacccgtttggaggaaatggtgcaggcagagggtgctttcaagtcaagagtaattggtgggttgttttgattcttatgcctttcttttaaagggtcctacctccaacacctggataaaggtagcacctggtgcagagaaaaccctgccctttgttgccttctagaccagtgtttctcgaagtgtggtccccagaccagcagcatcagcgttacctgggaacttgttagatgtgcaatttctcaggccctaccccagacctactaaatcagaaactctaggggtgagacccagaaatttgcattttaatgctgcctccagaggactgtgatgcttatatcacacagcatcataggactggcttgaaactgaccatctcagtatgaaacagaccaagtctatgaaacagaccaagtcttagtcagtgcctaacagctgcaatctgttttaaccagtccttcaagtgattctgatgcgctctgacgtttgagaagcgctcctttaaggctgcccctgttcctagcatcttaccattcctctgcatggatgaagttttcagtcctctttgcagggaggtttttaaacctcctgcaatttcccaaggaatcttatttccttatttccttcaactataagatgctgcctagttctgcttcattttgtgtgatcttctctatcctgaatgccatttttgacgtttgagaatagctttttttgcccagaatttctatacatgttttacagtgctggttcatgataaggactttttctgtgtgcctgaaggagccgtggggctaaatggccatcctcttccttgggaatccagcaagtttacaagtggctttgtggccacacctgagagattattgctgatttctattttccagaatagcctcacctctttctatttcccccaagtcctgtgaaaagcaatactcagtgattttgagcataatttttttttttttgaggcaaagtcttaccctgtcacttagggtagagtgcagtggcacaatctcggctcactgcaacctctgcctccccagttcaagcaattctcctgcctcagcctcccaagtaagtgggattacaggcatgcaccaccacacccagctaatttttgtatttttagtagagacggggtttcaccatgttggccaggctggtgtcgaactcctgacctcaagtgttccacctgcctcggcctcccaaagtgctgggatcacaagcatgagccaccgtacctggcctttagcataatttatacacataaagtcacaccttttactggaaagtcttctatatacagattagttatgcgagcaattgaagttaataaaggccgagtttctcagaaaacagcaacaaaaagttgatgcataagcggaaaaatgccatttatgggagaagtttcgaagcagttgtgtggtatgattttccatggagagattatggaagcactgcttggagcctgttaaaaagctacagttcaacatggtcaccgaagaattttccagatgtcagtctaatggcctctgggcctgtgtttgccatttacagggcagtgtgctttgatggatgtccttgggcagggagtgtcttgttataggactagaaacccgctcatactaacttatgaaaaaagggcatttattagagggatatgggggcatctcacaggaatgcaggcgtaaggatgggaaaatcaggtgccaagattgattgtcctaactgtgggacctggtgatgtctgatgctacttcttttccttcccttcccttcccttttccttttccttttccttttctgtctttctgtctttgtctgtccttctttctgtctttctgcctttttttctttctgtcttttccactttttaaaatagagacaggggtctcactatattgcccaggctggtctcgagctcctgggctcaagacacctaccttggcctcccaaagttctaggatcacgggcgcgatctttctctgggttctcttcatgcatctttctctccgcagtcttgccttttcttcttcagcagccatttggcagaagtggccactcatcgtggaagaggaccaccccaagtcctgttctatacaactcttggcaggtccagtagcagtagccaagtagtcacgcccatagcatgtgtatccaaactgggatttgggcagttcttagagaagagtcttgaacatgtgtagttggatattgtgaaatatatatttggtcttccatccagctccctggcataaaccttggaatctccagaatgttagtctcttgtttgctaatgagatgatgggtgtctgggatcccctaggcagcttcaggatggcagctggtcacaggaaagaccaaggcatgcttagaaggttggaacttcagcgcctaccccacaaacctctggggagaggaaagaggctgattatcaattcccagtgatgacatcaatcgtgtctatgtactgaagcccccgtaagaacctagaaaaacagggtgtagagagcttctggtcaactgaccacatggagcctggggagtggtgccaggagagggcatggaagccctgtgccccttcccccatccctggccctgtgcatctcttccatctgcctcttcatctgtatcctttgtcatagcctgtgtaataagtgggtaaaggttagtaaagcgtttccgtgagttcagtgagctgcttttgcaaaggaatcgaacccgtggagggagttacagaatccctgatttatagcctatctgtcagatgtgtaggtgacaacctgctgcttgtgattggtgtctgaagtggggagtagtcttgtgggaatgagccttcagcctgtgggatctgatgctatctccaggtagatagtatcagaatcgatttaagttgtaggacactctgcttgtgtccgctggagacttgctggctagtatggcggggaaaactcccatatacctgatgtcagaagtgttgagtgatgttgggtagagagtaggagaaacagtttagtttttcctatgttatcagatgtagcaaatggttgtcattttttatgttttattattctgactgtgatttttaaaactccacttaatagataaatatgccaatcttttccttttgtgatttctgccctttgaggccacactttaaaaggtctttaccaataaaagatggtaatattttcttctagcagtcttatggactgtttccaccgcccccgcccccacccgcccggcccctttaaaatattaagccatatggaatttaatttctgaaaatgaatgagaaagggacctacctcaatatttttcaagtagttctcccatcgttcaaatagcattgactgattcagcctttcaccattgccttgagaagcacctctttaccatacgctaaactagtctggctgagtctgtttctggtctttttccccttggtctgtctctctgttcctacaccaagttttgtctgttttctatcatggaaatttctcatagattcaaatgggatatactataaaaatatagtcttctggcctggcgcggtggctcatgcctgtaatcccagcactttgggaggccgaggtgggcagatcacctgagatcaggagttcgagaccagcctggccaacatggagaaactctgtctctaataaaaatataaaaatgaacctgggtgtggtggcgcatgtctgtaatcccagctactcaggaggctgaggcaggagaatcgcttgaacctgggaggcggaggttgcagtgagccaagatcacgccactgtacttcagcctgggcgacagagcgagcctctgtctcaaaaaataaaaaataataaaaaatatatatatatgtgtgtatatatacacacacacacacacatatatatatagtcttttttttttttttaaattatactttaagttttagggtacatgtgcacaggttagttacatatgtatacatgtgccatgttggtgtgctgcacccattaaatcgtcatttaacattaggcatatctcctaatggtatccctgccccctccccccaccccacaacaggcccgggtgtgtgatgttccccttcctgtgtccctgtgttctcattgttcaattcccacctatgagtgagaacatgtggtgtttggttttctgtccttgcaatagtttgctgagaatgatggtttccagcttcatccatgtccctacaaaggacatgaactcatccttttttatggctgcatagtattccatggtgtatatgtgccacattttcttaatccagtctatcattggacatttgacttggttccaagtctttgctattgtgaatagtgccacaataaacgtacgtgtgcatgtgtctttatagcagcatggttatagtcttcttactttggtttcatttttaagaaagaaccagcatcaaatgcttcatgtgtattctttcggcacatttgccttgcatatacaagcacagacattttatttatgcccttttgttaaagtgagaaccttttgtacacgtagtgtgttttggagcctttcactccagcactcatgcacttcagcagctccacaggatgccaccctgtcgatacatcattgtcccctgttggtgaacatttaggtcacttcccaagagtcttttccctctaatgaaaagtgctccacaaaataccttcatacttacattattgcacacctaaagctattgttaggtcaaaagacacgtgcatttgggcttttgatggatatctccaaattacctttcacagacaggcattctcacctgtttttgcagatcctggttagataggggttatcagtcacaaaggaggttattttccccatgggtgaaaacatagtatcttacagtcttaacttgtatttctccaattttgaatgagaatgagtatctttttttttttttttgttattgatcatttgcaattgttttttctgtaaatcacctgtatatgttctttgctctttttaaactgggctgctcactgataggtagttcataccacacaaagggaatagaggctttatctgtctccctggcccccttcttggtctttccctcgtctctttatctttctttttatctacatgcatatacacatgtatctttaaaaatcagccatcagccatgttactgaacataattctaatagttgatttgagctgagtcttccttcatttatcaattactgagtgtccttggtgcccaggagacaggtccacatttattcaatacagtcacaaccctcagaatacatctggtgggagggataggtatgaaagcaggggatgtagctgaggcagaaagagattcttcttccagccagcctgttagctccctagggcagagacgatactgtgagcccccctgctgctccccagtgctcagaaagtctgaatgaattgacaaggagcacagggactggactgttaggccacctggactcttccgttgccacgtcacggtgagaatagctggctgcctcactttccctgtcagctccaaacacctgggaacaggattgcttgaaacttgtctttcctgccctctaactcaggacttggccctcaggggcttaagataagactttgggaaggggttgtttgttttttttcttgtaaatttgtttgagttcattgtagattctggatattagccctttgtcaggtgagtaggttgtgaaaattttctcccattttgtaggttgcctgttcactctgatggtagtcttttgctgtgcagaagctctttagtttaattagatcccatttgtcaattttggcttttgttgccattgcttttggtgttttagacctgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccaatgcttgtttttctcaggtttgtcaaagatcaggtagttgtagatatgcggcgttatttctgagggctctgttctgttccattgatctatatctctgttttggtaccagtaccatgctgttttggttactgtagccttatagtatagtttgaagtcaggtagcgtgatgcctccagctttgttcttttggcttaggattgacttggcgatgtgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgagtgggagttcattcataatttggctctctgtttgtctgttattggtgtataagaatgcttgtgatttttgtacattgattttgtatcctgagactttgctgaagttgcttatcagcctaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagcatgatattggctgtgggtttgtcatagatagctcttattattttgaaatacgtcccatcaatacctaatttattgagggtttctagcatgaagggttgttgaattttgtcaaaggccttttctgcatccatcaaaaagtgggcaaaggacatgaacagacacttctcaaaagaagacatttatgcagccaaaaaacacatgaaaaaatgttcaccatcactggccatcagagaaatgcaaatcaaaaccacaatgagataccatctcacaccagttagaatggcaatcattagaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagattggattaagaaaatgtggcacatatacaccatggaatactatgcagccataaaaaatgatgagttcatgtcctttgtagggacatggatgaaactggaaatcatcattctcagtaaactatcgcaaggacaaaaaaccaaacaccgcatattctcactcataggtgggaattgaacaatgagaacacagggacacaggaaggggaacatcacactctggggactgttgtggggttgggggaggggggagggatagcattgggagatatacctaatgctagatgatgagttggtgggtgcagtgcaccagcatggcacatgtatacatatgtaactaacctgcacattgtgcacatgtaccctaaaacttaaagtataataataataaattaattaattaaaaaaaataaataaaattacaataaaaaaaaaaagactttgggaaggaggccaggccctgctagaaacacctccccgactcctgctgcctgtgcccacacactggaaccttctccccggaaccttttccctccgggcttccctcactgcagcactcactgcttttgtgccttctcctttctcctcatcttcacctattctagaaagactctgaggactcagtcatgctcatgggtttgtggcaatctcttctaattcatatagcacccctgggaactcaagtaggtagcaaagacccatgtcaaagccgcggctcttagaaggttggggtaacatctggggggttccttaaattactctacattgctaccatgtaccttgcctgatcctaagtctaacccactccctggggcttttgtctgggcccaggtacctcctgatccttggctgggttccgtgaccgtcctgctatggactatactagttttcccgacatgtggttagtcactgagatcgcttgataaaaatgatgagttgagttcctcccagcctactcaaccagaagctccaggtgtgaggtctgggcaccagtatttctaacaagtggctccagtagttctggtgagtaactggattgggaaatgagaccagagctttgccaaacacctgtgcttaggttctggatctggagcatccaggctttggattcgataaggtgtcttctcagtttctcaaccataagatgggagtcatatgcgtgagctggcagtgggttaccagcacctgttgtctcggtgacaagacatatttctccaacattgcagtcaaccttccttgcccttcaacccaagtttgggtcagtgatcgtcttttaaatgctcacagattcccggtgtgtttgcacgggtctacgctctgtaaggaggctggtagatcagggatcctaatggggattgagagacaggcttggacagctccaggcagcaccccctactccctgcgacccttcgaattccttggctattcctggattcctggccctgctctttcacaggccctctgtgcaggctggagccagaccagagcttggttctggcaaatatcaaagggccaggacactgacggggcctctgcttcatcccatcagtaacacagtttctgtatcatctgtgaaatgggcacaggagcccctgctccccaccaagattgtagggctgccctaagaattttgtaagcagctgtgagtgggaagttggggaccactcatagtgatgtttccctggttaactaagggatagcctgacactgcagcaatgctaaagaaggcattctagccccccttcacccctagcacccctcttttgggagatgtgctccttgtaggcatcaaaaggaggggtgaggcagggatccagcttctggggtagaagttgggaagcaaagaagaggaaggaaggaatggaggtggttttagttttttgttttgtcttattgttgttcttagtgtctgtgagtgcttactctgtgtcagaaactgtgctaagagctgtatgtacctcactgagtcctgtcctcaacaccaggaagctgggacccctatactgctatcccgtactttacaacagggaaaccgaggccaaataacatggtccttgttaaaaggaatagatctgggatttttgaacatctgtctgtaagatgccagcgccagagctcttaataacggattctcagaccttagagtataccacaatcacccagagggcacccagcaggttccagataatgctgatgttgctggtccgggaaccatactttgagaactactgccctggatgatccaatctggcccccattacctctgaactcatcttctattttcccttccccacaattcctcttcagccacactatcctccttgctgctctctatgatgaaggacatgcttctgcctcagaacatttttattttatgttcccttcatttgggattctcttccctcagatatgtgtgtggcttgctccttccctctgtgataggagccttccaagatggcccccaacacactcacctcctgatacactcctgtgtcatccctttctaccttccctcctgggtggtccctgagactaatagattgtggcagtcatgatggagtgtcacttttgagactaggttgtaacagacattgtaccctttgccttgctttcccctggctcgctcgctctgggcgaagtcagcagccatattgtgcagagcccgtggcaaggaactttggctcctgccagcatccgtagggcgagctttcttcttttttcttttttttttgagatggagtctcgctctgtcgcccaggctgaagtgcagcggtgcgatctcggctcactgcaagctctgcctcccgggttcatgccattctcctgcctcagcctccccaggagctgggactacaggtgcctgccaccacgcccggctaattttttgtatttttagtagagatggggtttcaccgtgttagccaggatggtcttgatctcctgacctcatgatccgtccacctctgcctcccaaagtgctgggattacaggcgtgagccaccatgcccggccagggtgagctttcttacaagtagctcctccagccccagtcaagccttcaaatgaggcagcacccactgacttcctgaccccaagctcatgggggaacctgaggcacaattgcccagctaagccactctctgattcctgatgtgctaaaacaatatgaaataatgaatgtttgatgtttccaactgttaaattgggggtaatttgcgatgtaacaatagatacataatacatttctctcagatcttcattctgtgttcctttcttggtgaggccttccctggccattcttaaattacagcttcgttctcataacactttctatcccccttccttgctttattctccttagtgtgtaccaagagctaacctgatatgttttgcttattttttgtctcctggcacaactccctcccccaatcccattagaaaatttttaagttttcacttatggaaaattttatacacatacacattttatacacatgtgcatgtgtctaaaattaactaaagatggaatggcataatgaccactagaatttaagctgaaggaggaggagtttaaccacttatatttcctgcaatataaccccgtgtccagcacagtgcctgacacagaataggccctcaaatatgtgttgaatgaataataataatattcatattgaggatgattctcaaataaagggttgtttatagattaaaatacactgttttgctgcagctcccagagtcccagcctagagctcagacacggtgagtgtggccagaaaatggtggtctttgttgtcagactgagttccagagatgccacttctcactgaggcctcagttccttccattaaaagtggaaatgggccgggcgcgtagtcccagcactttgggaggctgagacagacggatcatgaggtcaggagatcgagaccatcctggctaacacggtgaaaccctgtctctactaaaaatacaaaaaaattagccgggcgtggtggcaggctcctgtagtcccagctcttcaggaggctgaggcaggagaatggcgggaacctgggaggcggagcttgcagtgagctgatatcgcgccactgtactccggtctgggcaacagagcgagactccgtctcaaaaaaaaaaaaaaaaaggaaatgacagcacctatctcataggtgttttgtgaccgctgaaggggatgccagatgtggaggggcttggcgtgaccaggcgtaaatggttcttcagagagtagtttctttcctgcagagaaactgtggttgtgatttaaatatcatttaattttttttttcgagatggagtcttgctctgtcacccaggctggagtgcaacgacgcgatctctgctcaccacaacctccgcctcctggcttcaagcaattctcctgcctcagccatttacttttaagagggaatttcaaatgtcttgtagcaatggctgtactggaaggcattgaaaaaccagagatggaggaaactctggtgcgcaggagggaaccaggtctctgtgaactgctgcttttgtattggccaagggagataagcaggggcctccaggagaatgtggcctgattgcaaattctgcatctgcctggaccaaggcaatggggctcgcttggaggacagggcagcatagcctgggggcaagccagcttctgggtaggaagggagaagggctgagaaacggagtggcagggctgccatctgactagaaaaacctggccatagctaggcagaccctccttgtgaggactacagggcaaggagagaagccatgggtagagagaccgccaaaccagggcaaggaagaaagaaaatttggtggtgggggaggaggagatagagcaagtagcacagaagggtgagtataaagagaggcaaagaggagaagactgcaggaatctcagatcaaagtcaagaccccagagtccatttccttctgctctggtatctgtggttattttacctgataaccacagggggcagcagagagccggcacaagccaagaaaagtggacgagccccagcaggaggccactgggggccagaggcttgtaggtgggcccatggccagtcaccataaccagtggcttaggtccaggggctccttgtggctttcccactggagcccaatattgctaatgcaggcaggatgcagccttaacaaggggaaatgaagcccggaagtgactatttaaaattaataacttccgcctagctcactgtttttaaaatttattattattattttgaagaaggggcatctgtgctttgaaactcagatttacatagtcttcaagctttcaactggtctctcactttacaaattattcattcactcactcatccattcatttattcatttatagagatagggtcttgctgtgttgtccaggctggacttgaactcctggatcctattgcatcagcctcccaagtagctgggactacaggcgtgtgccactgtgcccagctgtctttataagttttattctatgtggggtagacactggcattcgctgaggagaagattaacatctttggctcttagcattaatgctaaaatagtacctcccttagactggtttcatccatggccagtatatggctctctgggtctcagcggaagaggtctgaatggagttctagttaccactaggaaaatatgtgttttgtgtgaattaggtggggtgggaagaggctccccggggcacatctcacttcttccactctgaccgcactgttcctcctagaacctctggggcctgtgtggccatggctctgttagtagagtgtgggcagtcatccgggatgacctaagaccacagggatggacgtccagagaatgcagaagggtctcaatccagcatctcttgaggcctggagctgccgcttcagtcttactgtgacttggtcaaggagccagatgtgttgtaagcagattagggaatcttgtattggaaaagacctggacacggcttcctccctgtgggtagtatggtcctctggggtgacttgtcctgctgctggtgaggtcacccagccagagccccagtggctctctccagatgtctgcctggcctggcctggcctggctcagcaccatccctgccccaggctcacagtgtctttgtgttatgggttggtcagatctcgccaagacaaggagatggactgggctgaatccttcaggcagctgcatcgtccctgatggggcccatttggaggttagaggggagggatatggtacttacggagactctagcttgtggggggtctgggagttgaccaggccagtgagggcagggaaaggggcctcccatcgggtccccacatggacagcagcattcagactgcaggccagcgtccacctagggtttcagagcctcctgcagcccccggagctgctggctgctgttctgattgcctctgtactggtagttcccttcatggagggctcaaggatgggggatggggagaggaacggggaccagcagcttctctgttcaatagtccagatgttattttgggtccgcagtggttggtgatggctcgcaggtagtaggcaaacagtgatggatgaatgggtgcaaggatggaaggagtagtcagtgcatgaattgtgaccctctgccccaaccagaagatcaaaggtggtgtctgcacatcagctggtgggacttccttttaaaataaggtcaatggtgtcagccaccaaaggggtggtggcagcagcacaaagggaaagttttctgggaccttttccctgctgtttattcctggagagcacatcaggtgggaatctctcttgtgctgtcacaatgtccgtctttctgttggcccatctgtccttgcatccttcaggccaggtgccgtatttgagagggcgaaccagccgtggcttcgaccctcaaggagataaggtgtcaaggttaggatctgagctgtctgagggatggacaaagtgctgatttcctagaaaaaagctggatggaatgtgtgtgttgcaggacttaggtcaggttctcaagaagacttgaggcagatttacatgcaggagtttcagtagggtgtgtgctcctgggagcaacccccggggaaggaaggaagcagcattgcaatgcggccaccaaggaggcctcggcagcgccgtggggagctctgagctgggaggggccttcagaattgtttgatttgagacaaggggattggtgggccgttgatcccctctcaccccagtcattagatgtgcaccctgcacccctactctaggcatagccttgggcacggcagctctctttggctaagggcggttccctgagagggactcagctatgagcctctgcagctagagagatttgggtggtgcactacagcacccactctagagagtctggggaagaactctttgcagggaagaagagcaatcttgataggctgcatggtggaagagacattttagttgagacttgatgagtgaacaaggttgtgatatccagggatgggggagcaggaggcggcaggtatgggtgaacaatacgggaaaggcgtatttagagatcggcgaggcaagttaactgggcctgaagtgaagccagtgggatgtcagtctggatgcagtcagggttgggatcctggagcactttgccaggaggccagtggacttcggaattgattccgtgtgccatgttggaaaggagctagccagggattttcgctgtgaagtgacctccggcgaaagctgggctctagggtgagtggtccactagctgtgagtggacggatttcaaaaggcagggagactggctctggagtgacatggagaagacaagaggaacgtgatggaggggcatctccaggccctgggaaccaattagatatgagggatgggacatagggtggagctggtgatggtgagtgagccctgtccctggttgtccaggggccagggaacccaggagactcggaggagagggtggagaggggagcccggtcttgactctgtggatgtgaaggcaacagtgcggcctccaggcagggctgattcaacgggcaggagagaagagaagcctgcctaggaaggagcctgaggctggatggtgcatctgctcctggggatgcccacctcgctgcttttgctcatcgaagctccaccgggcttgtctgtctgttttatttagtgctgagaaagcacataccatgtgcccgatgttatcctaagtgctttgtacaggtgaacccaattaatgctctttcccagcctacttaggtaccattttcatccccattttatagttgagaaaaacagaatatagagttcagatgattccagaggtcactcagcgtatgaatggcttatgacgtgggccctaagcagggcagtggtctttgaagtaagttctccaaggcttcctgctcttgccagccagtgggtcccttggagaagctcctaagcctgctggcagcctctctccttgtcactcctcataaaagaccctactactgtctggtttatgttcacaccgtctctgctttccagatcaccctcaattctgttttctctcccttaagacatgaagggaccatattacccctgttatgcctgcccctggagtccaggttcacccttcctgaaacccaaaccatgggccttgagaccaccaatcacacctagagagcgggagtattggggcctacgagaccaagtagccgaacctctttattttggatgaagcatcagaggaccagaagggtggtgcgatttgcctagggctgcacggtagtttaggagcaaagttgagtcaagaacccagttttgtttttattgtttgaaacaattgaattttcagtaatggaatttttaactaaataatgttatatcctcatatcagactaactttaaaaatgacttagcgctagaggcatgtatgtgggcctttggtattggtacagtatctcccttgggtggacaccttattgaactcattttacataggaggaaagggagtcacagagaataagtagcttggccaaggatagtggtggtgagaggcagagctggattccaacccaggcagtctgggtctagaatcaccacactaaacagagcctaactactttgctataccgcccccttcagtgattttggaaagtttttaaaatttatttttattttatttgtttatttatttttgagatggagtctcactctgtcacccaggctggagtgcagtggcatggtctcagctcactgcaacctccacctcccaggaccaagcgattctcgtgcttcagcctcctgagtagctggattacaggcacacaccatcgcgcccagctaatttttgttatttttagtggagatcgggtttcaccatgttggtcagggtggtctcgaacccctgacctcaagtgatccacccgcctcggcctcccaaattgctgggattacagacatgagccaccgcgcccggcctattttcattttttgagacagggtcttgctctgtcacccaggctggagtgtagtggcgccatcatggctcactgcagcctcgacttcccaggctccagtaatcctcccagctcagcctcctgagtagctgggaccacaggcacgtgctaccacacctggctaatttttgtatttttggtggagatggggtttcaccatcttgcccaggctggtctcaaactcctgagtttaagcaattcacccacctcagcctcccaaaagtattgagataagacgcatgaaccactgtgcctggacagattttggaaaggtattcacaaaaatttatacataaaaagaatctatagtttgattttgtctcattttaaagaggaacatatgcttagaaaacaaatcaacatatggataccaaaatgttgatggtgatgacctctgaatggtgggatgatgggtgatatttatttttgtgtgttttcctgcattatcaaattgtatgtagtgagaaagtattatttttatcactagataacttcataagaagtctctgctcatggcagtgaaatgggtaaagtagtgtttgggggacaatactatagcttgcagtattagttttctctctttctttgctttctttgctttctttctttctttctttctttctttctttctttctttctttcctttctttcctttctttcctttctttcctttctttctttctttttttttgaggcagagtctcattctgtctcccaggctggagtgcagtggcacaatctcggctcactgcaacctctgcctcccaggttcaagggttctcctgcctcagcctcctgagtagctgggatcacaggcacgtgccaccacgcctggctaatttttgtgtttttagtagagacagggtttcaccatgttggccaggccggtctcgaactcctgacctcaagtgatctgcccacctaggcctcccaaagtgctgggattacagttgtgagccactgtgcccggccagttttatttctgattagagcctgtagcagggcattggaagagagagaggtgaccaggcaaattcagcagttacagctcaaatgagacttagaactgcgaaatcaggaagaaacttggaagtcaccaccaggtggcagagggcccctgtctctttacaggctcctgcacctctgtgctttggagtttcaggtaacagtggacatttggggagaaatacctggttggcaacttcagggttccaggagaagagtccagagccccgagacaaagtaggggtgaatgaagaggcaggttggggcagaggatattttagaggatcttgacatctcaacaggaagtccatctccttctggccccagcctcatcaagaagggcccccagcaaaaacaagctctgtggtcatgggatggtggaagggggcaggggccaggaagggagatggatggatatgggagcagaaagcagggtcctgtctggccagggttggggaggagggcgattggctgtctctctttttctccagctctgagcatctccttctgctctgtgaaactcaggttctgccctgtgacattctcaaagtgattttctttgctcttctttcaccagagaccacctgggaacgtcccagcagttctcctgggattccagccagccctggctctcacaggagctctctgcctccaacaggtaatgtccgctgtctgctttggggcaactgggagggccctgatgccacattcagtggagaggctgagatgatgggtcctgggtcttaaacctggctgatgtagcaaacccagggaggggttgggcctgggagagggtcccttaggcctgctgccaagcaggttggtgtctccctggcagtgccagcagcagctctggtggcctcctgcacactcctcctcaggcgcttagtgggaggagatggctgggggaggtgaggtgtcagagctctttcctgtctgtcaggggcaggaagacctgaagtgtggacagaaccaccctatgtggctcttgtggacatcacggagtagaagctaaaaggaggtagatgtttacaaggcagctttcaaataaaacacctgaaacagtgtgagggagaccttttgagggtgtgagttccccatctgcaaaggtaatcaagcagaggcagttgagatggacgttcttttttgtttgtttgtttgtttctcttttgagacagggtctcattctgtcacccaggctggagtgcagtggtgcagtctcggctcactgcaacctccccttctgggttcaatggattcttgttccccagcctcccgagtagctgcgattgcaggtgcgcaccaccacacccggctaatttgtgtatttttagtagagacgggatttcgccatgttggccaggctggtcttgagctcctggtctcaagtgatccacctgttttggcctctcaaagtgctgggattaaaggtgtgagccaccgcgcctggctgaaatggacattcctataataggtgggaggtttgttcaggggcctcttgggagacatctaggtctgagattctggaaggcaggttatgggacccatcagcagggagaacaacatctcctttcatgtggctttttaaaaatgtcacctcctccaagaagccttccctgaccactcaattttgagccctcatgcagtcactttagatctcagccgcatgctattttaatgtccccatcatcctgttcctagttgaccttcactctcccatgctagactgtaagctccctgagggtggggactttgtctgtttcttttgtgatatcctcagtccgcagagcctggcttccgtgttgaactaattcaccaatgtctccaccatcctatggtgtgtggagcacacttgttggttttcgacttcaggagtcaatctggcagcaaagcatgaaagtcaaagttgtggttggggctgggaatttaatcttccaatgccttgagcgtgacatcctcagcttctgtggaagggaggtgagagcctgtgtaaagttttcagaagaaaaagtaatccctggtctaaatagtttacctgaagcagcacagggaaccacaggaaggaccaaaggtaatcacaggactctggaatactggatcggaagagggaggtgggacgcaaagcgagtggccagatcctcacctttcagagcagggagtctttggatattgtctagcattgagacctgaagacatgaaagtgcacattcaaagcatattgcttaggcatatgacagttgccagcagaagagctcaaaactggaaaagatgggaaaatattacctctagaaaatcagctgaggcgtgggagaggtgataggaaggtgggtgttttctatcaaaaattattttaggttttcaaaagcactttatttatatttatattattaaatttttaaaaaaataagaaaggaaccccctgtgtgggagggacatggggcagctgtgacggatttcctagggagacagtgagtgctgccatctcagaccaagtccccagaaatgggcccgttcgtactgtagctgccgtgtgacagcaggcagttctgagcccactggcttctctttcaatgttgttcttgtgtttttttttttttttaaaacaatcaaaatgccagtgcgaatgacgcaaggtgtgtcctttttcctggctggctccaggccagccagacactaaaaaggtaacccagctgtcttttccagccagagtggtcggtgaaggaggacaggacagggaggccggcagagggaggctcggatgtgtagagacagcacgtgtgactcgcagcctgccccgttggtgaggctggtcgagacttgccctttgagtcatggggtcacttctccaaagcctgctctcctgggaccctccacaggcagcatcttgtcctctctgctgttgatgggggctgtcctgcagaagggatgctcacaggagctgcctccggtccctggcttagaggcctgggtttaacaggctcccttctttaccctacaggtgcatcaagagcctctctctgtccagcgctgcactgtgtgctgggcccctaaagggggctgagaaaggtggggagatgggtggagaaggtcagatatagagatgagaattgcccgcatggccaaggctagactgagtgtgttgacaactcctgtccccctctgcccccatccccagggtgctggggtagtatttcctaaggtggaatccttgggatcccagatgtatccgtgctccatgaaggaggatgaagaaggacaggcacattagcattctgaagactgcaggaaggcctgaaatgaagaaacctatttaactcagttcgtttgtgctttgtttctttgtttgaaacataccacatatgtgttaagctttcctccctcttttgggtggttttgcctaccaggggacattcggcaatgtctggagatatttttgactgccagcaccggggggaggggctacaggcatttagtgggtagaggccagggctgctgctgaacatcccacaatgcacaggcaagtcttcacaacaaagaatcacctggccctaaatgtttactagtgccgaggtggggaagctcagttctagagtgacccagagcctcagttcagcgctgctcaagggttcccagaccatggcccattgaagcaagaagcagcagctccctacgtcagcatgaagagtcctgtgtcattgattctgagacatacattttcccctgacatattaatatcttggaagtcagatgcatcttacaatcaatagtatatactagtttattagagacatggtcttgctctgttactcaggctggaatacagtgtcatgatcatagctcactgcagcctcctcctccagggctcaagcagtcctcctgcctcagcctctcaagtagctggaactacaggcgtgtgccaccacaccccgctaattttcttattttattttcttcttcttattattatttttttctgtagaaacagtgttttgccatattgctcagactggttttgaactcctggtctcaagtgatcctcccaaaattacccaaattacagacatgagccactgctggcctcaatcactggcatcctagatttgtgaaattacaaatgttaaactggggccttgggcatgtttctccttgccaggcctcattttccccattcataaacttgagggcctggagagagataaaacgaggccctgcccatccatgcatgcttttggattattttgtttgtttgaggtggggtcttgctctgttgcccaggctggagtgcagtggtgtgatcatggctcactgcagccttgacctcctgggctcgagggattctctcacctcagcctcccgattaattgggactataggcacatgccaccttgcccagctaatttttaaagaatttttcatagagacaagatcccactatattgcccaggctggtttcaaactcagaatccagtgatcctccagcctcagcctcccaaagtgctggggttacaggcatgagccgccatgcccagccagctttacttttgtgttgtagctttgttaacttctagagagagtttgaagggccacccacagagctggttcattcttattagtgcaggtttgttggatactggtaagcagaggcagccaggttgccaactgggaagagagttctagaaacatgcctagagtcctcccccaaccccccccttccccacccccgcacaaactagactccagtctttgaatgttgggtgctacttaggatcagacctgggctggggactttgcctgcattccatcctttaatatcaccagagttatggaagctgtgtttattcagtagctttactagaggtgtttaatgccaggctttctgggtgagacccgcatgagtaagaaataaactttaaaccaaaacagaacacctaagacgccattcagtaactgctgcaaatattgaaagtcctctttgggctgggcttaacgtgcagtgtggaaatactgatttgtagagagaaatagtaacaggcaaagagaaagaaaatgagtgaaaagggagatgctgggagtttcatgtatgagtcattgggtagaatgaagacagtacagggcagtgttgtccagtagaaccctctgtgacagtataagcattctttctctgtgccttccaatatggtagccactagccatgtgtggctcttgagtacttgaatggggctggtatgtccaaggagctgaatttttcattaatttaataccttgttaaaatttggggaacaatttttaatttacagaaaagctataaagacagtaacttcctgtgccttctgtactcagttctcccggttgacatcttacataaccacggtacatttgtcaaaaccatgaaattgacatcgtgcattacgagtaactgaatgttagactttattcagatgtcatgagtttttccattcatgtcctttttctgttcttggatccagtcctggaaatcatattgcatttagattttatttaaatttgatttgtttaaattcaaataggcatctgtggcttttgtgtcaacagtgcaaatgtggaaagtgaatacctttctgagcctctgggcctgggatatgcattgaacttacgtgtttttcttaaggataaaagaaatctattattttttgaggttgtcctggtgggcggttgtgggagtgtttcaggaaacatgggttcaggatctggctttgctcagccttggggcttcagcccactgagggatcatccttaggcctccagtagcctcagggaacctagattaaaggggagagagtgaatgcctttgcagaggctgaagggcaaggaggaccttcctttgagcctgaggagccggccagggatatggttagggaggcagctgtgcttcctctgagcaggggctctctggggagggggctcctgaacccagagcctcaccctcgcccacaccttcttctccagatcaggaagcctgggacagctctcctctcccctgcaggagcaaaggaagaccctcgcttcttgcggaattagccagtctcaggttcaaagcagcttccccagcactctgacttagacctcacccctgactccagggaaggccctgacaccttctgctggaagaagtgcatgttcccctagaaccagtgttcttgctggctgaggctcctgggaccttacaaaggcctgtttaacctctgatgtcctggaaagcagccacaggtgtttcactgttcacaaccatgtgggaaaatcttttatcagtctgtctttgggaacgcagttcacatcttagacaactaggagagacagtgaggaccaggtggccagagagaaatttctggaacagaaaggtatttatgtaaaactgctcccctaaatgggccatggtggacagtggatcctcctgagaaggtgagcatggtgaccaaggaacctgcgaggccttccaggatgtggtgggaggaaggaggctgtaattgtgccctatgtcatcagaccggatgagcacggaactgccccacttcaaaccttgcattctgtggccatgactgtgtgtcccaaagtggatttcacggtagccctgctgtatttccctcaacgggttctgcgtctgtgtgcgcggaaggatgctgcatgctgttgccttgtttgagatttcaagcgcatgtcagcatattctaaaaggcctactgtaaataaactcaatctgaataatggggtgtttgtcctaaattctttggaccgtaacactgaccctttactatcactgcataacacttacaatacacatctggcagaattgctatcctgtttaacacacctggggaaacattaggctgtactatgtttaatatgtgatagatgaggaaggagaacgggtggaaggaaggaaaaaggggggggtgagaaagaaggagggaaggaggatgggtagaaggaagggaggaaggaaaaagaagcccgaagggaagggagggagggaagaagagaggggaagaggaaaagagggaagcgaggatttcaagaaccagggcttcagcactccggggttcctcaactttgttttttttggtttgttttggagacagtttcgcacttgttgcccaggctggagtgcaatgccaggatcttggctcactgcagcctccacctcccgggttcaagcaattctcctgccacagcctcccaagcagctgggattacaggcgtgcgccaccatccctggctaattttttgtattttagtagagatggggtttcaccatgttaggcaggctggtcacgagctcctgacctcaagtgatccgccctcctcagcctcccaaagtgctgggatttcaggcgtgagccaccgctcccagtcaccaggtttcctaactttgaggagtgaaattactatgtttattccagagagaggagaaattaggccagacctacaggaggtataataagagagtgttcatggctgattttcttatgttcttttgggttcctcagggaacaggaacctggagagtagggctctgaggatgcgactttttccctcagggatcggtactgagatatggaagccgagctgcgggtgggggtgagccctgggtggcggagctgctggcgcttctttgttgcttggcctttctcgataacttttcatattcgcctttcttttctgtttctgttgacttctccctacccagacctccctcctcttttctacccaaatatctgtcccctcctctcattagacacctcctaagccctctcaagttgcttaactgcctataagggaaatgaagtgtgtgggtgcctgtgtgtattatttatatttgaagctgctaaggttactaactagatagagcttttagttccctttttaaaaatcttaaaaacagatgagtgtgacatttgctttttttttttccttgtatctccagactgaattatgttccctttatgagcgatccttgaccaatttcatttttcttcccccagaggctggaggccccagaagcacccacttctcgcctcatttgttttgtggctgaccctgggtgagccgggagcccccaggacagggaatagcaatgaggaatgccgtgggtgagggttgccaggatcttgtgggctataactgtctagatctccactgagacgtattctgaatgtgcccgggagacttcaagtgataacgcagccagacagggtgtccgaggagagctgctacgtggggagaaagggtcgaatggaaaactgtgttttctttcctcgtaattgttttgacatgagcagtaattagccatcagctgacagaccagaactgaagtgagaacaagggattggattaggggcaaaatgtctcctctttagacagttcctggcggctgcaagtgtggggaaagactggggcagaggagaggcaggacctgggcatgcatttggagggtctggggagggagggagtcagggtctcctcaggagctgggacaaccttggttcatggggactcagcattatcaaagatagagatttattacctactcagataaaaacttgtgcatttcattttcgaaagcagactaaacatggttcccttgtgtattgtttgattttaagaccagggtcatgttgactttgtaaaatagacctggaagcctgccacatgtttctatgcatggatgtgtctttctggagtgtgtgaatgaatttgcccatcaaaccatctgggtgcagtgccttttgcggggaggtcatttttcaaaggtttgacttctttttggcatctcttgaaacccttttgataatttgaatctcatggaaggtctggtgttgaagatacagaattataagtcatatgttcttgcatttaaaaagtttctactataagtacagcacggtggctcatgccggtaatcccagcactttgggaggctgaggctggcggatcacttgaggtcaggagtttgagaccagcctggtcaacatagtgaaaccccgtctccactaaaaatacacaaattagccgggcatggtggcgggcgcctgtaatcccagctactcgggaggctgaggcaggagaatcacttgaacccgggaggcggaggtcgcagtgagccgagatcgcccactgcactccagcctgggtgatgaagcaagactccgtctcaaaaaaaaaaaaaaaagtttctactatatttgttgtgccattgttttctttctaatccctaattctgagcatttgtgttctctttccctctcaaattaccctggcttatctgctgtttttattgttgtgatgcacacacacagaaccagccatggtttgctaatggtctcccgtttcctgactcgttaatttctgttaccacttttctattccgttctcctgttttcttttggcgtatgttattggcctttaaaattttttccccagatcttaagttgaatgtttagtccatttatttttgttcctttgggtttggtaatgaaataattaaggctgtggattttcctccaggtatacttcagactttatcccatttgttttgatatattcttctttattattttctaaatattgtgtaattacagttttaaattcctttttgatctggcattatttaagagggcagtttcttacatttctaagtgtttaggagttggggggatggggatcttgtatatttattctttcattattaatatctacttttattgctttcctggtcaaagaatgtggcctgtgttttttataccttttgccatttattgatagtttatttgtggcttaaatgtgaccaagtttttacattgttccagggcttcctggcagaagatgttatctttgtttgtaggatatgatgtttactacatctatttcaatcagccttttaaattaaattattcgggtcttctttatcctccttgtttttgtctgttaatcagtcctaaactgaaagcagtgtcctgaggttttcttctgttgtctttaggtttttcagcatctgtgttttattcagatagttctatgctatttgataaaatttctccactctcatgccctcgttgtagggtgtatttatcatcaggctcatgtctttcctggcatagcttgatgccaggcggagtggattctccctggccccctcagcattttccctgatgctgttggaatcctgtcctcgcctcttaagctgccttcatagcgggtggatggtatctgcacttggccagctgcctgagggatgtgggtgtggcccaggcttgtagctggccctgcagggtggatttgttgtttcttgttgcttccctcaagcttctactgtactaggggcctgctgtggatcagcttgctatttccttgggatgtgtgcaaccaccttattctggaacggggggtaaaccctgtagctgggggagaagcccagctgcgcacaggcactcagctgcatgtggccctgcttggccctggagtgttcactgcaagtggtggagaacggggcaccacctgagcaggagacgggttctccgtggaacgggcttcatcatcccattgcccaacgcttgcctccagtcctcgtcgctccaaatgagtaggtgttggtggtaactttcagccatattctcctgtgcttcctgccacgctatagagttttctctagaagaatcatgagttggacatcagtgtgtagatcttcctccagtctgacctgcattgtatatatttattggcaattacttgaagcctgggtcacgggatggcgcatcgtcctggtctcctgagatcacgcaggcttgtggttcctggggactcaattcaggaacaaaagcaaagaccttccccttctggatgcctctgctcccccacttttttgatacagggtgtcacactctgaagtgtgggctggagtgtagtggtacaatcacagttcactgcagcctccacctgccaggctcaagctatcctcccacctcagcctcccgagttactagaactacagacatgagccaccacacccagctaatttaaaaatatatatattttgtagagatgaggtctcacggtgttgtccgggctgatcttaaactcctaggctcaagcagtcctccctctgcctcccaaagtgctgggataacaggcatgagccactgccccctggccattcctccctttttaattttttttaaattttttctatttttaaaaatagagatggggtctcactatgttgcccaggctggtctggaactcctggactcaagcgatcctcccacctccacctcacgaagtactgggattataggcgtgagctaccgcaccctgcctttcatccttcccttttttaaatgaagtgctttatgactacttataacttttgctattatcgctttgttggattctcacaccaacaaagtaggtcaggagaatacgtagaattatccccattttacaggtacagaagctgagggtcactgaggcgaagctgctcgtctaagcttatgtagttatattcctacaagagcggtaccacctgggaaccgagatcacgtgggtcccagtgtgaattcgtgatgtcaggagcgtgcgtgtagcggcgttggggcttgaaactgtccatgctgggagtgtctttggcacagaaatcgacagatactacatatcagggctccccctgttccttggagagcaggtttatcagcaagtgttgggagcatgagtgagtgtcccccaagagacataaagttataagggtagaattttagagcctcagataatgtgttttttttgttttgttttgttttgttttttgatggagttttgctcttgttgcccaggctggagtgcagtggtgcaatctcagctcactgcaacctctgcctcctgggttcaagcgattctcctgcctcagcctcccgagtagctgggattacaggtgcctgccaccacgcctggctaatttttttgtatttttagtagagacagggtttcaccatgttggctaggctggtctcaaactcctgacctcacatgatccgcccacctcggcctcacaaagttctgggattacagacatgagccccagctccaagccagattatgtatttttaattctaggagaacggtgactcaagaatgaagtgcatatgatcacctgactattaattgacagagcctaatttcacggtgaccagtcaatccagtcctctttctagtatattcacactccgctgctctgagtttgagggtggagaagttactaagaaagctgagggaaattgttggaaggtggtggagagccccccgccccgactctacggagggagattggacccgtgactggcatttgtaactacaactgatgtggtatttgtagcaaaggcagctggaccatagtgacctcccctcctgttaggcacattccttttgctctcgggttaaaaaagaaactcagtcccctaagaattcagtaatttgggtgctgaggattagagagatgccttcaacccatttccagctctgcagatacagataagatcagatcctgagggatggtcttcgccacgcaagacctctcagagccaaggaaggaggtgggaaaaggggctgcagtggacgaaaggcgggggtgcccatctgtggcccacacagcatctgagccgtgtctctgtccctgcagtgaatggataccacgcatcagggaccccagcgcaccctccagagactgcccacatgagtgtccgaaaatccaccggtgattcccaggtaaggggtcctgttgagggaggtatagcggtcactgcttctgcaggcctaggaaactgcattacaaagtccatcatgggagtccaggtggctgcagcccagttctgcccccaggtagaaagtggttgctgtgtctgggttgtttcagtgttccctgatggggagagggttggatgattgtggtctgttggttttctagaagtcgagggtggtttggaggaggggctgacggtgatggggttgaaaccattaggacagagagttccattctctggtctggattcctgatacctgaagcctgtgtttctcaccactttaagagtatggatgtgccagacaattttccttttctctaccctacccctcccacggacagattacccagaatggaatttagtaaaatttgatcatctcatttgataaagtagcatagagagagctatgagatggaaggaaatgggagtatgttgtacgatttccaaactgttttctcagtctccatcctacttgatgtttatgcaaacatgtgagttaggcgtcagtaacaactcaaggtatgcatgaggtcaccgaggctccaactggttttgtgacctgtgcaggctcacaggattactcagtggttagactggaccttgatgtcagtgcttacggcttttctagttgcgtgaagctgtgcctaaaaaactgaggactagccttatttagtctacccataaattatcaagaagatgttcttaatgaagcttccaaactccagcagccttttccaggaattaaaatgccagaatcctggaggtgataatgaaaatgatgacaataatgatcattgatgatgatcatgatgataatattgatgatgttgatgatgacagtagctgcatgtgcagtggattctatgtaccagtcactggaagaaggaaatctatacttaacataaggaaaaaatgactggaagaaaaataaaccggaggattgattatggttctgtctgcatctgagaccgtggttcttaatcaagggacatttggcaacatctggagacccattggctgttagtataatcagctgaaatgtgacactcagctttatcatggacaagagtgttaatttgggggaacgttattaagtcgttctgttaggatgctgagtgttgggcttcgattcagttcagttaactctggaaaagaatttgaacctcagtgtatgtcaggacttcttatgttttgatggacttagagtgagctgggcctcttgttaaaatgcagattctaatccaggagatctagggtgggggctgaggttctgggtttccagccagctccgaggtgacgctgatgctgtaggtctgaggaccactcctgagcagtggactagcagtcagtagcacacagctggcctatcggtctccttctctcgtctgctcatgtcacccatcatgaatcaaccctggctttgtatgtttcctgctgagctcccagcttgccttctcaacacagattctgttatcctgtttgaagtgaaacttacttttgtctcctgatttgagactgttttggaagacatcagcctaaattctgatgtggttcagcaacgatgacagaaatctggtgttaccctgggcatcatcaggaagaatatgagaaacagctccccatcctcaaaatcattctttcttccctgataaaacataatcccttctgaaatactgtgaagttgttactcatctattttaaagaatggacactggtataactgatatctcagaagctgatttaacactgtgcattataagccatcgacacagggatgtcttgtctagtgtctgttcttggggtatcttgaggggttctgatttatgtgcaaggctattcactcacacattatttacagcaccataacactagacccagcctaactgtcctgcaacaggggatgggtaaaagggatgatggcgctggaggttagccagtgatactatgcagccattagcaagcatgcttctgaagaaaatgcaataatttgggaaagtactcacaacataaaatagagtaaaaaaaaagtaggacacacattgcatatatagtcagtcttatttggcagaaggaaatctatacttatctatacttaggaagaaggactagaaggaaaactggaaaacgtacggtggctctgtctgcgtctgagatcatggctatcaattgggacttttgacaatgtctggagacgtttggattgtcacgcctggggagggggggtgctactggcaactagtaggtgacaccagggatgacgctgagtatctcgcaaggcatgggacaccacagcaaagaagtgctcaacttgaaaacatgaatcgtgctgaagttgagaacctttggtctaagatcatgggtcattttattttctttacacttgttgttatttttcaaatttcctaaaatgaacacattttacttttatagaaggcagatacaattttttacttaaaaaaaaaaaaaagctacaaagtaggtaccagtatggggaattcaggagaggcgagctctggagatgcaggcccgggtagatagtggctgcctaaagacaggcggattgagtcagactctttttggatggtaaccttgggagctgaggtgtcatcagggtaacaaaaataaatcatgtagtatatggagagggcgaacgtgcgttgttcaccagtcccaggatcaggaggtagaatgttattcttttaggctttgaaagggtaacatttggatataaaagctactacttttttaagttaaaaataattaggaaacagggtgtccctgtgttgcccttgctggaatgcactggctgttcacggaggtgatcgtagatcactgtgacctcagcttggaactgctgggctcaaacaatcctcccgcctcagcctctggagtagctgggactgcaggcgccggccaccacgcccagctagctactactttttgtcctggtttgtgagcctgcaggctggttatccaaaaaggtgccaagagttaaacatacaaataggttaagaaggtttggtgtttacagagagctctaccaacaaagggtccccaggtatagaccccactccagcatgcagacgagtagattcaccatccctgctgtcagttaccactcatgataactacacttaaacatcaataaatgaataaatgagcaaaggaacacttgagatgcggcatgtggggtggataaagtggcatgttcagggttacagtgacgaaacctagactggaaagccccagatctcaaaacccggttgtgatctctttccgccccctgcttagctgcccctccttgagcaagctgatcaggaagattagaattttggggggagggggcggtcgtggtggctcaagcctgtaatcccagcactttgggaggccgaggcaggcagatcaggaggtcaggagatcgagaccatcctggctaacactgtgagaccctgtctctactaaaaatacaaaaaattagccgggcgtggtggcgggcacctgtagtcccagctactcgggaggctgaggcaggagaatggcatgaaccagggaggcggagcttgcagtgagccgagattgcaccactgcactccagcctgggcgacagagcgagactccatctccaaaaaaaaaaaaaaaaaagaattttggggggtgggtgtcgggggatggggaaagggactttccacggacaccagtaacgtgtccccaccatactatgtcatggggaggactgatagtgggtgccccacagttcctgagggtgcctgccccgctccttcactcagcccttggagacctggatgggtgggcacaggaggtggtgatctggtgccacccagtggagggtttcaattctgcagccctggggcagtcggcccaggtactgggtaaatgcagcccacctgattcgggggcagaggcgagggatcaaaggcgaatcatctttttttattttttattttactttaagttctgggatacatgtggagaacgtgcaggtttgttacataggtacacatgtgccatggtggtttgttgcacctatcaacctgtcatctagattttaagccctgcgtgcagtaggtatttgtcctaatgctctccctcctcttatcccccacgccccgataggtcctggtgtgtgatgttcccccaccggtgtccatatggtcccattgttcatctcccacttatgagtgagaacatgcggtgtttagttttctgttcctgtgtttgctgagaatgatggcctccagcttcatccatgtccctacaaaggacatgaactcattcttttttatggctgcatactattccattatgtatatatgccacattttctttatctagtctatcattgatgggcatttgggttggttccaagtctttgctgttgtaaatagtgtagcaataaacacgtgtgcatgtgtctttatagtagaatgacttatattcctttgggtatactcagtaataggattgctgggtcaaatggtatttccggttctagatcaaaggctaatagtcttgctgcctttgcagaatcgcgtcctagtgggtcccttcccttcctgcccaccagtgcctgggcctttttgtgatccacctttcaattgttctggcttctcacgaacttcccaggaagaccctctagacacaggagagaggaaagagaatgggacgaagggcttggaaacttgagggacccattggagcatggagttcaaagtggagaaagaggtgagatgtttaatctccaccacctcctacctacctcaataattcaataacacatgttcttattgagcaatttcggtctttgtcaggcactgagacacaggtgatatctatagccctgcgttgatggagttttatggctggtgtgggagaaacagtagataaataatggtgcaatttcagcagtgacaaaggctggaggaagtggatgctgtgagaacctagcctggtgctggaaatgtcaggaattaaggtaccttaagaaaagatacctattctaagactggaatgatgagcaagggtttcacttggcaaagaggtggggaaagaatagctttccaggggagggaatagcatcgtggatgcctggaggcagcaagggggaaccgtgtttacgcatagagacccagtgtggctgtggcttactaaatcagcaggaatagggagggtgggaaatgaggctggggtagtctgcgcaggcctgccacgaggagctcaggggttatcctaactgcactgggaagccattgaggggttttgtacaggatcccacctgctgaagggatgggacccagattatttgcagggggggaggaaatgggctgagaagacatttggagtcgggggcctgctgaatcacttgtgaatgacccactccagtttaccaagcacttcctgtgtggtatcaccccctgccaggcctcagggtgatgcagagatgcccaggtggggtgtcctgacccctgggcaggcctttacaaaataaatggaagggaagagttctctggaatcacaggcaaaggaaatttaaaacaaatactcttattataggcatttgcaaacctttgcaaaagtagagggaatatataataaggtaccacaaatctgttaagcccaacgattacctgcctttgtccaatcttgttttatttgtgctcccatcccctcccccaatccccttgccctccaccccctagattattttaaaccacatttctgacttactgttttaaatgcaaatatttcagaatgtatcttccaggaagaagacataatgataataccattatcatatttaagaaaacattaattcaataatgccgcctaatatatacactccagattcctcaattgtctcaaaaaatgcctttttttaagaaagaaaaaagagagagatggggtcttgttctgtacctcaggctacagtacagtgacaccattatagctcgtgaattctagaactcctgggctcaagcgatccttccacctcaacctctcaaagcctagggttacaggtgtgcgccaccatacctggcccccaaatcccttttatggctgcttttctccccagtccaggatcccttcaggttcacacacagatacactggttgctgtgtctctgttgtttctctctctctctctcttcccccaccaaaaaactgctttattgagctgtaattcacatacccatacaattcacccatttaaagtgtatacaattcagtgttttttactatatttacaaagttttacaaccatcatcaaatctattttagaacattttcatcaacccaagcagaatcacctgaagacttaggcagcccctaatctttctgtctctatgggtttgcctcttctggacatttcatataaatggtatcatactatctgtggtcttttgtgtctggcctctttcacctggaattccaaggttcattcacatcgcggcatggatgaacactccattcctttttatgacagaagaatattctgtcgtatggatagaacgtttcatccaagttgttgcctgtctcgttgcctctacactcaatcccttacacctttttttctttttttttttttttcatcaccttgacgatttatttttgaggagtccaggtcaggtgtcttatagaataacctgcgttcttggtctgactgttctcttatgcgtaggttcaggttctggagtttgggcaagaatagctggacagggcatgtggggttctttttactgcatttgggggcacaaccacccaggttggcaccctactcatgaggctcagtttgcactctcggttaaggtgctgactgccagatttctcctttgcaggggtacattttccctttctaatttgtcagtcatctgtgaggtgccagtgtaagaccctgtgagtatcctgtgccctggcagtctttccatccactgctttcagcatccttgaggatcatggcctgagtcccctttgaggctggggtttgcaaatggtggtcatccaatttcttgtacattttttattggcattcttctgaaataaatgttctctcccttcccctttggagttagttagttagttgcagtcattcattcatatttgtgctcaaattgtcgcagatttggcctgtggtagccctttaagttgtttatgttcttttgttatctctccattattctctgaatactttcttacctcttggtacaataggatattccaaatacctgcctttgaaattagtaccaaggagcttccggtaatatttggaaaccaatttctagccagtagatgttgtcactgtgatgagatgtcattccttctgggccctttcaatggagaattatgatagtgtgtgtgtcacgtgtgtgtgtgtgtgtgtgtgtgtgtgtataaaatgcacgtgatatgtatatgaagttggagcagtaggcacaggttatcagcagcacaggcagagcctgagattgcctgtgatctaccttggccctcagtggttgaagtaaaacactgctaatagaacagagaccagggaaggtgctgacacctaacacgtggaacacccaacctcaatgccattacttgtattcctatcctagccaagttataaggaggaggtgcgacctctgcgtcaagccttattctacagagatttatacacagtggtcccaaaatatatgtttgtggttgatggaaatcttttttgccttcctgcaaagacacatggaaaacaaaatattgtctcaggtctcaaagtggagagatggcggaagatagaggaaagagttatgcaggcttggattctaatttccactcctctgtttactatagccttgtgaccctggacagttttacttctgcaagccccaatttcatgatctgcaaaatggagttgatgccatttaacttgctggggttgtaaggatgaaatgagattaaatatgtcagatggctaacctggagcctgccgtaataagcaagcactcagtagacagtcgctcttgcactgcttctccccttagccccctcatcaccaacatcatcagcatccataggcagactcgaaggctgttgccaaggctgctggagtgctggttcccctctctggggggctgcagtgggaacgcggtggtgatggtggtaatgtgtccatgacaggaagacagactcctgcagactgcagaatccatcccataggctactctttccccttcctgccatgtatttgcttggctagagtctgtacgtgaatgaacctatggagagagagacttctatccctgtctcttctccttggtgactggtacctcctgccatgtagcctccgtctgcctttctccctgtgcagttttgtcaagtgggaaggtatagggtgggccagctggatgagatgatgcactaaaaatgtctatggaagctgtagttggccataaagttgacgttggccaggagcccgttggggtcactagaggagttgccataagtagaggtacctcagtgaaaccacagtgtagatcagatccatgtatctctgagtgaggtccacagattctgcaaatcagaggtgctggcaccacctgggacctgctggatcaggcccagcagctgagagtgcagctgggactctattttggacactttttcctcagttgattctgatgcacctcaaagcttgaggaccagtgataaccatccatttgacagatggagaaattgaggctcaaagaagtcagattctctggccagggtctcaaggctagtaatcattttcttgtctgtgaaattaatgctctgtaaggttcatttttgctagacaccttaaggatatcagttttcctgagttgactttaattagcaacccaagtaagactgtatgggagtaagggtatgcgaccttagcaggggcatagtcaagctccctggtttgcctaatttgctgacgggtttctgaggcaaaggctcgccctcacctgcagatggtcatttggccaggtgtccagggtcgtgctggcctgaggggcggggtgccccccactccaagccggtggttccttcttgttgaagcccctccatcctttttctggcctttatctataaagtgacagccacttccttacattctaccaaggaagagtaaggccagactggccgcagtggctcatgcctataatcccagcactttgggaggccgagacaggtggatcgcctgaggtcaaaagttcgagaccagcctggccaacatggtgaaaccctgtctctactaaaaatacaaaaattagctgggcgtgctggcgggcacctgtaatcccagctactcaggaggctgaggcaggagaattgcttgaacctgggaggcagaggttgctgtgagccatgatcacgccactgcactccaacctgggtgacagaatgacactccatcttaaaaaaaaaaaaaaagaataaggtcatgcacaagtcctggggcacaagtgtgatggccacctgcggtgccttaggggtaagcctgcttcccaggttgctgtgtggctcaggataggagacatcccaggtcctgcttggggatctctggtattgagcccccaacataattgctaatagaacaacagagacccagaatcaaacattctttggagtcgtaggctcttaggacacgtgtagcattttgcactggcagtccttaattttctctgccagaacgatcccaggactttggcaaactgctgaggaccccaggctcagaggtacttgggactctggttttcttactggcggtggaagacatcaaaaggcaatataaagactgagtggaagctggaagtcggtttggctgagaaatccctcctggctcacggggttgggggagcggggagtcagggaggtgaccgagcagcgccccagtgcacattgtgtgtatttaggtttgacgttttggacccggggggtttcagaataaaatgtcgtgtgctgattcctcagtgccaggaggtggtggccttaactctcttctccccagtggattccgcggcttcaggcagcaagcggcacgcggaacgttcaccagcagagggcagcggaggggttaactccccaaatcacagactgagagaagaggaggggagacctggtttggagcagttctctcagagcctgtgcaggaggcttccttaattcgccttcagcccgagagctgggcgtgggaacagcgtggggtcagggagacccctgcttgccctggcccagaatatggtgacttaggattcagactgagcatccctgattccccagcgcctccaccctcagggaacctgaatggggggaaaaaatgtccaatatggagaacagctttgacgatgtttcttgcctctctccccagaacctgggatcctcatcgccaagcaaaaagcagagcaaggaaaacaccatcacagtaagtggctcccgaggggcgccctcagggtgggctgcgagctggggcatttggctgggctgttgccatggcgatgtggaccgccaagcagaagtgatgcccaacctggaaacggggaagttccaaagctcggatttcactcaagttccccatccacatgcccctcccacctccccttctcctgtcaatttcacatttcacttctctcctggtgaacaagtggaaggaggatggctgggatgatgcagaagccgttttttcagggcaggaggggaaggtatgcgtgcgggagtgggttgaagggggtggactgtgctcagcgcaagtgatgtgacgtgtaaattacagccacggcagggttgcttttgtgcggggtaacttctggaagatgtcaaagtaaaaagcaagagaaagcgtcctaagaatagagttcctaggagtccctgaggggagcaggcagcttctgcctagagtggccagcctgcctcccagggcgcttcgagatgcccaaccccatgtggagatgagggggagcccaccccacccacccccatgcagagatgaaggggagccccacactccacctctgctcctcagccctgtgtttggggcagctggggctggacatcattgccccctgaggggcacaggcctgagaagtgtggtcgcaggtttgctattttggcacaagggcaggagagcagggaacggggtattgctctcttaggctccaactcacacagctctgagccattccgaccacccctgtggagacaaaaccaagagtgggtgcatttccctgcttcgtccaggctgcacatcctgctttgggagaaaaagtgtaggtaaacaattaacaataacaattgctgcaacttttgtgtgcacttattatgcacatgtagtgatccaagtggctcatttaattgtccattagctatatgaagtgtcagtcgtggaatcaatatagtataacgatgatgaacgtggactctgaggccagagtgtcggttatattaatgacagtgcaacagcctggggcaagtttcttgacttcttcccgtctcagtcaataactgtcaagtggggaaatggggggtagtgggtggtctctgccttagggatggtgtagggactaaatgggtccatccatggaaagcacttagaacagagcctgcatatagtaagtgctctgtgcacactcatcaccctgtttacagatgaggaaactgaggcacagagccgcaccttgctcacggtcacccagctgggaagtatcaggatttgaaatctatgtccttaccacagtgccccttctggagctggcttgggttccttgtgtcatgagctcctttggagtgccctgtgctgatggacggtgtctccaagggctgggcagaacgactcagcctgcttggactgtggggtagcagcagcctccctgttaccggtggagttgatggagctggtgggtagggggtgtgggcaggctcaggtgcagagttccagagggtacagtccccatcttcaaattgtcacaaaatgccccagaatgctggggcacagcaggagctctccagagtcttctgaaatacataaaaaggagggggaggagaaagggggggaggtcggagtgggagacatatttgaattctagaagaaaaacaaaaatgcaaagtgaaaagcagagtgttatgtcgtggagggttgccttaaaggcgcttagtgatggtgcccaggccacagggtggggcacctgctggagtccatcttacagccagggcttcgggtgtggccggagggggctgatggcggcccttgttgggcccctgatgggcagcacacctcgcccatccctgccttccctgtcgcttcctgctgagccatatcattgcttctcatgagggagtctgcaaattgtattctcaagcctccaagaccttttttaaaatgcagattcctggatggcaccccagaccttcagttgttttctctggggccagactggaaaatctgcatttgagccagtgttccccagaggttttaagtaaacactcatgccttggagaatttttttgccagagaaactgagcaaaggagcgactggccagaggtcacaaaacaagtgaggagcagagcccaggacttgaacccaggtctcctggctgccggcccaggacacttcccggtgtaccacctggccttggcccacaggtctccaggccttggtgccttttcccttccacacaacaccgctctcccatgcccagcctcttcctctgggttctgatcctccagagttcatggtttcccaagaaggagatgctcagggggaaagggatggctcaggtctcaggaggctggggcgtgaacttccttttctgtggtgtgtagggatgaggtgagccgcttcccgtgccgtctgatcccgcagagcagaaatttccaggcctgggcagcaaagggtggtggatccagagaaagaatggagctggattctgacgctcctttttccccaggctatgggttttcaggggacagacacatgggccccctgacagcaacgggcaggggctggcagccttgctgggtcttgtttccgctgtccctggtgtggggctggcaggtggagtgtgctgtttgattgggagtgacgggtgctcatggcagctcacagcccttggcaggagcatgaacgcgtctgaatctagagggtttcagaaaagatgacagcaaagccacccggccacactctcacctggaaagaggaatttggggacacctgtggtcctcagcttcagggcttcccagcgtagccacagaacccggggtaggggctggaggtgaacccttggggtcctgtctactcttcttctctgttccacagagctccggggctggcttgttcctctcccataccctcccagatcagctttcctctgggagaaaattcagagcctgttggacttgaaccctcagttgtcaaaccattttcccttctctgctgcaggcaaggtggtcaaacaggccgtgcaagaagcctgtggcctctgttccccacaggctcctgctgggccaggacttaggggaggggcatgccttggggcctccgtatgtcagcccccttggtcacacgtgtgttcagtggctctcacacctcagccaggtggttttctggctgctgtgtcccactgcgtacccctcagagagcttctgggaggcagcccatgtgcttctggctgctcctgtgcggaaaagccctgcaggaaccccagctgcacagtggaccccagcagctggggagggatgggggtgtcactccatttacctgagggttggagaaaacagagttggtgcaagagcgaagacgcggctttgttgaggacactggtctcgggggaagtgagggtgggactgcctgctggaacttgccctgagcagtacacacggggaggcgtgcccctctctggctccctcttgagcacccttcctttttgagcccctgcctttggtggggacctggcacatttatacctcagtgtgttggaaaggtagtgtgacagaggctaagagcctagactgaagccggcttgcgtgggttcagagcctgggtccacctattccatgcacaaactgtgtgatcttgcataagtgacttagcctctctgtgcctcagtttccttatctgtaaaatggggataataatagcacctgccttgcagggctgttgtgaggattcaatgagctaatacgtgtaaaacgctgagaactgtggctggcacattatttgcttttgttgaacaaacagaaagtggatctttaggatggcagtgaagctcctgctatgcctgggaggccttgggaggaggatgaggtctttccagaggtgtagctggaccctggtattaaccatcaggaaaatgtaaccggggggaggacaggaatccacatgcggaaagtcctgtcccaccttctcttccctccttgggctttggagcaccgcagggtggagctgtgtggccctctcagcccttctgatccagggacctaggagccttgactttgaggtctggatgtcacagaaggacacagcaaggataaaagtggtggcccaggaattaggaagctggttctggaccctgctctgccacttatagtgaactagaattaaacattctgtgtctcagtttcctcatctgtgcatgaggttgcactagaccattgcaaataaacatcgaggctccagttgcttccaggacatctgcgcgcacacacctctcaccatgcccctctgctgccactgcctccctctctccgaagggactgttcttccatcttccatcccaatggatggaaacatgcttcctctccacccaggtcagtcaactcagggtttctcagcctcagcaccattgatcttttgggttggatagcactttgttgtggggagctgtcccgtgcattgtagatatgtatcaccttccctggcccctaccaaccagaggctaatagcatccaccctcgaccccacacagctgtgacaaccaaaaatgtctccacgttgctagatgtttctggggtgggggaaaaattgtccctggatgggcatcactgaattgacttcatggtgctgtcaagggctacctgtagagtatcccaggcttcttctaatcccctcttgactatgctgctcccagctgctatcatgaccccccaccccccatcccccatcactgcagactgccctgatggccacagtcacgttctccctccagtgcatcctctatgctgtagtgggggtgctcaccccagacaacagcctgattaattgttactctcctgcagggtgcttctgtggcccccgctgtcctgctgccttcaggacagaccttggcacccctgcaagaccccctctcagctcagtcttgtctactccctgactcaggagcagccagaagcacaagggctgcctcccagaagctctctgaggggtacgcagtgggacacagctcagccaaaccgagcaacgcggtccccacctgtagggcatatcctctcatcctgagtcctttcccttcctgcagtacccttctcaccttcccacccctctgtctgcctgggccctactattattacctaaatctaagattcctcccctggaccctcagtccttccagtaacctcagcacctcaggcttactccactggcaggtttatcccaaagaattacagtgacttatttacggaactgttgagagcagagatgatgccttacattcctagcctccggccactgcaccaagaaacatctcctgagcacccactatgtacccaacactgcaccagtcaggagggaaatggcagggaaaagatggtccccatccccttgtagaacaggctgtctggcaaggaggagaaacattaaataaaccatcacgagaaatatcattacaaatgtatgcatgcagcttgctgggaagagctagcgtagcacgtggcactgagcagcctttcaacagatgttcgaatggaaagtgaacgagcaaatagcccatcacatagcttcgtggtcgaggctggagctctgcagtcagctggatctggattcggatacctcgcttctgtgatcctcagtttcctcatatacgatgaggctgttcttcctcccctgtggagttgctgggaagatgaaatgagaatacatgcaaagccctaaagagggtgcctgagtcagggctcccctgcaggagtgaggatttggagaaatcccagtgggcttcctgggagggagaaatcccaaaatgagagaggacagagacagtggcaggcacctcggggctccatctgaggactggtatcctcaaggagtggcagaagcagcagggtgatgagtccttaatgagtcctcacattctactgcctttactcttctgccccaacctgttttctgttcctgcattcgtttgctaaggataatggcttccagctccatccatgtccctgcaaaggacatgatcttattctttgttacagctgcatagtatttcatgttgtatatgtaccacgtttcctttatctagtatatcgttgatgggcatttaagttgattccatgtttttgctattgtgaatagtgctgcaatgaacatatgcgtccatgtgtctttatgtggaaagatttatattcctttgggtatatacccagtaatgggattgctgggtcgaatgatagttctgtttttagttctttgaggaatcaccacattgctttccacatggttgaactaatttatgctccctccaactgtgtataagtgttcccttttctctgcaaccttgccagcacctgttattttttgacctttttaattatagccattctgattggcatgccatgatatctcattgtggttttgatttgcctttctttaatgattagcggtgatgagcatttttgcatatgcttgttggctgcacatatgtcttcttttgaaaagtgtctgggccgggcgcggtgactcacgcctgtaatcccaacactttgggaggccaaggtgggtggatcacctgaaggtcaggagttcgagaccagcctgaccaacatggtgaaaccctgtctctactaaaaatacaaaaattagccgggcatggtggcaggcacctgtaatcccagctactcgcgaggctgaagcaggagaatcgcttgaacccgggaggtggaggttgcagtgagctgagatcatgccattgcactccaaccttggtgacaagagcaaaactttatctcaaaaaaaaaaagaaaaagtgtctgttcatgtcctttgcccacttgccatgtaggatcttaagagcagggctctgtggcttgtttatctgtgtgtcttccattgtggtgggcacaaggtctcccccaggggctgtccctgtccctgctaaatggatcacgaatgctggttctcaaagtgtggtccctggaccttcagcatcacttgagagctcagaccccatccagagctcctgaatcagacagtggggggtgggacccagcaacccatgtcctctaggtgactctgaggcatgttcatcctcgactctgggacaagaaggggactgagtggtacttaggtgggtctcagtcctcctcaggacttccatggccttttaggtggttggcttggagccagccaggatgcatcattgaaggggctgtccttggtaccgtctcctcttccggctagcagtctgtctgcacaggcctgctggggtgcacggtggcatcctcactctgagggtaagtcaactcaggaagattctggggggaacaagactggccaagacccatttctcctcctgcctgccccacgttttggccaagcctcttcctgacatgggaaagtcctttcttcttgttttttttttttttttttttttttttgagacagagttttgctcttgttgcccaggctggaatgatgcaatggcgcaatcttggctcaccgcaaccgccacctcccaggttcaagcgattctcctgcctcagccttcccaagtagctgggattataggcatgcgccaccaagcctggctaattttgtatttttagtagagatggggtttctccatgtgggtcaggctggtctccaactcccgacctcaggtgatccacccatctcggcctcccaaagtgctgggattacaggcatgagccaccgcacctggccaggaaagtcctttctttgtagggaagtgtttccccgacaagagggcaaggccaagagcagtttgagtgaggaaagacgatggaaaggggagagatgcccgcagggcaggccactccagaagcattcagacccgcctctgagtacccacaactctactcgttccatcattcttaatgctcaatttactttaatgtcatagttaatttatcattaaatttgattgaaattttcatggactgcattattcagtaacataaagatggactgtgatgactgtgatttgttgaaataagaataattggaatacaaaataaggaatctgtgcacttttgaaacccgtcccttgttttcatgattgcctgcttggcagtgggttgtggaggcacaggaaggaaggagacttgtctctggacacaccttggggactcggcccgaaaccaaggcttggggctttctgctgctggcctcaagaactggccctcccttctctcactgaggctgctgaggcctgggagaaaactccccagcctcagctgatcttcatctagcctttgtttttttaatccatcacagtgctaattttttagagttcaggaagctgtgcaccttttttttttttgagacacagtctcgccctgtcacccaggctggagtgcaatggcgcgatctcggctcactgcaacctccacctcccgggttcaaacaattctcctgcctcagcctctcgagtagctgggattacaggcgcccaccaccatgcccggctaatttttgtattttcagtagagacagggtttcactatgttggccaggctggtctccaacttctgaccttgtgatccgcacacctgggcctcccagattgctaggattacaggcgtgagccaccacacgctgccacaaggtgccttttaaaaaactatcttgattttccccacttatcattagattcagattaaatatttttgacaggatttttttttaacttaggctaaagtgcagtgatataatcatagctcactgcagcctcaacctcccaggctcaagagatcctcctgcttcagcctcccaagtagctgggactacaagtgtgtgccaccatacctggctagttttgttttttattttttgtagagacaaggttgtgctatgttgcccaggctggtcttgaactcctgagctcaagtgatctgcccgccttggcttcccaaagtcttgggattacagatgtgagccaccatgccctggccaggaatcttacatagataatgttgtattcttagaagttacacattttgaaaaggagaaagaggcccagcacagtggctcatgcctgtaatcccagcactttgggaggccgaggagggtggatcacttggggtcaggagtttgagaccagcctggccaacgtggtgaaatcctgtctctgctaaaaatacaaaaactagccaggtgtggtgacatgcacctgtaatcccagctacccgggagaggctgaggcaggagaatcacttgagccagtgaagcagaggttgcagtgagccgagatcgtgccactgcactccagcctggtgacagagcaagattctgtctaaaaaagaaagggagggagggagggagggcaggagggaaggagggaggggaagagggaaagagggagggaaggagggaggggaggagaggaggagaggaagggaggaggggaggaagggaaggagaaagagaagaagggattatccttggcagaatttggtgcagccctgtcatctccagggtcgtccacgtcattcctgcctctgatccttctgctgagttgtgtttccctctagggtggtggggacctcagccctcaccttaaccacatgtaaggatctgggaggaggaggctccttcttttgttggggacttctccccagactgcgactgaggtctgtgccctggcagctggggagggggtgtgcgctagatttacttctagccacccaggagcttcctgaaccagaggtcacaacgggaggtccatgggcctgactttgctgacagaagagtttgttgggcctacatggtgttattgtgtttattattattgtttttaaccttgaattaattgccaacacttaaaaatggagacactttgcataaaagtccccattttcagcttccctcgagtcatcacataatccgtcagcactggactcctcagaagggcttgacgacacttggcaagagctgagcaggatctgccccttggacgcatctctgcagcctctggcccctgcccaaagagctgagcaggatctgccccttggacgcatctctgcagcctctgacccctgcccaaagcagatgctgtccgccctcctatcccagctgcagtttctgtgacgctgtccgccctcctgtcccagctgcagtttctgtgacgcctgggtacctcactggcttgcacaccccgcctagcattggagtttgtgtcctgggcccaaaacctcagggctgcatcattttttaatgtgtgacattttccacttcagcaggtgcttgggctgcaagaaggggttaaagacttataaggctcaggccttgctcccacagaggaagcaaattagcccgcgtcctaggagaggtgggaatctggggcctgaagccacctccacacaatggggaaaagccaggcagtattgcagatgtgctcgggcagaaaaggctgagatgacctgaaaatttctgtacttcacgctccttagctagggccagccttacacgtgcaacccagatttttttttttttttgagggggagtctcactctgtcacccaggctggagtgcaatggcacaatctcggctcactgcaacctctgcttcttgggttgaagcgattctcctgcctcagcctcctgagtagctgggattacaggcacatgccaccacgcctggctaatttttgtgtttttagtagagaaggggtttcaccatattggtcaggctggtctcgaactcctgacctcatgatccacctgcctcggcctcccaaagtgctgggattacaggcgtgaactgccgtgcccggccccccagattataattttaaggtgtatttgttcgtatgatacacatcgtgacataaaatttgcaaggtaatctctcacccctgaccctcacccacacagttcctttccttggaagcaaacaatgttatcagtttccaggaatattctatatgcaaataaccagatgtgtattatacaggtgacccttgaacaacatgggagctaggggtgccccctcctcacccatagtccaaaattgacatataactttgaactccccagaacttaactactaatagcctcttgttgagtagaagccttactgacatgaacacatattttgcatgtttatgtgtattatacactgtattcttacagtaaagtaagctagagaaaataaaatgttaagacaattataaacaagaaaaatataattactattctttaagtggaagtgggtcatcctcaaggtcttcatcctcaacatcttcacattgaatgggcgaagcaggaggaggaagaggaggggctggtcttgtcttcctttttgaaaaggaactataatactctgcttgctttttttttttttttgtttttaaccttcacctaaccatatatcctggcacattttccttgttaaattttcttttttttttttttgagacatagtttcgttcgtacaatggcatgatctcagctcactgcaaggctggagagcaatggtgccatctcggctcactgcaacctctgcctcccgggtccaagtggttctcctccctcagcctcccgactagctgggattacacgcatgcgccactacgcccagctaattttgtatttttagtagagacggggtttctccctgttggtcaggctggtctcgaactctcaacctcaggtggtccgcctgcctcggcctcccaaagtgctgggattacaggcgtgagccaccgcgcccggccgctttcctaattaaatttaagaacttcatcaccatgtcctttctgatttccatagatgtctatctcatactttgtttaaccattcccccactgatggacattggagttgttttccagcctttaacggccataaatagcgctgtcgtgaaaaagcgtgtgtggatgtcactgcccccatgcaactgtatctgtatgatagactcttgtgcaattgctgggtcaaaggcacctgaagtttgcaattttgatcctagtaaactgccatctagagaggtggtactggttcacagcccatttggggtgggggtgagcacctgttgccgctcatgtgaaatgctggcccctggagcacgggaagatccctgtgcgtgttctgtcaatagggaggctgctccagtgccgtgtcccccaggagccgaagccttcctcgctattccagtctccagcggggtcattctttcttgttctgtgccctacagataaactgtgtgacgttccctcacccagacacgatgccggaacagcagctgctgaaaccaaccgagtggagctactgcgactacttctgggtaagcagcgcctcagtttcccccacagcgtgaccccggtgaccgggagtggacacccaggatgggtaggagggacctggatctcaaagtggaggggcctttctcgttggagcgtgaagggctggtgttagagtttgcatctgtgacaggaacttaggaccctcttggggtccagctcattccatgaatctcaggggttcagcaggacttttgttcacattacagacacttcaaccagaatgtaggtaagcggggggccattttctccgatgctcagtgaaggcaggagactagaatctgcctcaataaatgaacgtgggctccatacctgcttgtcacttacgtgagtgacgttggacaagtgcttcacctccttgggcctcagtgttctcatcagaattgtgaggcagttgggcacaggatcttcagagagctccagcttgggtaatcctgtagttttaaaacgtttgcagatcacttagcgaacacagagttttagttttgcaagattaaagacaattttgcaggtggatggtggtgatggtcgcacaaccatgtgaatgtacttcatgccactgaactgcattcttaaaaatggctaaaatggtccgttgtgtgctagatgtatttttttcaccattcaaataaataaatttgtagaaatgcagagtcctgtacctcagaatatcctgggaatggtcctgggccatttgcatgttaaagtcatagtgactttcagaattagatcacccctttctggaatcagatagtggggatggtcacaaaccctgtgaatgtattgaaaaccactaaattgtacatttcaaaaaaacaagtgtccaaagactccaaggaacaataaataagtaaaaactttgttttcaccactttgcaagaatggattttttgagacagagtctcactctgtctcacccaggctggagtgcagtggtgtgatcttggctcactccagcctccacctcccaggttcaagcgactctcctgtctcagcctcctgagcagctgggactacagatgtgtgccaccacacccaactaattttttgtattttattttatttttttaatagagacaggatttcatcatgttggccaggctggtctcaatctcctgacctcaggtgatccacccaccttggcctcccaaagtgctgggattacaggcatgagccatcgtgcccagccggattatctacacttttttagatttgctaaccgaatactagataaaagtgcttttctctttctacaaaatcgcttgtaccttagaagatatacaaagatccctgttgcctacacctctcaccaaggcacaatttctgtagctccagctgtgctgtgtccagggtagagatctgtgcattggttgaggaaacagtataaaggggcttatctttggcatcagacagacctgggcaggtgagctcagagggcggggtaagcaagcatcggggtaagcaagcatcagagtgcgtaagactttctaggccccagtaagtgagttttattctgcttgtggaaggagggtgttagaaggtcttaagcagcaatatgatgtgatctgattcataggcattgtgcaggtgggggtgggaagttgacgggtgagtggaagagaccaggaaagatggtggtggcggcagagagggagagatgtacctgggtttggaaacatcatctctcaagaggggtgcagtaaatggagggttcaaggagagagtggtttgagccctggaaatgggtatcctagttgctggaggtcagcgtgtggggtctcaagccttggaaagctggtaggaatgtctgatgccgcctgcatccagcagcatccggagggcgacacttgtgagttcttatcttaattcgagctctctggggactctgatacttaatctgcaatccacttatccccctgaccatcaaggccttttccattaatagaaatttctctctcctgacacagtcattaaagcctgtttcttctggctggttttccccagagtgcatagctcagcatatccatcctagaagggaggcagatttgagctcagtatttggataattttccttctgctttttcatcaagatgtagcattcgtagagtgaagcacagagatcttcagtggacattgcttttaaactgcaagaacagcccgactgtgaccccgtaggatggtgatctccctgtcatcagggatgttagcagcgtggccggaggcctttgagttatggcacccgagggaggggtcccacaccgggggaactgggaaggtgtccataaaatccttcatctacttgatgatggtaaatggggttccctgcaggcatcagcaaccccttttctttcccctctcctaaaatgtctgatctggatgggatctgagagatgcaacccacccctatttcaagggggtggtccggggagatactacctaggattggacaccctgcagctgagcagagacaagaacctgggtcctaccagatgctgggacactgttctcaccaatgcacctctctctctgggatatcaaaaacctgttctgaacaccttccattaagtatcaaagtgtttgaccctgggttcctgatagggaaaagctgtaaggaggaggacacttttagacatgcctgggatggccctgggagctggtgctccagcagccacggccgtgcgggcagatgtgtgggtgaatctcaggcaggggaatggcagggaaggggcatttggtatgcttgaagaaatgcaggtaaaataaaataaatcatttaattttgaaattttaagaatatttgtttgcaaaattaattggctgctaagtacttatttcattgacttgcccatcctccccaagtttggacttttatttaaaagtaactaataacagatgccatttattgggtacatagtatgtgctcagcaatgtgctcagatatatacataggtcatttaccctgaaatgaccacatgaaggtggggctgttatttcgtcagttttgcagatgaaaaagcttaggcctggagtgagtgaagaacttggccaaggtcacccagctagtatttcagggcagcctgtcctgttctctcctccggcctcccttcaacccactttctctctatgatttacttttctctcctgtgatcttgtatgaatgtgtggttagagggtgtcactgccctaccagtgtaagaagttggtagaagacaggatggcttaaggctgggggtacctgctcctgagctcacacatagtccagcttggagtcaggatgccaagattcgccgagggccaagccagatctgcagccacctggttggaagtcgtaggccgttaggcatcacagccggtgctcttggacacttgcccttcttcctctcagttcccaggttgggagagttaaggggcttggatgtggggatgcagcaactgtaagagcctgagcatcagaaagcgctgttgggagtgggggcaccaggagagagatccgagttagggcagcagagacagctgctcccgcgtcttgtgctggactgggattgccaggcacatctaggagccgtcctccctctacgccattctccctggctccagactcagacgtgccctaaactcttgtgcttctgcttcctttgtaggctgataagaaggacccccaaggcaacggcaccgtggctgggtttgaactactgctccagaaacagctgaagggcaaacaaatgcagaaggaaatgtcagaattcatccgggaaaggtgaagcctgggcccctcccagccctggggcctggcaccagtgttccccggggccccgtggccggggcggggcgacagcacaggactcagtactgcacactcagcattgggctggttagcgccaggcggcaaactcatggcgcctgggatggatctggtcagcagttgtgtacctttggccgatatagtgtttttaaatattgaaagcaacacttaaaaaaatgggtagatttcatattaaaatctggatatttagcacaccttgaaagagcagaagcattggcaggattgcctccacatccctcacgcgacacttggctggagctgagtagcagctactcttgtagagggggtgtgtgttcccattttgccagtctccaccattccgtactgtcttcccccgcagactccttcactcctttacttatgtacctggccatcatttgaagcacagccctttaccgtaaccagtgggggggatgttacagttcaattcatcgttagccaaaacctgtgtcccagggcaggagatgttgaaccctcctcctaccccatccctgcctcaaggattataacagtgttttgtctaaagagcttgggaacacagatgaagaaacaataaattcagcccaatggaaatggagaaatcgacaaagagaaagagaagttccttctctatctccttcctcctctctctctgtctccaagttctgaggctctgttcagcacacactcacatacccacagctgcacatacccacctatcacccatgtgcacacacacacaaacacacaactttccacctggagttggaaatatagcaaattgcaatatctttttaaaatatttcttttttttttttcttttagacagagtctcgctctgtcatccaggctggagtgtagttgcgcagtcttggctcactgcaacctccatctccggggttcaagcgattctcctgtctcagcctctggagtagctgggattacaggcatgtaccaccacgcccagctaatgttttgtatttttagtagaggtggggtttcaccatgttggccaggctggtctcgaactcctgacctcaggtaatctgcccgcctcagcctctcagagtgctgggattagaggcatgagccactgtgccagaccaaaaatatttcctttttaattataacagcaataatcaagtaataatgcttcggcgttttgaagcacccctttcccttagagggcctattttcatatgagatcggatgtgttcagggtggtatgggcatagacagagggcctattttcaatttgtgtaatcaaatccttattttatgacccattaaactggtgggaaacggagaggttgcacagctcgggtttgagaaaacaatggtataaaataggcaaataggaaaattgctgtaaaagccaaagcttgaacacgcttatggtttatatttccatgacaacgtcttgttagcaaataattggaaactgccatttcaggacattccgggcttcctagagaaaacgcatacaccatccaccttgggatctcatagggaaggccctttagtgccaggagaggtgagagctgaggctcagaattgggagctcgcctggcttgaggacaggtgctggctggtttgctgggatcttggtttagagaagtggggcagaggtagaggtgacgcacgctgtcgtcctggaggtgagacacaggaggcagacagcgtatgcacctcgtgtgtctggtgcatgctgtcggcattgaggagccgggagcgtggcatggatagatctactttctagatatctctcttgaccacagtctggaggtgaaggtagggggatggagaggaagtgacagaggcagatcagttggaatgagactcaggaggacctagagaccagttgaaggtggaggtgaggggaaagcagtgcaagaaggaacgagattgtgagtctcctgatgccaagtcatgcaattattattactcggaatgctgccgccagactttgtcagccgccctctctccatcatcgcaccctttgggtgccagctgcttgagcagctgggaagcaaacgctgtggtcccagcatctctggagcttctctgttcaccgtgtggtggaccaggggctctccgaagcctgggctctggccagctctggttggcataagcatagctcttctgtctcccactgtggcccagaggaccacttaggtggtgaacaatacctctgacaacatgcttaacatggacgtgccagataatacaggacactccctggggagttgccttgcaaatgtgtcaaaggcctgcctgccggaagctacatccaaggcaactttcctctccagggaaatagaatctacctgcagccctgggcactgctaggtttccgtggaagtacttgtacccagcaggcttgacaatcagaggcattgggggtgtgagacagtagggagatgttctgttctgctgctgagggtccgaggccacctgggagttctggggctggaagggagaggggacagcactggggattgctggtagtccatcacgagttgcaaacgttcatttcttccttcattcatttattggttcaggggtcttatgtttcccgttctgtgctaggaactgtgtaaacgacagctctcgtcttcacagctctaggagaccggagaaaatgtcctactttgcagatgaggagatggaggtccagacagttttgttcattcatttatccaacaagtatttattaagcacctactgcatgtcaggtagacagacaagagccatgtggtctcagagcttatggtctagtgggttcctttccacggctgaggtgtgcagggcagcagggcagacccacgatctggcactggagagctgatgtgtgttgggttttctctctttgcaggataaagattgaagaagactatgcgaagaacttagctaagctctctcagaactccttggcttcacaggaggaagggtgagtgggtaggagagaggtgggagtggggaggatggggggtcactgaggaagggaaatcagccactatcactgatcactggcatggccccactttggatggggagctctccataggcctggctcaaggtgggcactcatggctcaggtaggtgctcatgacttgggtgggcacccatgactcaaggtgtgggcatccacactcaaaagggcacttccagccgggcgggtggctcacacccattatcccagcactttgggaggccgaggcgggtggatcacaaggtcaggagttcgagaccagcctggcccacatagtgaaaccccatctctactaaaaatacaagaattagccgggcatggtgatgagtgcctgtagtcccagctacttgggaggctgaggcaggagaatggcgtgaacccaggaggtggagcttgcagtgagctgcgatcgggccactgcactccagcctgggcgacagagcgagactccgtctcaaaaaaaaaaaaaggcacttccacattgtcttctctttagtgaccaagagccacgttccagatgttgaagtatgtcagaatcccctctggtctgacccctggtagctgggcagcagcctctagatgcccactccagcctccctttgtctaggggcaggctgggaggaagctgcgtatgagagggtattgtacctggccgctttgtctggagctctctcctgtgggcttgaggcataggctcccttcccgctaatgctgtgactgtccagacctccttgagtgggacctgggctgggagaagcttaacccaaccctcccagccacagaaggactcctagtgggtaaaaaagtctcagcccttatgcacccctgggggaaatggaatatggtacagccgctgtggaaaacaatctggttgttcctcaaaaagctaaacatagaattaccatgtgacccagcaattccattcctaggcttatacccaaaaaaactgagtacaggcactcaaactaatacatgtatacacatgtacacagcagcaatattcataatagccaaaaggtggaaacaacccacattccacccagggatgactggataaacaaatggtggtgtatgcacaatggatacccatggatagacaatggaatattactcagccatgaaaaggaatggaacactaatacatgctactgtgtggatgagcctcgaaaacattctgctaagttacagaagccaggcacaaaaggtctcatagtgtatgattccatttatgtaaaatgcccagaacaggcaaacccatggaaacagaaagtggattgtcatttgccaggggctgggggaggaggggaatgggttgtgactgcttaaaagttaccgggtttccttttggggtgtgtattcatctgcttgggctgccacaagatgtcccagactgggtggctgaaactacagacatttattttctcgtggctctggaggctgggaagtccaagatcaaggtgccagcagggttggtgcctggtaaggactctcccattgggttgcagatggccgccttctgattgtgtgttcatgcagcctttccttggtgtgtgctcagagagagagagagagggagctctgtgatgtctatttttttttttttttttttttttgagacagagtctcgctctgtcgcccagactggagtggcctgatctcagctcactgcaacctccacctcccaagtagctgggactacaggcatgtgccaccatacctggctaattttttgtatttttagtagagacggggtttcaccatgttggtcaggctggtctagaacccctgaactcaagcagtccaccctccttggcctcccaaagtgctggaattgtaggcgtgatccatcgcgcctggccaatgtctatttttataaggacactaatcctatcagatcagggctgcacccttatgacctcatttaaccttaattacttccttaaaggccccattgccaaatgcagccacattgtgggttagggttttaacctaagaattttggcaggacataaacctttagtccatactagcatgacgaaaatgttttggaactagatagaggtggtagttgcactcacaaaacaggcgtttgatttggtctcgtcctaaatgcgcctggatcgatcacttttcaacggttaattttatgttatatgaatttcacctctgtaaaaaaaaacagaaagactctcaggaggttagagttgaaaaggtccccagaggtcctctccgttctgacctccctctggtgctggtctgtttgaattccttctccaagggggagtgaacccccgaggaaggaagacgttctgttgtgggatggttgtggtcgtcagcgagccatgatgttaaaccagtccaaatctgccttcgtggcttgaaatccttcaggagactgagattttgccaacccaaatgtggctttgattaagccctccacatgggttggctgtgcagccaggcggcctcctttgaatggttctcaccctccctgccagccacagaccgcagggcggcccagcaagaccagcgtcccttccacagatgtaaatgaggttagttcattcctggcctccttctgctccatgcacggggcctgagataggggcaggaagggggcacatagaggagcagctcttgctgcctggcaaggggctttcctaagtatccccgtgccctgcaaccactgtgccactccggagtcttccggcttccatctctccagcctgggctgctgccaaggacactgtgtcctggccaacatgcacagcatatgctcctcacccgagcagtccagctccataagtcaggcccacactaccatactgtacacacatgcccggacaaacacagagacaaacacaacgcaagctcacatacatgcatcagggccactgcctcgtaggtgtacacattactctgtgtgtgcatgcacgcacagcagccccatgcacacactcctgcagcaggcactggaacatgaacacatgagccccctacgtacaacgtgcaaagacactgatttacatttacacacagctttggacatttaaccctatctccttgaagactttcaaagcaaagcaggagtctagaaatttggagcagttgaggaagatgctgctcagggaggctggagaggcttttgcaattcaacttctgtgtccaaattagatttcacaggacatgtgcacattggtaaataaacagaattcggttgtttattctgcctttagtttttctctcctatgtggaaaggaaatgcgattttggttttcctagttggcagtcatgaaaacaacatgcattttgatttggcgtacctgaaactgtatgttggaacagagatgcacctcaggttttgttttgtttttcattaaccgtttatcagatgaaaaatctcttttcaaatgagagaatttgtaagtagctttttaataaatggtgatgtgactccaaagagcctggaatattggagagcagggaggcattcaccaaggatgcactggctcagaggggcccctctgaatgtctggagacatgtcttcccacttagcagtgtctggcctggaggtagagctgaggacgttgtgttgggtgggggaaaaccatggttcttcctttcatcccagttgcccagagatgacattctcaggccaccacgactgtccctgggccatttacctgccatgtgctctgctgacagtagactgacagctctgtggaaagatgcatgtgctcatacaaagtctgggcaccgcctggggcctttttggctctgtgactcttgttcatacctcccacaggctgctgtgtgtggctcagctgcaggggcaaacccctctcacttccctttaatccagttcccattcctcccaggacaaccttggtatgcttcaaatagtgttggctttcaccctagagctaggaggcatcttgagataatttgtgtgtatggtgtgaggtagggccgagattccttttcctcctgtggatgtacggttgtctctgcaccatttgttaaaaagatcatctgtttcccccatggaaacaccctaacctctttgctgcagtcaatcggccctagctgggtgactttgtgttctgttccgctgatctgtgtaactgccaggactactcctgccacccctggacctcctacccacctgttgaatcaggtggggcacccaagccacccagagggggtggagtgccccagtacagcttcctggatctcaggcccttcaggcagagacaattgtcaacagcttggattgccccgtttcatactccagtgcttctctggtggcttcccctgccaggatcactgaggggacctttctttgctgctagactcctagataaaatcaggcagtcatttcccataaacacccacctcggcctgagcctgcgccaccaccacacagggctggccagccatcagagggatctgctgtgcactgttgggcaattcttcgctgctggctgctctgctccagacccagaagcctcaccacatgctgtcttttattcagcttttgccactcgactttaatgaattctctgggggaagtggcttttggatgatattaagtcaacagaacattcagcctggatttactggctgtgttgaagaggctgggagcaagaaagcgggggtatcacttggaagggtcatgcggttaaagagctccaaatcatagagaatgtagcctggggcctgcattggcaagtcttagggacttcaggagatttcttctacgtgaagcctctccttggagtggagaagtgatgctgctaagaggacttggcccttctctagtaagctgtgggcagcatcagggctcacagctagagaagcagtgctagaggagaccgtgcttcctaggatggccgtgggagccttctctgccctgtggctgcatctaggtcactagacccacacagtccatcttccccactcctggaagccaaggagctgggtttttcctataagcagcgctgtgtgatacctgctgtttgaaaagagcttctccggctgggcatggtggcttatgcctgtaatcccagtactttgggaggccgaggtaacccctccctgcagctgctctcagttggtcaggagttcgagaccggcctggccaacatggcaaaaccccgtctctactaaaaatataaaaattagccggatgtggtggcacacgcctgtaatcccagctactcgggaggctgagacaggagaatcgcttgaacccaggaggcagaggttgccatgagccaagatcgcgccattgtactccagcctaggcgacagagcaagactgtctcaaggaacaaactaataaacaaatgaaaagagcttctccctggaatagaacctgttttccttccttgatttattagcagatgcttgcacccctcatcagcaaaccagggaggggtgatgtgaaagctctggggacagtgacggcccaggggtcaaggccctcactgcagctgaggctttggaatgtccccacacctgcttccggcaccttcctgggtcctttcgagcctctggatttctaggaatccccaccccccccacctcttggctgtgcgccacagtctgtttccttagctccagaggtaaggtgagctcacttggaccttggtggctcatctgactctgtgagttgaaacgtgatgctcatgtctggtttctgcctgacttctgcctcatccgcgtccacattctcagctgtcatatacctccccgagacctggggtggagccccaccatcctgcctcaggaagggctttggcttgtgacctgagtctcatggtctttgtgttgcagctccttgggagaggcgtgggcccaggtgaagaagagcctggcggacgaagcagaagttcacctcaagttctctgccaaggtaacccctccctgcagccaccctcagttggtcttacacactggggtactaaaaaatagttaacaactgtctctccagtttgccgtttgccattttccctggtgtaaacttcaggctatcaacatgaagtcacggaatacggagttgggaagagatatctgcccagtggctcaccatgaggtggtgcatttttgtatagacacagtagcacaaataaccatcaatatccaccaagagcatggaaaatagtaaagtgtagttaggaggtggtaagtgctaggtatttattgcctttgttttttatgttttgttatttttaaaaagacaaggtctcactgtgttgcccaggctggagtgcagtgacatgatcatagctcactgcagcctcagcctcctgggctcaaacgattctcccacctcagcctcccaagtagctgggacaacaggtgtatgcaaccatgcctgggtaatttttttatttatttgtagagatggggtctcgctattttccccaggctggtcttgaacctcctggcttcaagcagtcttcctgcctctacctcccaaaatgctgggatcacagacatgagccactatacctggcctattaccttcgtttttaatataatttttattcaattataagttcatatcatttcctttttgataatggccgtgtttaacaaccagcaaacagaattcctgaaaatttaacattcagctcttgggagccactgggagcaggccttagcacacctgcccagtttctcagggcagcccctgagtgacgaagccctgctttctttttgcctggctttcaaagggatggagtaggatgtcctgtctcttcctagtgtcagggaacattaggttatgccaaagggagaattttttttaaatttgtggttgttgcaaaatttcagaacaagtaaagggtccttctttatttatttattcatttatttattgattgatttattgatttattgattttgagacagagtcttgctttgtcgcccaggctggagtgcagtggtgcgatctcagctcactgcaagctccgcctcccgggttcaagtgattctcctgcctcagcctcccgagtagctgggactacaggcgcctgccaccacacccagctaattttttgtatttttagtagagatggggtttcaccgtgttggccaggctggtgttgaactcctcacctcatgatccaccctcctccgcctcccaaagtgctaggattataggcgtgagccaccactcccgaccataaagcatccctctttcatttaattctgaagatactagtgccaggactcgagggcagggtgtttctgtcctattcccatcctcagggctcaggatggtgtcttgcatgtagtagatgcttaataaatattttcttattgagtcatgaatgaacagagccctctgactatctccaccccacccccagtcttttcaggtctgctttctctcaagatttctccatgtttccaagtgactctcccttccccactccctggcacatacctccaggttttctctccgactctcagctaatttttagatgaaaaataaactaaatctctcagtgaagtaatccactctaaagtgtacatgattggtggggctacccattaacaggcttgccttttaaagaaaggggccaggcgtggtggctcacgcctgtaatcccagcactttgagaggctgaggtgggtggatcatgagatcatgagatcgagaccatcctggccaacatggtgaaaccccatctctactaaaaatacaaaaattagctgggcttggtggcgcatgcctgtagtcccagctactcgggaggctgaagcaggagaatctcttgaaccctggaggcagaagttgcagtgagccgagttcacgccactgcactccagcctggcaacagagtgagactctgtctcaaaaaaaaaaaaaaaaaaagcgggggggacctttcagagtgcaccatcccagtgaccctggcctcctcgctcttccctctgtcctcccaccatcactagtcagacacagcagggtaaagtgcctaaacgctgagtctcccttctttaaacacgtgcttgatcatttgaaggtagcatccctcagagatggtcgctccttcctgggacttccacgttcagcactcactggtcctgtctctttcctagtgtcgttcctactgcaattgcaagtccctgctttgggatcccatacgatgtaccccgtggtggtactcggcacacagaaggcagaatgaatgactcagatgactgagacacgtgaaaggactttctaaagagctgggttggaagagggaacagagctgctacagctccccatggcttagtgtgccccaagattgagttgacacccagatgtgagtgagaattcccagccagtgaaggcatgctaactaacctcattacaccaagcgcttcagtagaaaattgctactcaagtcctggcagagaagggaactccgtgaatggatctttttcctgcattgcatccaaaacagcaagttatttttcagctgcagatcatgagtagctttcccctcaaggcctcccttcccctgtcggggcccccagcagctccattctctgctgtggtagaaacttccattgactgggaagatcctgggcgggctgccattgtgatggggtggggctgggagccagagttgcgagctttggaaaggtcacctgctgggtccccgggaatcttggtggcatttactccccatcagcaggacccctgattcttgattgtttagagtgctcaacaggtggcaaaactctctccgacgtggtagtggtgacataagtggtgtggatggctgtgtgcaggatataactcattgccgtcaaccaccacgcgagatagcatacacatttcacagtgagaagaggtggggtgagatcacagcccatggtcacacagccaggtgggttcagtcacagaggaagcaaaggaaaggactgagcgaatgggagacttggtccccagagcttttcttccagcagctcccctgctttggcagaccaatggcattgaaaacacagcctcttcttgagcctgtgcctttccaggggttgccaatgggctactgcagactggccctggacaaccacatgctcagaacattttaagttagtgttcaggacacagggtggacctcaccattcagttgacaggaagctcatgaagacccgtcatgcaaaacagactttgctacgagaggctctcggctgcttccagcctgtcggtcagtgttggtggcctcaagcggtcatcgcagcagcctagtggttttatggcgattccttgagaagaaagtggctccaaggatgtatttgactgccatgaataatatagctccatatgccaaaaaccgtttttaatgtctgctccaaaagacttattgaaattctgctctgaatgctctgtgtcaggggtaaaagctctttaagaaatgcaattttgttgcagcaatttttgtggtttttctggtccattagctcaagccattgctaatagcaacagattgctaaagaaatgagagagccgtatacaaagaaagttatacctggctcctgctgaagaagggagaagagcagaattccttctgctgatagaaaatctcatgcggtagaggctctgcgttccatcagaagatttaggggacaggagtgaggagacatgagttgtatctcagtattgtcactaacaagctctgtgaccttgagcaagtcacttagctcccctggggtttcatttcttcacatatgaaatgaagaattcagaccagatcagtctctttacacttatctgacagtgacttacaatgatgcattttatgtgagcattcagaacctgtctgtaggtatccactccgatatctgcacacagacattcacacacatctgtagctgaaacaaacgtttcataaaacagtatttatcctcctacttaaaatgtactctggtattttctgttcaagtctggtctgttctcaccaaaaagctggtcctggcccattaaatcgatttcacaactctcggccgcacaccgtctgaaaaatatcagactagacagtgtctgaaattcctaccaacttggaacttctcttattctcttctgatgtgtgagatgaaaaggaagcaaagagagcgagagttttggaaagaaaaactgatgggccatgacaggccggcctgagtctgtgaggacactttgaggaaggacttctgattcctggttcaacagagatgcttaaaagttaagaatgggtactaaagataccagcctaaccattttaaaggaaaaaaaaaactgtcttttaaaagtacttaatatcgccgggcacagtggctcacacctgtaatcccagcactttgggaggccgaggcgggcggatcatgaggtcaggagatcaagaccatcctggctaacatggtgaaaccccgtctctactaaaaatacaaaaaaaaattagccaggtttggtggcgggtgcctgtaatcccagctacttgggaggctgaggcaggagaacggcttgaacctgggaggtggagcttgcagtgagccaagattgcgccattgcactccagcctgggagacagagtgagactccgtctcaaaaaaataaataaataaataaaatacttgatgtctgtagcgagatggagatgccaggcatcctcatctgtggaatcaaatcacttgtgatagttagcagcgtcacgcttccagaatgtcatttgaatttggggaaagcttcctggcatattggcaggttcatgggcttttccccagaccacagaacctggggctggggtccaggaaaccttaatgttgaaaactcttcaggtcattcctgggcgtattaaagcctgaaagtcacttgctttccatgtccttagagaccccggagtttctgagtcagcaggctgagctaactctcccagattcccggagtcgtacagctgctcctactcagcaaatgccaaacctatatacgtgggaaaggggtttatttattctcgtaagctctcaagatttttgtagcatcctgcaaactgccgccaggtggggatgttttcctatacagggaaggttccaggggctcaaaaaaaatagtaggacatatttacaactaacacgaggaggagagaggggtgtttggatggccagttctctgttagtctgtgacggtcatccagcgacaaagctgtcttcttgtcacccaggggattgagctctgaagagtttgtcattctctctacaaacacagaaggggcacccacccagccccagcccaggtcagacactgggcacagcagtgctcaacccagatggggcccctgcccgcttggagctcccagccccgtgtaagtcagttgcttagaatagggacacctaagtcctggttgtatccagagaaaaagatattgtacagcaaaaacctgagggagaggagagaagtcacagaaccctcgttgggatatcatctgtccagggaagttgagctgtgctccctagagacacctctaagaccggtggaggcagatttgcggtggtggggtggtcataggttgaagagagttgcctgattccaggcagtggggtgggaggggtgcacagggctagggtgccacctggctttgaccacagcaggtcccgttgatctgttttcttataaatgttatgggctgggcacggtggctcacgcctgtaatcccagcactttgggaggccgaggcgggcggatcacgaggtcaggagatcgagaccatcctgactaacacggtgaaaccccatctctactaaaaatacaaaaaaaaaaaaaaaattagccgggcgtggtggcaggtgcctgtagtcccagctactcgggaggctgagacaggagaatggcgtgaacctggaaggcgaggcttgcagtgagccgagatcgcgtcgctgcactccagcctgggcgacagagcgagactctgtctcaaaaaaataaataaataaataaaaaataaataaatgttatgctcacaaacaaaaggaacaaattttaaggaaaagttcttttaaaggggggtgggatgggaaagagggaaggaataaaagagaagaaaaaagcttaaaaccctgatgccacccagctcttctgacagcataaacccttttctctggcccctgggatacagggcggttccctttgcctgtgctccaggcagcccagcaagctgagaatgtctttatgagcgcaatgcgggacagttgcccttgtgagtttccagcaggtctccaacagttcccaccatcagttcctcgaggtttggaccctgtctagctcacctttgtattctcagcacctgccatggagtagatgttcgataaataggactgacctgagaccttctaattgaatggcattcattcgactgttctttactgaagccgcgtaccccagtcactgtgctgagtgcttggagacacagacgctgatgtggtttctgtccccagaaagctctcagttcggaaaataagggagagagacataagaacaaagccgtgcaagaagctgtgggataaaataagtgtgtgaggtcattgattattattgttttttgtttgtttgttttgttttttttttttgagaccaagtctcactctgtcacccaggctgaagtgcagtggcacaatctcggctcactgcaacctcccaggttcaagtgatttcctgcctcagcctcctgagtagctgggattacaggcacctgccaccactcccagctaatttgtgtgtgtgtgtgtgtgtgtgtgtgtgtgtgtgtgtgtgtgtgtgtgtatgtagtagagatggggtttcaccatgttggccaggctggtctcgaactcctgacctcaggtgatcaacctgccttggcctcccaaagtgctgggattacaggcatgagccaccgtgcccagcccattgattattaacttgatttagccattccacaatatatacatatttcaaaacagcatattataaaccataaatagtaaaaaattctaaaaatttaaaagctgcagaagctcagaaaaaaagtagttaacagatggggaaatcagaaggctctagttgctaaccacttatcctgtagacgtgtgtgggggcctcctgagctaaggtgacctgcctaagctgagacctgataggcagccacgtgtcagggggtgtctctcaccttcctgccaggtcgctaccccagactcatcctcacttgcctggggaagtgggggtgcccctcccatccctcctccctgcactggcttacagctgatgccctgggtcctgagtgtgcgtctctactctcccaacagcttcacagcgaggtggagaagcccctgatgaacttccgtgagaacttcaagaaagacatgaagaagtgcgaccaccacattgccgaccttcgcaagcagctcgccagccgctatgcctcggtggagaaggtgagaggcccaggacgctgggccagggcaggtgcatgggggactgcctggaagaagggggactgggaagccagcagtggctccatacgccaaggctgagtctttgtccccaggtaggggaatagggggatgtccaagcctcgtgcctacgccagagcaccccacccatccaagggcagataggagctgcctccctgtggtgctggaatgaccacccagagggccaggggtgcgaggagaggctgcagctgcagtgggcagtcgagtggctgttggcgaccagttaaaccccgagcctagcagtgctgctgctggttcacgtggggccccgtgtttaagcctcacctggctgagtcgtcctgactcagtcaccgcctccctgctctccttcctgctcagggatgaggctgagtcctgggtggtctcacctccagggaactgatgttcagccttagagggaagagagtgtgccccagggactgattcccagtccccagtgccttagagaggagaagggggctcaaactgctgggacaccctgggcccagccaactgccgccacccaaggaccacagagatgccagtggtggcctggaggaaaggcagtacagtgaggggaacaagagggccgaggcttgtccagctccagaacgggagggctgttgctacatcctattaagtgctgcagggaggtgacacagatggcctttgtggtcccttccaagcagaggggctgtgactttaggactgcctaggtccccagtctttgtacaggctccatcgggaaaaaaacgtggtttgagagattgaggtaggctgagtccagatgtcactggaagaggcaaggacgaaaagagttgggttgtagcctctacctagctgggtggtgccactctggctgctgggcctctctggaccactgtggcatcatccacacaaacaaggggcgaaaggactccaaagggaagctgggctgcgtggcccaggaggcccactggctccgagctgtatgagcagcttctccgtgtccttggaccccaggcccggaaagccctcacagagcggcagagagacctggagatgaagacccagcagctggagatcaagctgagcaacaagacagaggaggacatcaagaaggcgcggagaaagtccacacaggctggtaagtgctgggcacccgcctggcctggtcagtgcacacagaaggagagggcacggggctaggagatgaggtgactggcgagggtgcatctctcctttgcaagactgcagcgaggaaattacttcccttgtttgccaggaggtaccccctcttcccttctctctgacccacacccagagatctcaaagaaagagactttgggggtcagaggaaggacacaggccgggctagttctggggcatggtagaggctggactccttactctctccctggtcgtggctttttttgttttccgcccaagccccagatctctgaccaggaggtggacaaactccttcatgcactgagagctcagggccctgtccctgttcagagcccacagaagcacacagctcacccaagctgcccacttccccaggaagcaatgctctctctgaaggttcacctatggggatgggctcctgccctgggaacagaggctgacactttgtttaaagaaataaccagatttcagtctcttgggaatagtctcccaatgagttggtttctgcttccacctagtggtcaaagttagctaatacacaaagaggaagagaaggcctggtagaaccagtgaaaacctcggtaactagatctaagggaagccacgtttcactgcacgagaggacacgcatgttgcctctggaattagaatgtgtgccgtagtattagagtttggtctgtaggtccctttcacctcaatttctggtgaacctgttacaattccttcattatagaagaaagcagccaccttacatttcaaaataaggtaagatagaaataagtcaataaaaaataatgtaatagaaggataacgtttattatacaaatcttataatgcacaataataaattacaggatcaagaagtagagggcacagtatatttattggtagagagaagggggggcacagaaggggaagagatctgtttaaattattaagttattaaaaaaataacttataggccaggtgcagtggctaacacctgtaatccggcagtctgagaggctgaggcaggaggatcagttgagcccaggagttcgagaccagcctgggcaacatagtacctcatctctacaaaaaaatttgaaaaaattagctaggcatggtggtgcatgcctgtagaatcagctactcaggaggctaaggtggaggatggcttgaacccaggaggttaaggctgcggtgaactatgatcacaccattgcattccagcctgggtgacagagagagactctacctcaaaaaacaattatattgcaaaaacagtattggtacatggcaaaatattttaatcagcagacaagaatataaaatgctattcacagaaataatcaccatctcttcctagtgttttgatttttaaatatttaaatttatatacatttgatcatacaatctatcttctgaacttatttaatatatcttggaaatacctctttttcatttctgtaaatctttttgcccatccattcatgcatatcaaactttttaatggctggccagtgtccagttgtatgattgtacccaaatttgtttcatcattcccttaactgaggtttaggactcttagattgtttcagagtgcttgccagccagtgaagctgtgttattgtacctgcatctttgtgtgtgcctaagaccagatctgcatatagagagaatatagttgctgagtcaaagggtattattcgtcttgatggatatttccaaattgctttccagagagagcacctatcaacagcatctatgaataatgcctgttctctaaatgcttatcaacattgtgtgttatcaagatttgaaattggtagtgagtggggaaaaatgatattttgtttttaatttgcttttctccataacccaggttgagtatgtaaaatatacatataaatcattgttgtactttctgtgaactgattaactcatatcctttccccactgaccatagattctttatctatcagggagatgaatcgtttttcattttaattgcagatatttttcctagattgtcatttgtcttttagttttgttctttgtaattttttttttttgcttgtttgtctattttttcttgctgtttttctgtacagtgatatttcccataagaagcctagatttcggagctgatttagatctttttttttaatcacctagagggttttttcttactttttttttttgtttcaggtgtttatttttgtttttgtttttaaaatagtgaaggccggccgtggtggctcacgcctgtaatcccagcactttgggaggcccaggcgggcagatcacgaggtcaggagttcaagaccagcctggccaacatagtgaaacctcgtctctactaaaaatacaaaacttagctgggtgtggtggtgtgtgcctgtaatccaagctacttgggaggccaaagcaggagaatcgcttgaacccagaaggcagaggttgcagtgagctgagatcgcagcactgcactccagcctgggcaagagagtgagactctgtctcaaaaaacaaaacaaacaaacaaacaaaaaaagacagtgaaatatgtaacccaccagacatttatttttccttacactggtggtctaaccatattccacaggttcttatttgtggtggttttatttctgctattttcattatgttttgctatttgggttttcatttgatcttcgaaccaagaattgtttcaaagaaaatctttatatgtttacaagcaagggctttgttgttgttttctaatcttgctatttttttttacatagttttattgcattgtcatcagataatacggtctctcattcctgtagtttggaattattttgtgacgaaagtgacagtccttagacctaactctgaaaaataccgcctcttctgagcactcgctgtggccagcctccatgctttagagcattgtctcttttgatcagcacagtccccctgcagggaggtatttttataccctttacaaatgagaagactgatggcagagaaaatgagaaccttccatgaggtccacagtggtggagcggcgaagccacaattcagtctcctctcattccagagactctgcttgtcgccattttgctggacagcctgttgctcaggaaatgccacctgttctttccttctgttcctttcctccctcttcctcatcttttccaaggctactagaaggaaagacatcagatcctcagggatcatcatcatcatcatcatcatcatcatcatcttcatcaccaccatagcccatattaatatttggctctctacgcccatctctattctaagtgctttacatattttgacatatttattcctcataacaacttggtaaaggtacaatcgttatctccattttacagatgaagacacggaggcaagcgcaggataaccgacttgtctacgattacatagctaataagtagttgagctgggatgacaacaaaggctttttttttttttttttgagatggagtcttgctctgtcgcccaggctggagtgcagtggtgcgatctctgctcactgcaagctccgcctccctggttcatgccattctcctgcctcagcctcccgagtagctgggactacaggcgcctgccaccacgcctggctaattttttatatttttagtagagacggggtttcaccgtgttagccaggatggtctcgatgtcctgacctcgtgatccacccgcctcggcctcccaaagtgctgggattacaggcgtgaggcaccgcgcctggccaacaaaggcattcttgtcccacaatccatggtcttaaccaatactgttctaaaaagttccaatttcaagctcttgggctgccatagagagaaggtacagcccccttcacctactctgtttcccaatgctgtggaagttcctgaagcaatttctcaaaatcagcattgacacacagggctcagggagtttcacagtgtacagagcagcacgccgccctcctcctcggccaggcaggagctcttgctagaaatgcatttgcatttcggaggctgaggcgggcggatcacaaggtcaggagttcgagactagcctggccgatatggtgaaaccccatctctactaaaaatacaaaaactagccaggggtggtggcgcatgcctgtggtaccagctactcgggaggctgaggcagaagaatcacttgaacccgggaggtggaggttgcagtgagccgagattgcgccactgcactccagcctgggtgacagagccagactccgtctcaaaaaaaaaaaaaaaaagaaaaaaatgcattttacggtgcagcatccactttcttctctccggttcagtgcctcttgggatcaagggtccagtcattggccttggaccaagaacaaaatgaataaatgccttggtgtgggctctgttattcaaggcacactcgcgtctggtgtgtggcatagctaggggtatggttcgcagctaggcctggggcctggagacataaccttccctgttctctttgactttcctatcagagtacctatgagccacaatgatgatactataggagtcactttgactctactcgaattactaaattctactctagcattctgcttctagaattactagagaaaattacttcactttggggttcactcatgagctttttccatcgtgagcaaacaccatgatgccttcctcttgctggagccctgtgaggatgaggaagctacgctgagacaaagccgtgcatgagagctgtgctgctctgcctgccacgtgcacacacattaccagagcgtctcataaacatgcagtctctgattcagtaggtctcggatctgtcctgggtttctgaatttctagccgaccccagggcatacaagtgccactggcccacagactgtgatttgtgtagcaaggttccaaggtgctggtacgcttagtaatgtttgcaattacttcgcagtgtgttttctttctaattacaaaatgttctaaacatacatatgataacaaagtaatagagtagtcctaaagattgaatagttatgtttgcctcggatctttctgtgatgacataaaatgcaatagaaggagctgattcctgcccactcaccctttctctgtttcccaaggtagccactctcctgaagctggggtgtgctcctccagtgcatgttttagactgtgactacagatgcgttcttttgtgtttcagaaggacatcttgcagtgtgttcatgcacacacacacacacacacacttacatgatctgcaaatttatcttccttaattattcttagcaccaaattgtgtgtgacatgttttaaccaatctggactccccagtgtaaaataaaactgccatctttagagagggaagcatttcttgggctcatgataggattgggggtcctaggaataccctagacacacacacacacacacacacacacacacacacacacacacacaaaatgagaaccaccatcctgaatccttggtatctggggtcaggcttcagggggacacctgagctgggttctcatggggctgggttgcccccttccttccctggctctgctttcttcttcttcctactgccatcccttttccagctttccagcggccaccatgaccccagggggaggagaaggcttggctgtggggctcagggtggggcacagagtcatggtgaggataggatgcttcatgatggtgactgtggtctttttccaggagacgacctcatgcgctgtgtggatctctacaaccaggcccagtccaaatggtttgaagagatggtgaccaccacattggtaagcgggcagggatgtgtggacatggcagtacagaggctgacacagagcagcccctggtggttgttggtgggcgcggggatgatggggtggagtgaccctggagatggtcatcaaatctacttcagtgttggggtcgaaacctcaatgtgagccagcttatgtggattcagatctctgctccagcgcttcctagctgtgtggatgtgggcagggttgggttggatatggctacatccttcttgggctgtcccctgagaggtcagggtcaactgaggactctcctcaactaagtggacaagggcctctttaggaaaaatagccaagctataggaagagaggaccgccccacacatgcacacacacgagttgcaggtccttggtaggagatccttgcaaagtggatggatgggtgaggatggagctaggcagtggggtggggggaggcctctcaccaagggtgaacaacaggcggcagggccgatgatgctcttgagtatttcttgtaaaggggcagcatctccttatcagtcagcacctgcctgagtggacagtgaagtgtggctggtacttgggccagatgggacaggaggcatcatgccaggtgctcatcggatcagcccactgcctaaagccacccctgtccatccagcacaggactaaccagctgccttccccaggtgtcagcccaccagagcagattagaggcctccaccagggacagtgacctagttttcctcctggttaatctcctaattaagccccctgctttacccccctttctgattaatcacctgggcagtgacctagttgtatgcagagtaacagccggatcccctagattccaaagacacaaaaccatctagaaaccagaggacaaaccctttccacgctcccctttgacaaaagctgtgccacgtgcagcccagtctgcctccctggcccggtctctattgcggccacagcactaggcataggcagaggaagggaggctgctcagcagaggcccagggacaaggtcccaggaatgtgtggcatggagctcccacatgtgcccccttgttataccccatcagggcaccagggccagggctgcatgggtgcattgccatgagtaacagcctgatggactctggtttaaatcctgttcctcccataattccgtgtcgctttgggtgagctgtgttgttgcctctctaggtgttagttccccagttcccttgcttggagaatggggataataacagaaacgatctcttaaaattgtaacgaggacagttaaggaacgcacgtaaagccctcagcactgtgcgtggcggagcaggcttttcaggaagtaaaacagccgctgctgctgtcatcagcttcaccttcaccttagatatggggcacgctcttcatcagaccccagagagtcagatgggacagaatgtccacagccagtgacttgcgttttgtggtcttggtggggggacccccaagtggaggggacgtgctcagagttctctggcctttgctttctcggcaggagctagagcggctggaggtggagagggtagagatgatccggcagcacctgtgccagtacacgcagctgcggcatgaaacagacatgttcaaccaaagcgtgagtttccagcccagcggggctcccgggcgacacggggcctggggagagccgcctggcgctaggccatggcaggttaagtggctgctgcaagtgaatctgccctaaaggcgggcagtgggcaggtgctctggcctgggggtggcctcgtggactgggcctctcaggattgtcctggacgtctgtgtgattcccaccctggcacatgaagtggacacacacgtgagctgttaccctgaggagaaagaagctcgtaacagttacagtagctgaagacattattaaatttcttaaaaaacaaaaccaaaaaaaacaacttctagaaatattcacaatacctaaagctcaagttttatttgtcctgttcactggtggtaaatgtggggtggaagggatagagacaggttttaaggccctcctggcctctcatccaggcctggggtctgcagggtgagaagcagggtcgggatgcatactgggttccccgttcacagccctcttcatgtgctgtccctcagatgggcctccccctggggccccggagccctctagagaggctgctctcagagacactaaggtgaggacagcatgtctcagaggagacctccctggcttggccgccgtctctaacagtgtcgcattttctctgtctcttgcagacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtcggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacagtcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgccgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttagtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagttaaatcccatctcgttttttttttcttctgctctgtgtgtatcctcgagatgcctagattcatcccatgtaaaataaactgtccagagacactaggtccccctaggcgaccctctttcctggagggctgccacattcttcatgtgacctgtcttggcatccctcctaggctctcgagattggtggtgatttcacctccgatgacttagcgggagacaaagggcatctggacactggcacccaaatggatgctatgctcctggcctcaggcccctccccctggtgacttcctgtctctgtgggttccagccctttgcctccctctcatctctggagctcctggctgtttcttttctcatccatccatccatccgttcatttatatatatatatatagagagagagagagagagagtctcgctctgtcgcccaggctggagtgcagtggcacagtctcagctcactgcaacgtctacctcccaggttcaagcgattctcctgtgtcagcctcccgagtagctgggactacaggcacgccccacctcaactggctaatttttgtatttttagtagagacagggttttgccacgttggccaggctggtctcgaacttctgaccttaggtgatccgtcctcttcggcctcccaaagtgttgggattacaggcatgagtcactacgcccggtcccatccatctattcattcaataattactgagcatctggtatatgccagacactgctctaggttctgggaacacatcagtgtgagaaacagagccctgctctcaggtagcttacattctagcagacaaaaacagtagacctactatgttctgtgatgtgggtgtggatggtgttaagtgttgtggaaaagaaaaccaggacagggtacgttgcaggattcaatagggtcatttgagtggcctcattgagaaggtggtatttgatcaaagacaaggagacctgggagggaccctggaaggtcaccagaggagagtgttccaagcggaagagatgctcgcgtgtctgaggccagcctggctggagtggagggagtgaggagggaagagaagatgaggacgctgggcaaccctctttcctggagggctgtcacattctttgaacgacccgtctcagcgtttcccccaggttcttgggattggtggtgattttacctctgatgacttagcagagagacaaaaggcatccgccccctttcatccgttcttggaggtgccagaggccacttgcgagaaatggtgggatgagggccagtgctgcctgctgcaggcttttggcttggactgggagaagtgggcagccatagtgcatgacctgatttcatggccatggggctcactgtggggctgtaaggggacaagagcagaagcaggaagagctgttaggaggcagcggtgatgctgcctgcacaaggcaggtgcaagggaggcgggaagaacggtctggttctggatgtaccttgaaggtagagtcaagatgatttcttgatagattggagtgggttgtgaccgaaagagaaacactgagaatgatgccaaggacctcaatccaagtcatcaaaaggatggattgtcattttctgcaatggggacagctgtgggaggagggtccttccccattctctgtctcccccgccaccttctccatacccccttttccctctcaatgcggacttctctgcaggtgctggctccaggccagagggcaggagggtcgtcttggccttcagctcatagcaggcaaggtcgagcaatggggaaggggtggcgtctgggtcccagctaatggccaagatggagctcctgcttgaggggacagggccagcttctgggaagcatctttcagtccagcgaggagagcgagaccaaaactgggatcctctgcctggagatgaagccttctcctctagagcagtctttgggttttgggagagtttatggccccagctcagacttaacaaatcgactcacaataca

SEQ ID NO: 16977 - DNA, 113283 bp, Human; identical to SEQ ID NO: 16976

SEQ ID NO: 16978 - DNA, 11662 bp, Human
agagtgacatgaggtgggcctggcaggtggctttctcccagcagcagggacctaccttctgctgccactagcctgttagtaagtaggctaaaatccccactttacactttgagatgcaaggcgggcggatcacctgaggtcaggagtttacgagaccagcctgaccaatatggtgaaacctcgactctactaaaaataccaaaaaaaaattagctgggcgtggtggcagacacctgtagtcccagcttctcaggggactgagacaggagaattgcttgaaaccaggaggcggaggttgcagtgagccaagatcgtgcccagcctaagtgacagagggagactccgtctaaaaaaaaaccagtttacctgcctggagaccgtggggtttattcttcatcattctcaccccagggcaaaaagagacaactctccatccacggtggcaaggctggggttctgagtgtgtcccctcgagcactgcgctccgctaaggaaagtgcacgcccaccctcccttccttctgggtgacaagaatccaggtgtgcagcgtcctcactaggttgcttcctcgtgcttgatactccccgctgagctgcacagacgcgaagcctgcctttgcacagctccgtctctgaccactcagttatttatccattcactcagcaaacacgttttcttgcctgctcactccaagtccactgcagacggacaccctgcagcctgccatggacccacagatagattgtgtttggcccacaccatgttttgttttgtttttgtttttgtttttgttttgtttttttgagatggagtctcacacttgtcacccaggctggagtgcaatggtgcaatctcggctcactgcaacctctgcctcccgggttcaagcgattctccagcctcagcctcccaagtagctgggattacagtcacctgccaccatgcccggctaattttttgtatttttagtagagacagggtttcaccatgttggccaggctggtctcgaactcctaaccttgtaatctccccactcagtctcccaaagtgctgggattacagacgtgagccaccattaaaattttgaattaattgccaaagttgaaaagtgtggaaattgcaagaaaaattctgatttttggatttctcttgaataatttaaaaaaacccaaaaatctcaccatcccatgtgaccacgttctctggcagccccttcccgaggtgacacaggcctggctgccccctgctggtcccttcaggcagttcaccttcactccctgtgactgatggacaataacaaaacgagtgtttagcattagccatgtgccagtttctaagtgtgtcagacatattgactcacatcagcctcacaatgacagtgtggtagatgctatgatgcccatttattcaagaaagacttgctgggggcccaagcctatcaggttctggcaatggaaatgcatccgggaacaacacagacaaaatcccatccttcacggagctttcattccggtgaggggacatgcagcgtgccgatgatggtgggggttgtgctattatagatagagggtcagtataggcctggctgagcaggtgacatttaagcagagacatgactgcagtgaaggtttagaagagtgtcccaggtggaaagaggtgaagaaacaagcctggggccacacagctagttaagtagccaagctgggacttgaacccatgctggccccagagtctgtgctcctaaccattgcattctagggcttgatatgagatgccagccccgccccgagatgctcagagttagtgaggaagagaaacagggaacatggctgctgttagagggctggggctgggggtgccggaggccccagctctgagggttccaacctcctgtcctgttctagtatcgtcccgggaggccgagatgaattgcctgcctgccctgggctctttattttaatctcactagggttctgggagcacccccccccaccgctcccgccctccacaaagctcctgggcccctcctcccttcaaggattgcgaagaactggtcgcaaatcctcctaagccaccagcatctcggtcttcagctcacaccagccttgagcccagcctgcggccaggggaccacgcacgtcccacccacccagcgactccccagccgctgcccactcttcctcactcatggggaacagcaaaagtggggccctgtccaaggagatcctggaggagctgcagctgaacaccaagttctcggaggaggagctgtgctcctggtaccagtccttcctgaaggactgtcccaccggccgcatcacccagcagcagttccagagcatctacgccaagttcttccccgacaccgaccccaaggcctacgcccagcatgtgttccgcagcttcgattccaacctcgacggcaccctggacttcaaggagtacgtcatcgccctgcacatgaccaccgcgggcaagaccaaccagaagctggagtgggccttctccctctacgacgtggacggtaacgggaccatcagcaagaatgaagtgctggagatcgtcatggtcagtctcccctctccccttctggctgggcggtgccggggtcgctccgggctgggggtcccctgctgcagctgctgcagagggagtggatctgtgggtggagcgggggatgcgggccactggctctgagagcgtggtgctccgagatgctgatattgatagaggggtgggcacttgcccacagcttcgttgtcttcccggagcagaatctgagtgtttcctaatacagccatgttatgcttggcttcacgatgtttgggtcaacaacggacgatatagaccactgtggtcccataagattgtaatggagctgaaaaattcctactgcctagtgacgtcatagcacagttactttatttttcaaatgcatttagtgtagcctaagtgtatccgtaaagtctgtagtagtgtacggtaatgtcctagttcttcacattcactcactactcactcactgactcacccagagcaactcccaatcctgcaagctccactcatggtgagtgccctagacaggtctaccattttgtatcttggttttttattttttatttttttgagatggagtctcactctgtagcccagagctggagtgcaatagtgcgatcttggctcactgcaacctctgcctcccgagttcaagcaattctcctgtctcagcctcccgagtagctgggattacaggtgtgcaccactatgcctggctaatttttgtatttttagtagagacggggtttcaccatgttggtcaggctggtctcaaactcccgacctccagcgatccgccagcctcagcctcccaaagtgctgggatttacaggcatgagccactgtgcccggcccattttttatctttatactgtatttttactgcatgatttctatgtttagctatgtttagatgcacaaatacttaccatcgtgtgacaactgcctgcaacattcaggacagtcacatgctgcacaggtttgtagcctaggagcaaaaggctggaccatggagcccagggatgtagttggctctaccatctgtgtttgtgcaaggatgctctatgatgttcccacatagaagttgccttaagatgtgtttctcggaatgtattcctgtctctgagcgacacgtgactatatttacattttttctttctctccatcctttgtttcttcgttcctttattaaaatgtcctttgaaattttcagcagtacacattcaagttgaatcactgttcattctaaacacacaatatgcttctaatataaagtagaaagaggtcaaagttgggggcatgaactctgagttctagtcctcatgttctccccagcgcggggcggatcatggcaccacgcatgagcccccgcttcccacgcgcggcgtggctccccggctcctgacagtttccctgtgaggcgcacaggcttccatatggttcccaacacgccttctcccctgtccatactgtcctcctgtcagatcctttgttgtgaaagtaatggcaaaaaccataattacttttccactaacctcgtaggtgtcttgaaaatggtttatctgatataaaagtaactcatgaaatttagaaacctaggcaaaagagactaacaattgcctctaattccaacatccagggaaaacttttcttagtatatcagtatataccttttcagtcttttacctatataattttaaataatgttaaagctatgacatattcacatacgattttttatcatacatttttcagttactcttttatcatgagtgctttccatatcattacatattcttccaaaacactttttttttttcttcagacagagttttgctcttgtcgcccaggctggagtgcagtggcgtgatctcagctcactgcaacctccccctcctgggtttgagcaattctcctgcctcagcctcacgagtagctgggattacaggcacctgcccagctaatttttgtattttagtagagacggggtttcaccatgttggccaggctggtctcgaactcctgacctcaggtgatctgcccgcctcggcctcccaaagtgctgggattacaggcgtgagcttccgcacccaacctcttccaaaactcttttaatagctgcttggaattctggcttatggaaatgtggaaattattgaacattcctatgtttttggacattaggttgtttccatttctttcctattataccagttctaatttccttcatttgatttttttttaatttattctttttcagtccccctgcccctgccacttaccttattcttctaattccattcctgttagtagagactattgtttagatgttaataactttgtgtgcattggcaatcatgctttcatttgcatgatgacaaatgcacaaaaatcttccacagttattaggagaaatcataaataaaacagcagagcatgcagcttgtggtccatgggcttatcctcaatgctcagctcgggcctcccattctggcaggcatgtgtctctctcattgttatcttggcacagcctgcagagaaagctccctcggattggctgtggggtctctgggtggcctgggacagggactaagtcttcagagtggcataaacaatgcagggcccagcagaagcctacaaattgatactcattgaataaaaggaggaggaaagggaggagggggaaatgagggagggagagagggaaggtaggagtcaggaaggaaagagggggaagcaaggggaaggagagaaggaagggagggaggagaaggaaaggaggagagaaaggaagaaagaagaaaggaaagggagggagggagactccatcaatggctggggctgtgcaaggtggcagaaggctctgctattcaccagattacaagttcatgggcagagcactgactgagggagttaaaagtgaagggttctagtcccagctctgactccaactagcagtgttgctgtgggaaaaccatataaccttcctgggcccagggtgaggatttgattatttttgcagtctttcctgaggctctggaggtctgtccctccgtgttggaagtggggtgggcaggcactcactgccagcttctagctggcacacctgcacatggtgcccaaggccctgcacagatggataggagtgtaggagccacctacactggcgtccagctcagggctttgagtgctgccagcgacgctgctgccctgggctgtggctttggcctctttactcctttatccagcaccagggggctgaagggaaacttctcaaagctgtcgaccttccctccaggataatttcacagccattattgcccctgcctgacctgctcacaggtgtctccggggaggcagaacgcaaatggtttgcgaatgttttctcccattccataagttacattttgattttgttcattgtttcctctgacatggagaagctctttagtgtgatgctatcctgcttgtttattctggtttatgttgcctttgcttttggtgtcatatccaaaaaattatcgtcaagaccagtgccaagaagcttttcccctacgttttcctccagcagtttgacggtctgaggtcttatgtttaagtctttaatccattttgagtagatttttgtgtacagtgtaagatgtggattttccagggttgccagccccttaaagttcctcctaacgagttctttctttctgtttggtacaggctattttcaaaatgatcactcccgaggacgtgaagctccttccagacgatgaaaacacgccggaaaagcgagccgagaagatctggaagtactttggaaagaatgatgatggtgaattccttttccttcattgcctttgatttttcaaccatgggctgtttcctggaaatcccaacaagatttattcttctgagtcacagtgtccaggcaggatgggggacacctcattccattgtgcattttcagagctgtttgaagggttggacaggggaatggccttaagggtgagcaggagccaaaactgttttctgtgcaattagaacaagagcaaacttcagctcaccctagctttgaattaatatcgagtcccaagtcagtgggatctgtatttctatggttttactttgggaagttggtttgggtcctctgagaaacaccaccaagataggattagatttaaatgagattgcaagagatttatgggaggaaaggctgaagaaggaaaacaggctgggatcgagaggaggctgggaaagctatcagactgccaagcagatctgacccctggcagggagagagggaaagaaaggaaggttaggaaagaaaggaaggttaggaaagaaaggaagattaggtaagtaatgcccgagactgcagtgcagtctgaggaagtgttgacagagtcgatggggtgtcctcagtgcccctgtcagtcttggtgcccctgccctgtcagtcagtggctggaagcagcccccaggaagtgtgatcctgcactgtaggcagtgatggactccagcactcggctgctggggctgtgtgtctgtgatgcttacggccagcacaaggatgcggtaaaggagctggtattaggctggggctgcaaacacatatggctggaggggcaggaatgatgaaaacgagttatgtggacagtcatctacaagcagtggggattggcaaacagcagagggtgcacctctggtctgatggcttccagcatattccatgtggggctatggaacccgtggttgagacatcatctgatttttttttaagagaagccagccatgaagactttaaaaatccagtgtgtctcaactgataaaacacagcatggcccaaacacatccaagggtcctgtattaacccctttggtgacctctggaggcagtcttctgccaaggttcaagaagaaaaagctgagcaggatgctaaataagggcagagagagatgaccctgctcctcctaatctgccaacaaatgatgaaataagagaagcatgaaggtcattggggtaggaggaacataggacacagaatttaaggaggcgctcgttctcaggggtcaacaatgcactcacaggacctgaaagtgagcgcctccttaaattcgcgccttggtactttacccacctttccctcatcggcccggattggcccctcacctttgagcactctctcctccttgcacagacactggctaccaagatgccttcttttggcactttgccccactggctccttaactggcttcgcgacctccctctgggtccgttcatgtgtcgagccctgtgttctgctttttgctcatctgaaaacctccctggtgaacatcccgggaggggatgacgtcagaagccccgaggtcgacgtgttactcctgttcgtgatgtgttgtacgtgtttccacgcggcccatctggagacaatgcctcagggcagagtcaggctttgatggtgggagtttcaagctctctgtgagctctctgtggggtggctgggatgttaaaacccaaattttaccacccagacttgcggaggaagccatcctggatcctaacccagaagggattaaaggtatccaaaaggcccagagcataagtcagaaatcacattcagttcagcaaagctttgttgagcaccgactctgtgctaggcactgtgaacatacaacagaaaggagcatctgtctcatgctagaggtatttctgcgtgtgactgccttccccgccaggtcaacagtttcccagggagggacttcatctcactctcttctattgtacaccccgcctccgctccctgtggtggccttggctccaagcacagtggcatctgggctcaggaccatgcatttaactggactgatctgaatacagttagccacctgattaaaaacaccggaaaaccaggtgtgggcgcaacaaggctgtctctcagtcctgatcccaaataaggaggcagatgagactgggggacgcagggatggatgcataggaagggatcatggcggagttgtcagccaggaatcatggggctgcctgtgtgctgcaggtgccaaagagacctctctgcaagccacactccccctggcatgatctcattgggcccttcacttctcactcctatttctggagggatgttgttccctgcttctcagctgagactctgggcctgacatccagattgttttgctatgctcagacccccagaagctcctcctgaacttgatccttgaaacttgagctactatagaaaatagaataacaattaatagttattaattattgaagtatttaataaccagcaaggcaggggcaccggccaatcggaagagacacatagcacaagactggcatcttgggggcccccccagtgccagtcattcaccgctctttgctggtctgcagggagctccaagggtcatgggaaaggaggtgggtatctggactggggtgggggaatattgaatactcagggccactgagtattcaatattcttataatagatacattcacactggggatactggctagatgtcagcctcatcgcagctcacttggctatcaatcctgactgttttatgtacgtatatattttttcccaatgcacagataaacttacagagaaagaattcattgaggggacactggccaataaggaaattctgcgactgatccagtttgagcctcaaaaagtgaaggaaaagatgaagaacgcctgatgccaactgttcagctgtcctccctccacctaccactcacatgacacccgtgagcgcctgtgcacacacacacacatgcacacacacgcgcgcgcacacacacacacacacatccaccccagggccaagagaaaggcctgcacacaagcccacagcacagctccctgccaaactgaagcatctgtagtgacccactggttccttcttcctgggtcttcagcattccctcccatcatgcccggtcccacccctccctctgtccaccagcccatggccctgtgctaatcccaggattaggccataggagtcctaagtgtcaccccgctgtaagctcctttgtggagtgctgggtaagcagtttccaataaacgcaagctgagctgggcacgtggctgctggtcatccttcaactggaaaaggaaatgatttctatcagtcacacctcaaagacaaggctgtgttgcgatggcagccctaggctgggctgctttggtgcggaatgagtctaatgcggtcctgctgtcatggagctcatggtccagaggggacaatgaacctggaaggagccatgaccagtggcccaggttaccatggaaacgtgcagagcaccaggggaggacacagtggaaggggctgacttgtcaggggggatcagggaccacatccctgacgaagggagatttaaattcagaaccactgcacacgaggcgggggacggggtcggggtggggaagtctcaaacagaaggcggccaacacagagccgctgaggcatgaatgaccatctcgagttccaggagaaggtcggggtggctggagggtagaaggaggagggagagcaaagtgtgagctgaatctaaaaggtaggcgggggctggaccacgcaaagccctccctgcagcctgtggtaagcacttgggggctcaccatggggacagcggtgccactgtggagttggaagtaggaggggtttatgtttgtaagagaagtccccagcaggctaaaataagtcagagaggagcaactgggggctccctggagtcagggagcccgatgaataagcttttgcagccactcagatggcctgggccaggggaaaggcaatgggatggagaggaccagatccagtgaggacacatttaggaggtagcatccacctggctggctgagggggcaggaggagagagggcaggaatggcagccaggcctgtagcttgggcagtgggtgaatagcaatgccatctatggagatgagaaatacagagagtctttggggtttcagggaacaatgatgaattcagcttcaatatagtatgaggtgaaggcagagccatagatggccctaaagccccttgttttagagacaaggaaaaggagtcccaatgacaggaagcagcttgcccaagggcagccagctgatgagcagaggtcaggcaagggctacccaccggcccccaactgcctcctcaaagctccagggcctgggatacccaggaactccatcagtgcattctccaagatccctggatttgttgctttgaaggcccatttattctccagcctcaagttccaagatgaggtcagaaaaatgcatggataccctggattcttgactgacctgtctgcaacctcttgaggctgaggagtctctagttgctggtattgtggtgatgcctccagaccccactttagccacagagatgacacaatcaccactgccaaagagcactcctctgtgtggagagcaaacgtgagaataaacacttatgaaccgtgcaccatgctagactctgccatcattatttcattgatggagatgttattatctgcacaatacagatgaggatactgagggcaggaagtgtgagtaggagttggtacttaaactggagtccctttgattacaccagatttctccaatagttttgacctggacacagcaggatagagaactctaggattgcacaatgtcagagatggaaaggggaaggaggctacaaggcatgagtccagaggttctgggaggagaaggattattactagaatcatctacccaaggcattctcccatgtagacatagtgggctatatagaagccagttcagtgggagataaaagactctgtgggtccagtccagagtgttctaggaatataaccaaagggctcaatgctctttccaccacactccatgaatgaatctggttgcttcgaggatgaggctgggggcttttcacttctctctgaggtcagtctatcattgtcacttgagtctaaaaggacagacactgcataattaggtccttgctggtttgtggttcaatgggagagccaaagagtgaaaacctaattagtgcctctttttttagcttagggtggaaggaccacttggg

SEQ ID NO: 16979 - DNA, 67911 bp, Human
  misc_feature (1)...(67911): n = A,T,C or G
agattctgcagagcatcctgaaaacacacaggctcttgatgatgtgttagacacctcctgaataccccccagacagaatctggaatctatgtgcctgggctagacagtgatactgggttaatatcactccatctatactttgccgctggccgagtctgggcacctgtgtcctgtgctctcactggcctggtggggtgtccagtctcaagggaagaggccttactaagttccatcgctagagggcaaccagccaatgggtggggaagtcgtgtgtggcccccaactttcatcccttcagaaataaaggatgtttttgagaaaaagttgcaagagatgagatggaatattcttgcaaagcaggtattttctttaaagacagaccattttccagcatgcaacttggaagatgatctttaatgagcactcacagaacggagttgcagccacattcaatgaccaaagtccatcccttgggtactttctccctctgggtcactccatcctgctctctgccatcccagagagatgaccacgtcaattccagaggtgacaccactctgagtccatttctagggtctttgttctagttgagcttttcattgttaaggtctaaaatcttgtcacatggagtttttaagatttttagggatgtctattaagaaaagcatggctgcttttcccaactgttcagaattcattcagttgaaaagttacccaggatgagttcctatgtttgacttgaagagggaaggaaaaaataacacaaaaacaaaaccaaaaacgaagtgaaaacatgttcttcttgcctcttgctgactcactgttccaaccaatcaagacatcttccacctgggcctccaatttgggaggctgggagacattgcagggacgctgggagctggcctgggagaggtggagtaagaagttccaagcagagcctttgggaggcatggcgatgagcctgctaagaactcaccggagagggcaggggcaggacagggcaccctcccaagtacctgtgctcaagcaactctggtcagaagacctgcctatccggttctgctgtttacttgctgtgtggctttgggcaagccatccaacctctctgagcctcaatgtttctcagctgtcaaatggagaattcatcgtatcctcatggggttattgtcaggatgtgcgaaataggatggtgggttaaaagacgttgtcaatgtgagttgtggggacagcctactcctgtgctggttagtaagtgatgtatcatcaattccataaaagggtctgtcaggtgggctgagccacatgtgcttagaacaagtgggcattcaagatgagtgaatgttgcacttttcaacacactgttttgctattgtgtaggcataacctacgccgctgattgggtttttgcttcatggcctgggctgggagctgttctctcctgagctgagcaaccacctctcctgcagtctctgcataaacaggacccagaggagattttgcctttgtggttagcctcagcccagcctggacaagcttaatgccttagaaagaaataccctgcctcaaaaagacacctgcctctaaactggctcgagccccatcgccttctgccagccattcctctgtagctcgaaccccagcctgtctcagccagcttcgtgcattgagcagaaccttcagggtggagcccgctgaccgccttgttctttctcctcagcctgtcaaggaagtcccagaaagcacagctgacttagggaaggtctgggaaaaatctccctgcttttgggggggcaggggcgggggatgagccagggccgagaaggaactctgaagactccgtagattgctctagaccgcctcagacactctcggcgcagcgtggagaggatttgtgcaaacatttcctctgtggaccaagaggaatgcaagaggaggctgcctgcggtgcatcttggacggctagagagatgtacccctacttgtgaaggtgcacgaggaagatgaagctgggatcgagcagggcagggcctgggagaggaagcgcgggactcctgcctggcgtccacgagctgcccatgggcatccctgccccctgggggaccagtcctctctccttccacaggaagtgctctctctgggcccctgggaggcccttcctcactctggtcctgctggtttccatcaagcaagtaagagcagttcattattattattattatcagttgtatttcctgatttttttttaaagaagcaatttaggcctcatgtaagcaatttggaaaagagaaaacagtattaagaaaataatgagccgccataatcctagcattcaaaggtaatcactgttcatattttggcatattgtcctcaaaccttttctctatgcatttgtttttttttacaacagctgatattaggaagcataaaacatgttgtgtcctggtccccccaaccagccccgcatcatattataagcatttccccacgtcaatgtgagttctgcaaatagcatttacaattgctgcacatatccttctgtttgtcttcagtattctcccagctttgagtatttaggttgagcaaatccatttttctttttcctttcctttcctttcccttctgtttcctttttcctttcattacaaaaatgttgaacgctaattgtttttttaaaatacaattcaaagaagtgaaatgcaaactacaaatcactctacttccaacagctgcagatcatcctcattcacatttgggggcttatacttccagacatttttctaccattgtttgcatacagttttttgtttgtttgtttgtttgttttttgagatggggtctcgctctgtcgcccaggctgaagtgcagtggtgagatcttggctcactgcaacctctgcctcccgggttcaagtgattttcctgcctcagcctcctgagtagctgggattacaggtacgtgccaccacccggctaatttttgtattttagtagagatggggtttcaccatgttggccaggctggtcttgaactcctgacctcaagtgatctacccgcctcggcctcccaaagtgctgagattataggcatgagccactgtaccaggcctacatacagtttttttttttaaacaaacacaggcacatactataaatattattttgtaatctgctttcttcataacaaaatacactaataacacagctgacatcactatggagcacttgctctgcactgggttgagtgccaggtgcccccgttcctcatattttctccttctgtgttctcagcaaccctatagactgaggttctcttgttaatccccttttacagatgagtaaactgagtctcggagaagttgagcaacattcgtccatgttagtaaatgtagatccatggtataatatttaagggctttaagggtttattgtaatgtctttaactatcctctatcgttgggcatgctggtagcttgctttattctatccaagaagattagaccttcgtcctctttccaagtttccatttggatactgggctatgggcagtataaaaggatgatgggaaggaaccccagttccacttgtctgaataacgaaagtagcttaaggaatggctcagactgggcacggtagctcacgcctgtaaccccaacactttgggaggctgaggtgggcagatcacaaggtcaggagttcaagtccggcctggccaacgtggtgaaaccccgtctgtactaaaaaatacaaaaattatctgggcatggtggtgtgtgcctgtaatgccagttgctcaggaggctgaggcaggagaattgcttgaacctggaggtggaggttgcagtgagccaagatcacgccattgcactccagtctgggcagtagagtgaggatctgtctcaaaaaaaaaaaaaaaaaaaaggaatggctgtcttcctccttcgttccatgggcagggtgagtccctgttcatggtcttggaattctaaacccctccaatccccatgtagggcaggctgtggtaccaggtctcatgagggttcacctcaggctttctttgttgcaagcctggggctagacaggcagataacccctgccagatttcctacatccaggttcccctagaggctgccttcaggccctcatggattgtaaatgtgagcccaatcaatggtttcatggaattcttgccatcttggcagcctctcccccagtgaccagaacatccttcaggaaggtggccctggcctgcctctggtcccaggacttcaatgtgttagtggtgggaccatttggtgggagggttggttcagaacattcatccttgcttccattctctggatatctcatatcaacactgagtgagtgtatccagcttatcatgtagttttgttcacaaatgtggattgctgaccacatgccaagccctgagacagcgctcaggatattatcataaaatgcttcctcacacatcatcttacttaatcctcaacacaagcctctgagaagagtgttattactgagccccttttacagatgggcaaattaagcttcagaggagttaaatggttgcgttcgatgctgtagctcctgagcactgtagccgttgtgcctacccggggtgtttgaagccctgtgttttttcttccggagtgctcttgggagttgctgatgtatgaatatttatgttacaacagcggaatctgcagagcctcgggccggcttaccaggctgagaaagccacaccttgaccctttcagtctggtatttttataatcaataacatgtctgctggcagtgtctgcttccactctctgccacccagtctgcgttttcagagcatttctggctgtctgtcctccgggtgtgtctgtaattctgatggccttactcttggttctccatcttaaccccatattccttttctagatgtttatattacaaggctttgtgaagactttcatgataaattctgctcatagcctctttccctgcatggaatataaatgactgtggtgtgtgttctggcaggaagtcttcaaaaatttcacttaatgagaaattctcagggatagtttagtttctaaattcaagcagggaggtagtgttatccccacaccactctctcccacactcgtttaagttatttagcagttgctttggcatcaaaaacataaactatctaaggatttttgagaagtacattgcggcccttttatacatggatggcaggagggtaaaatggtgcatatttaaaatttttaatttttttttttttttggtgagggtagacagtttggcagtcaaaaacctttaaaactatgtgcattctgtgacccagaaattcaaattcaaagaatttctaagaaataaagatgtgctctcaaatgttcaactatgaggattttaatcacagcatcatttacgtcagcaaacatcttaaaacaacataggcattcaacgctagaggatttaaaaactaaattatatcactttttttcatagaatgttatgtagctgttaaaaggatgctttacttcatttattatttatttcttgaaatggaaatatattcacaatattggtcttctaatgaaacataaaaggctttgaaacaagattattccctttgaagtcacaataaaaaagaaaagaaagacaatgaatgtgtctttcattcacagagagaagaatctggaagtagatggtaatttctgagtaatgagatgataatttcaccttctcccctttttgcatagctgtgatttctatttcatctacagtgaagtgtattccttctctaacaaagaaaaacagatttatttaaagagagtcagtataaggatttttctttccttttccttaatcccttctcggccaagttcgttgctgatgctggttgcctatgcaagggaaaaggaatcaaggtcaagctggacttttccagttggaaaaaaattcacccgtatatcttctttcctcatgactttgggaatctggctgtgattgaacttggatgtaccccttgtgttttttatgtctttagggcaagggaagacagtctgagtttgtccagctctcctagactgacaaaattcagtactttttagttttagtttgtttttctgcttttgactatggccattggccatggcaaagaatggaggataggggaacattactccagaggctgattttattgtctcttccttaatcaggtcccggagaggtccctggggtcataaatagtactttgtccaccaatggatcttacactgatgacttggaggattctagaagcttattatttggttagcaactcatctgctgaatttgtaaaaatgatttagagtcagttatggtgccattaaagatgtttacttctttaaacaatatgttaataacttacatgcttcctcttgggccgtaactcagagagagatattaatagagattccaaactcataggaaactgaaatcaagggataaatgccaattattgtatcattattattacttattggataattgcatgattctcaaactgtgtgcttgtataccccagggcaccactgtgaactcacaggggtgctatgagatattttaatttttcaagggaagtacagtgatatgtagcattttccagacaccatgcaaactactagcttaaggtattcatggtgttaacattagatctcaccccctcccttttgatgatgttgtctctttgcaaagctgggttttccacaggtcctgtgattacaaagcaagtatagcacaaaaatcagtgtggaacaggaaataaaggtggtggcatccgatctgatcctaaagcttgagaagttgtgcaatggacagcaggcactaagctgttaaggcataaatatttattaagttgtttggacttacttacttaataagtggggctttagatatatcttttggcctagaagtgctgtggaaaaattactgagtcaataagtttgggaactgctggtctagtgatgaccacactagctcttcttcaaaaagtcggctgtgtgattgttgctgcactccctactggtataccagtcctacctcattcttttgggataaccttaaatctacctggccctagaaaacatttgagcttgttgccccttgtgagaagagagaaaaccttaaagccaaatgattaactgggtgatattagcccagatcatttactgaacccttcctcatcctccgtctcacaagtgagcctctggaaatgaaggacagcaagagcattaactccagccctgtgctgggggcttgtattcagagatgaaagacacctctcagtcctcaaggagcttatgggatagggaggaagatggataagtggcccaccaatgacattgcagtgtgatgggccatagggatcggtcatgcaggggaagggtgacaagctcaagactcagggagatgagtggttaagtgtggccaagggtctctaggcttgagttgggccttgaaggatgactaggagttcaccaggtgaaaatgagggcagaagcgagtgccaatgggaagtgcaaggatgagaagtcatgaaggagcacgacttgggacaaggatggctgagatgctaaatcctgagaccacaggccttaagtggaagactgtaggcaggagagccctgtgctcagctctggcctgttctcctgtcactgtggagcagtgtggagggtggatggtggcaccaggccagaggaggaaaggaagacagggttggacaggagagacgttaaggaggtggggtcgatggaacctggacaaggggaagggagctgctgtggacgactcctggtttcaggtttctaatggagagaactgagccacacttggcatcgtagggatgccaaagacgacagaccagaatgcccttggccttgcatgccagccagttatatagctgccgtctctagaacagattctaagtcctttttagggtaggggctgtgtctcgctcatctctgtatcctctttaattcctccttaacacaaggcctggcccacaataggtgcctgatgaacaatagaagagaaagccctttttaaaatcaaaagaagcccaggtatagtggctcatgcctgtaatcctagcactttgagaggccaaggcaggaggatcatttgagcccaggaatttgagaccagcctgggaaatgtagcgaaatcctgtctctacaaaaaatacaaaaatgagggcccagtgcagtggttcatgcctgtaatcctagcactttgggaggctgaggagggcggatcacaaggtcaggagttcgagaccaagctgatcaacgtggtgaaaccctgtctctactaaaaatacaaaaattagccagccacgcctgtaatttcacctactcaggaggtgaggcaggagaatcgcttgaacccaggaggcggaggttgcagtgagctgagataacgccactgcactccagcctgggtgacagagggagactccatctaaacaacaacaacaaaaaaacttagccgagcatgggggcatgtgcctgtagtcccagctactcaggatgctgaggtgcgaggatcacttgagcctaggaggcaggggttgcagtgagcggagattgtcccatcacactctagcctgggcaacagagtgaggagaacttgtctcaaaaaagtaaataaataaaataaaaataaaatcaaaagaagtggtacaggtacacaactagaagctgttacacagcccagttatctggaaagcccaaaacgtgctatatttccaaggttcagtggcatgaaatagtcaacgttagaaaggaaaaaactcccaactcctcagtagcttgatgaagtctctcagacacttctctttgtactgaacccacttccgaattgacttctcaagaatagatccgggccaggcgcggtggctcacacctgtaatcccagcactttgggaagctgaggtgggcagatcacgaggtcaggagatcaagaccatcctgcccaacatggtgaaaacccatcgctactaaaaatacaaaaaaattagctgagcacggtggtgcgcacctgtagtcccagctactcggggaggctgaggcaggagaatcgcttgaacccaggaggcagaggttgcagtgagttgagatcgcaccattgcactccagcctggtaacagattaagactctgtcttaaaaaaaaaaaagaaagaaagaaagaaagaaaagatcctataacctgagcagaaaaaatcatggtcacctccagagcagagaatctgtctactcagagcctttgagcctttgactttggacctgcagatacctgggcaatgcaggcttctgcaatcctctggtccttctgtcacattgttgcgtcttagtgtgatgcgtctctctttgggatctacgtagtcttagaagcatgcaactattcatgtgggaggatgcaaaagtttaggataagaattttgcgtactcttgaaatgtcaacttcacttaaaggtttttaattttttttcatatttgtattaaagccaatatgattaggttatggagtgaatgtaaaatttgtatgtactcttaagatagaacataagatgctgaagaaatgccatttctttgctgtgggccattgtgggcacttcagtgggaaggttggagaatcatggtgtgaagtgacaacaaggccacatctgtgcttggtcactgggggtgaccatgtttttgtttgctcaggttacaggatccctccttgaggaaacgactcggaagtgggctcagtacaaacaggcatgtctgagagacttactcaaggaaccttctggtaagcatgtgtattagttatccgtggctgtgtaacaaattgccccaaagcttagcggctcaaaacaataactagtcacttattacttctcatagtttctgtgggtgaggaattcagacagggcacactggggatggcttgtttccgctctgtaatgtctagagtttagctggaagactcccatggcctctacacttggccggggcttccatacagcatgatggtggggtctctaagggcctgcctgaccagaggccagactgccttttatgacttggccttggaagtcatacaagatcactttggccatgttcaactggtcagacagctacaaagctctactcaggctaacagtacagaaacacagaccccatgccccactgtaaggaaacatatgaaaccacatgtatgtggatgtggccgtctttgataaaagccatctgccatggcacactcatcacctgatcatatgacatgattatctgctgtagattagcctgggaatctgttaaaggaatgggggtggggggcgcgggtctcccatctcccagggcattaactaaatctgaatagtaacatttctcttatccaagcatacactaagttcagaacattctagcgaatatgtaattgttgtctgcaggctgactcttcgggtgcagccacgtgcaccatgcccacctccaaaagaaaaaaagaagaaagtaccttggcccgttgcctctgagcctactgaggacaatccccggctccggctgctttcagatcattttattcagaggccttgagattgacaggacactgtgaactctccctgtctttcttcacccaaaggcagtcccaggcttcaagcccttcccagctccctttgaagacctcatgggcccaggcaggtggtagtcaagccttgagatcagctgcaggaaccacctctcgctttggagaacactgctttctgaggtcaaggtaaggcaggctttcatccagagccatgccatgcacagctcaggtgagcactgccttacccagaccaggtgctgacacctggcagccaggtcgacatggtgtcccaagccagctcataacctagcaccatggtgtttctaagatttcaatgccagaaacctggccttttttttttttttttttttttgagacagagtctcactctgttgccaagctggagtgcagtggcgcgatctcagctcactacaacctccaactccctggttcaagagattctcctgcctcagcctcctgagtagctgggattacaggcgcccgccaccactcccagctaatttttgtatttttagcagagacggggtttcaccatgttggccaggatggtctcgatcccctgacctcgtgatccagaatcctggccattttagcctaatagggagcagatggtggggaatgatgcttggcttccaggagtcaggagcctgtaatattagaagtttgggacctagtctgaaatacttccacttgattccaggaggcccataaggtggagttttaaggttgttgcttcccattgccaaacaccagggtaaatcatcccctgagatggtccaagtatctaataatgatcattgaattagtgctcaaatggagagatatggcaaatggagagatatgactatatagtacttgtgttggttatgtgtgaccaaggaccttgatcttgatcctccgtattccgctggtcgttttgtacattcacagagtaagtgtgccctgggatctaattggtgaaggtttgatgattatttagctgattgtggaacataaggcactggctcagcctccaagagtcctcctgtccccaagtttctgtgaaagtttagttcatgtcggtggctgggcatggtgtctcatgcctataatcccagcactttgggaagccgaggtgggcagctaacttgaagtcaggagttcgagaccagcctggccaacatagtgaaactgtctctactaaaaatacaaaaattagctgggcatggtggcacatgcctgtagtcctagctactcgggaggctgaggcaggagagtcgcttgagcctgggacgtggaggttgcagtgagctgagatcacgccattgtactccagcctgggcaatacagtgagactccatctccaaaaaaaaaaaaaaaaaaaaagaaagaaagaaagtttagttcatgtcaaataaagcaaaatcagcatgatgtgtacattgacgtaattgaccggaggtcaagttgggcagacgaatgcacattctttgggactgcattcagcattcctgtggtccccaaatcattccccatccttgactcatctagagagtggggcacccatgctggtttctgcacaggttacaccagcttccagtgccaggaaggtgggctcccacggtgcctctgcctccatcagtggcatccctgtgctaaaacactgatgtttatcagacccttcttctctctgtaggcatattttgtaacgggacatttgatcagtacgtgtgttggcctcattcttctcctggaaatgtctctgtaccctgcccttcatacttaccttggtggagtgaaggtaataagtcttatttttaccaattttccccaaccaagtgcttttctgaagtcctcttcccccacaaacagtccccgtctaagctctcagtaatacatcttccttctgtaatttttctattcctggatgttccatttatttttatgtatgtatgtatatatttatttttatttatctttgtggttacatagtaggtgtatatatttgtggggtacatgagatgttttgatacaggcatgcaatgtgaataagcatggagaatggggtatccatcccctcaagcatttatcttttcagttacaaacaatccaattacactccttagttatttcaaaatggacgatcaagttattattattattattattattactattatatatctattttttgagatggaatctcgctctgtcgcccaggctggagtgtggtggcgcgatctcagctcactgcaacctccgcctcccaggttcaagcgattctcctgcctcagcctcccgagtagctgtgactacaggcacccacccccaccacactcggctaatttttttgtatttttagtagagacgggatttcaccgtgttagccaggatggtctcagtctcctgacctcaggtgatccacccgcctccgcctcccaaagtgctgggattacaggcgtgagcactgcgcctggccgattaagttattattgactatcatcaccagttgtgctatcaaagagtagctcttattcattctttctattttttgtacccatcatccctccccacctccactgtcccagccgcccactacccttcccagcctctggcaaccatccttctactctctatgtccatgagttcaattgttttgatttttagatcttacaaataagtagctctcgtactttgaagcttctagagtacagatccagcagccactaaatttggctgcagtgggggtaagaatggccactgtcatggagaggagaaacaggtgggggagaaagattgggatgctaacctccacacaatttttgggttgttagatggggaagaaggattttcaaagaaccctttgcattcacattgaaaggaggtgccaataggttagtgtttttaactcccatgggacttggatggagaatttaaccacttagcttgctctgatgctgtttcaaggaagtaaacattacttagatacccaggataatatcccatccctaccagccccagaagcccaacctcttggttattttattctgaaagaggagagaggtgattactggttagattcctgttgccttttaccacagaccaccagcaaatacaaggacaactaaaactgttctcaggaaagataagtggttacaagctccaggcaaaacaaggtgagaaccagcttctgagagggtaagatgatagccttttgtatttaatttcagcccgataaatcatcccatcgtgcaactttagtttcaatgttttgcgcctctagagcagagagagagagagtgtttagaaggaagatacatttctgggtgggagagttagtgacctattttatggaagtgttctctgatgaaatccagttggaatcatcccaagaagcatgagaatgtgagattttagggagggtggaagagataactcgctggatcggaggactctgaatgactcaggcacagtacccctgggagcagctcagtgagggaaaagagcactgggtgtggagtcaggagccccgaggtcagacccagtccctctgttttacactttggagactttgggcaaattcccacagccccctgagcttccacttcctcatctatgaagggaaggagagttgctaattctgaaggtcactccgaggagtcaatgagaaggcactcacagggtgcgtcgcacagctgccgcttggtccgcgggagctgaagctgaatccagggaggagccccttggattccttcaagtctagaggccccaaacacctggacttctcagtagcatgtggagccgatccctacttctctgctcactgtctacctgtccctctctgctcactgtctacctgtccctttccaagagctaaaaacacagatccattccactgtaagagaaaatgaagtgttcaaaaagccacatttacaaagaagttaaattaaagcctctttaaaaaaaaaataggttttgggcttctggaatgtgaagggagtgtgatttgcaagaggtgggaagttactcttccacccgccattctgtgcattaaatctttagaatccaaatggatccctgcagtgaagagaatgtggagaccgtggaagggcgcagaggagaacatgtgcaaatgcacagagtggaggagagtccctgtgagatgggagagaggaaggagcttggtaatatcagaagagggagcgcctggcgcctgtagtcccagctactccggaggctgaggcaggagaatggcgtgaacccgggaggcggagcctgcagtgagcccacattgcaccactgagcgcctgatggcaaacagaagctgtaactgacgactgaggctgggggctgatgacgaaggaagctgggtgttagtcactagggtttcaagctttcttctgtagaggaagattatgtggagtcccagaaggtgttaaggcataaaaatggagcacaagttgtagtctgggagaatgacattgagagcatgcagctattggacacaggaatggaggaaccaaggaggagagtggggaaactactgcagtgtcccagaaaacagcatgctaagggtctggattctggcaagggcaagagggcagagagaaggagaaagattaaagtgttggaggcagaatgctcaagacttgtcatcaattggagtagaaactgagggacagggaggagtagaaaatggaggagaggaaaacaaactcctcttccttctcctcctcctccttctccccctctcttccccatctaaggaatggtctcagggtccacctggccccacccaagcccacatctcaaccagtgggtagccaggtcttccatctcctcctcccctccatccctcactgctgtgggctcaccagcaccctctgctgcttctccatggcctcctctccagtccctgcctcagatctggccccctccaggcacctttggaaaagctttctaaaatatcattcacattctgtctccccagcatcacgactcctacaaatggcatgcaagacctcctgctgcctggccctgctgacctcgttagcactctcccccacgttcagggttccctgcactccagcccaatgagcaactcccaggctctgcacctggtccagctcttgccactcagtaccttggctcgcacacctgcccaggaggcctcctcacaggctctggccatgctcctctgcctataaagccccttgtaattctcagctcaatcctttcctccttctagaagatttctcagacctctcccctcaactacagacctctcccctctgcctttctgaagcctctttttttttttttttggagacagagtcttgctctgttgcccaggctggagtgtgccgatcttggctcactgcaacctctgcctcctgggctcaaacaattctcctgcctcagcctcccaagtagctgggattacaggcacacatcaccataccaagctaatttgtgtatttttaatagagacagggtttcactatgttggccaggctggtctcgaacttctgacctcgtgaacctcccgccttggcctcccaaaatgctgggattacaggcgtgagccaccgcacccggcctctgaggcctcttctatacctgtgcagtcttctgtcttagcatttataatcgtttacggcgatttttctttgcactcccccagccagagctgagccctatttgtatctttgcattcccagcacaaagcattatggctagtacagacaatgcaagtgtcaagtgacattcttaccattcactcattcaactaatatttatgaagcacctgttgtatgccatgcattatttttaagtgcttgggatatattagtgacaaaaaccgagtaagatctctctcctcgtggggcttacattcttgcaggagagacagacaattatcaataagcatcataaataagtgcagactatgtttgaatgtgatctatgttaaacaagatggggaagggaagggatgggatggttggagtggggtgatgtgttgcacctgtaaactgggtagttaaggaagtcttcgatggcaaggtgacattttggtgaagatgtagaaaaggtaaaggttttagagggagggtgttcaggagggaaggagacagcaggtcaatggcgctctatgcggggaccatgcctggcctgttccatgaagagaagtaggcagatgtggctgtggtgaagaggggagagaagcaacaggttacaacagagagttacgggccagatcttagggggcttcgtgaaaggccagaagactttttctcagaaagcccttggaagatttggagagaagcatgacatgatgtggctaatttttttttttttttttttgagacagagtctccctctgtcacccaggctagaatgcaatggcgtgatctcagctcactgcaacctctgcctcccaggttcaagcaattctcctgcctcagcctccctagtagctgggactacaggagctcgctaccatgcctagctaattttttttttttttttgtatttttagtagagacagggtttcaccatgttggccaggctggtctcgaactcctgacctcaggtgatccacccacctcgacctcccaaagtgctggggttacaggcgtgagccaccacgcctggcctgtgtggctgatattttattcagcttgctctgactgctgggttgcccacagatgtgaggggcaggactgtcagaggagtcccatctcccggtgggaggtgatggttccacaggatggaagcaggaggtgaaagtggcagtcagattctgggtacagatgaaggcagggatgacagattagctagaggacctgaggaaggctatgagagacagaaggggagggtgactctgaagtttagggccgggggattggaaggacgggtttgccatccactgaggtggtaaaataggtgggtggagcagattttgaaaagaagaaaaagggtgtggtttggagtgtgttgtttgagatgtcaattagacaccctacctagcaaagctgtcaggggagtagggggctataccctttggttgtccattcattgaattcagcatatagttactgttggcccatgatatgcagggccaggactaggaaggaccaacagatttcgacttctcgtttgcaagctcagcctctaatcctccaggtggaggaccttctgggagagtctcctgggatagatgtgactgagtcacaatggcagtctgtatgggcagagggatttttctcatcattttcacatacactttcatttaatcctttcccaaatcatggagagttggtaccaattattatccccagttcctgatgaaaacagaggaaggcttagaggttaggagagctaggcccaggacacactcatgcatggatggcgcatccggcttcagccccagtctgtcagccacgtgcccaccactttctcttctgcatggcatgagcctcaggaagagatgccccacctagcaagcatcaggagcccagattggcatctcccagctgggctgaaccttggagggcttataacatcactgagtcaccagaggctgttctaactccagagactttgggtaaacacagcagacattagcagaccatggtgtgttacaaaattgagaagcttccatgttttcctttccatcccaaataaacagtgaggatgttaatgagcccccaaaaggggaaatgaaaatcccttctccctgggattttccacagctctgtggcatgctcaggggaacgggctgtgtgttctgacctttcctccagagctttgtttactttcagagagctcaggaagggcctacagacactgcttggctcaggggacttggcagacgatagagaacgccacggatatttggcaggatgactccgaatgctccgagaaccacagcttcaagcaaaacgtgagtttgctcagctcagtgaggaggcatccagggtccaaaccaccctccttcgggacaccccagtggcctgctggctccaggggccacacaaagaggcttctccagcgcctctccccggggaagctaaggaaggtcccgcaaagcagcaacccttgtggcggccatggaatttcttccactactaggctgacatgcaaaatcctaagagaagtcagtcttccaggattgatcctggcatttgtgcttgctgttccccgtgcctggagcacctgtcccagctcccctgtggctggctccttctcaccatccagggttcagtccaaatatctccttcaaagagagatcttccagggtcacctaatccagagagtgccctctatggttgccacatccccccgacccaccacccaccaccccccacttcgactcctttatggcacctgcccctccctgaaattctcactgttgcttatttgttatctagccctctcatcagaatgtagatccactggtgacaggggacttgtgtgcctcgagggagtggcatagcacagggtctagggtcaggcagccctatttccattccaaatagtaagaatgttaataagcccccaaaaggggaaacgaaacgtcccttatccttgggattttccacagctctgtggcatgctcagaggaacagtctgtgtattcatatccagactctgctcttcccggctgtgaacctggtgcaagttacctcatcttcttgggcctctgcttcctcattcatgccacagggatcatatttgctacatgtgacgttgtgaggatttagtcatcagacatcagtttcttaggagaaaacctggtacacggtcagcatggtctatgcaggcactcctgccctatccccagggtctaccacagtaactggtccgcaagtccccatggcttcccaggaaaggttttttggatgaacaaacaaatccatgcttcagacttctctccacatgtgttctttccagaatccttctgcaccatactttctcgttggactcttgctcttctccctgaggacctcctgtttgtccaacatctgctcactttccttcaaagtgcaatgcaagaggctgcacaaagcggaggaacaggtgtttggggatcagacagatatctacggccacaccttggtttctttcattccgatggtcaggccacaaacagtaatgaagcatatacgatgggttaggtttttgcaccaggcactgggaataaacaggggatagcacgtggatactgcctccagggagctcagagtcttgtgaggcatagggacagtgtgatcgttgctgggagggaagtgtcagatgcccagggtcatggaggatggggaaactgatgcagacaggggaccaggaaggctgctcaagcctagccctgcagggtgagaaggagatggccatagtaagagagagagcaaaagggagaaacacacctagggtcaaagagctcacggggctctggggccaccttgagtgctgctgggcaggtgaggtagggcctgaggaggacacaggtggaggtagaggcctcgggagaggtaggtggtgaaggcctcctgtgcccggtgaaggacttaggactttgtatattgaagtaggagagggacataactaacttatgtgttgacagatttgtcctggcagattggagaggagtgaacttgtcaacacatgagttagttatggagatcggagactggggccatgctggaggcagaaggcagggacaacaggcaggaaccgtggcagcaactcaggccggataggaagagagcgcccaggggtggaagaagagggagggtggactcataggtttaccgaggagcaaaacggtaggacctggctggtgctggaggctgtgagagggtagagccaaggacaacaagatcgcaggcttctggcttggacccttgaggagacttaaaaatgcccctccctgagaaggatacagggagaggccttgccctttggattctcaatattttactacctaattctttttttttttttttttttttttttttgtgaggcagagtctcgctctgtcacctaggctggagtgcaatggcatgatcttggctcactgcaacctctgcctcccgggttcaagcaattctcctgcctcagcctcccaagtacctgggactacaggtgcgtgccaccacgcccgtctaatttttatatctttagtagagacggggtttcaccatgttgtccaggctggtctcgaactcctgacctcaggtgatccacccgccttggcctcccaaagtgctgggattacaggcatgggccaccgtgcctggtcctttctacctaattctgtgccctaatttgaacctgcaaaacacccccactctccgccactcccaagttgtggctttttttttttttgagatagagtctgtctctgttccccagggtggagtgcagtgacgcgatcatggcccaccacagcctccaccttccaggctcaagtgatcctcccacctcagcctcctgagtagctgggactacaggtgcacaccaccacatctggtattttttgtagagacagggtttcaccatattgcccaggctgaattgtggctttatttcatgatttagttggaattctttagctctctaaagtcatttaaatattatcccattaaatgttaaagatattctatacaataaagtctggggacaggggaaggcaaggagttcagttttagaaacactattcttgtcacgggagccacctagcctctctgcaggcatcgtaagatggggttgaaaatacccgctttgcaggcttagttgtgaggcttcagagggcaatgaatgtggagtgattcatccacctcctggcacacaataggcatttgatagttgtgattattgcgtttcttttcttttcagactatcttccctggaccctacaaacacttctctccctccctggcctctctggttcagtcctagggctgtgatcatagttcacttgtcattgtgagttttttggtgtctgtgatggtagcttttctgcattggctatttggttggatttatgtgtgtgtgtgcgtgtgtgtgtgtgtgtgtgtgtgtgtaatatttcatttgactttcaaaagccaaaaacctagctttttgttaagttattaaggtcaatgctatttcatatagttttttattctatttataaatctagtaagttagtctactttcgtagaggtctctgattaatttttgttgacacaaacaagttatttacatatccttttacattttaagctgcgctattacatttgatatgctttagacatttaaactatgttaaataattgttataataagaaaatctttcttattttaaaataattctagttcatcgaatacatcaactttatatgttgagtcttaaattttcctaaatatgtcaatactgttttcatcacggtttcaacttaaagttgaaaatcaagtacgctttgatgtatttcatattggaagcttaatactaacctattaggtcctctaatatgtcatattctctaaataataccaattgcatacagattgtgcaagtaatttaaaaaactgctatatgagggatagaccaaggggtagatatggggcgataccacataaagtttaatgtttgttagaggccagctgcagtagctcaggcctgtaatcccagcgctttgggaagctgaagtgggagggttgctggagcccaggagtttgagatcagcctgggcaacacggcgaaaccccatctctaaaaaatcaatacaaaaattagctgggcatggtggtgtgcacctgtagtcccagctacttgggaggctgatgtgggaggatcacttaagccccaggaggttgagactgtaatgagctacgattgtgccactgcactccagctttggtgacagagtgagactctgtctcaaaaaacaacgaacaaacaaaaaacagtttaatgttagaatctaagtggtggatatacagatgttctttataaagtttctttaactttggtgtatgtttgaaattttcataataaatattgaggacaaataaaaaaattctatacctgaatttaacacaaaacattaatcaatgtagtggtgcgatcaaaccttgccaagattaagacacaaaacaaacactttcacactaaggagacaaactggtccaagaaagtaggggtttccatctcaggagacatggttgcctgtagaccaagatttgtttgttctggttgtcaataccagtggtgtaggtgtgttagtaaatgttaacaacaggctccctgcttccactcctgaagaaagaaaggctaggatttgttaacacttgccaattttggtggcattaatgccccccatggccaatttcaagctaccagtgtgaccgcagaggatgcacagtagcgcagcgttagacatgtttctcctcatgcagatacaacagcaaaaataaccccagtggcactgaacacagacatgtagaaatgtaattaggaagtgatgaatttggagtatttattgcttttattctgaatataatttattcattgtaaatttacatcatttaatttttttttcttttttttttgaaacggagtttcgctcttgttgcccaagctggaatgcagtggcacgatctcggctcactgcaacctccgccttccggtttcaagcgattcttctgcctcagcctccagagtagctgggactacaggggcacgctgccacacccggcaattttttgtatttttagtggagacggggtttcaccatgttggccaggctggtctcgaatgcctgacctcgtgatctgtccgcctcagcctcccaaagtgctgggattacaggtgtgagccaccgcgcccggccatcgtttaatttttaagaatgctcatgttttgcaactggttccctgaaaatttgccaatcagttctcacaagccaggatgaccgtaccactgggtctaccagggtgacttttttcactcttgccaacaagttgagccccaggttcatgtccattagagaaggctgatcgtattcaggttctacacgtttcataaactagctatttggtctaacaggagccatctggttcgggctctgttccttcagagcctcgtgggtgttggcatgtccttggctcccttaagtgtatcctaatcttccatcaaggcgcagtggctcataagtatgatcccagtgctttgggaggctgaggcgggagggctgcttgaggccaggagtttgagaccagcctgctcaacatagcaagattccatgtctaatcttccatcagacgtgaagaaccttcaactggatactccacatcctcagggaattctgtctaaacctcttactttcctactggatttgagttaacagaatcctgtgatccttatacagttttactgtgtgagatatcacacctcttaaagggatcagaaggacacctgtagttggattagatccggtttatctcaagaatttgtctgacttttttcacatcaaagttgtgctaatggcatgccttgaattaggcaaactgtgtattttttttctcctgggcttcaaactgtttgagaacaacaacaaagtcacagttatatttgactatcacccccaaacctctgacctagtactgaggtgcacagtggcctttgcatacagtaggcacttaataaatactacatgaatggcttcacaaattctgagccaattggtctgtaggggggtccagccatcaatactagttccaaagttccccagatgattctaatatgcagccaaggttgagaaccacaagtgtgcggacacagtagcaccatccccaagtcagcaaatggggagcgctaagcaagatttgaaaactgcgctttcaaaaacaggaagtaaagatttctctcttcggaaaagtgaggacaagagcattgcctcctcccctctgcaaatggccatatttccaagaattcaaatacttaacaaaaaaaacaacttctggccatgtttacctgtgtttctaatagagggttgaaattttgcccaaaaaaggccagtgttagtaaatctttgcccttcagagttttggcaaacaaaatatgttatgttcttccaactaacgagatgctgggggtccttatgcatgttaaatggcacttttaaaggagattgtgtgtgtgtgtgtgtgtgtgtgtgtgtgcgctcacataagcattaacaagtgtgtttagatgacttagtatggaattgcgtttaatggaatgaaaataaattattatgccttactttgtcctttaaaaagtgcgtctattcttaaatacataatttaattaatacatacatatgaattgatatatctgtatataattttaatatatggcatataattttaataatacgtttaaaattttaatataatttataatatatccattgattatatatgatttttccaacattttattttgaaatattgaaacatatagaaaaattaaaagaataatatagtagacactcatatacccagtatttagattcaaaatgtaataacattttgccacatttgctttctctctgtttctttctgaaatattcaaaactaatttgtagacatcatgagatttcacccctaaattcatcgggtacctcctaagattaaggacatcattctacacaactacattaccattatttcaaccaagtaaaattaacagtgatttttatcacatggcctatttcatccatatttaatattttttccaattgttttcccaaacttttatagcttttctgccctagaaatatttctctctctttcttacagctggatagtatttcacttagcatatccaccagtttgttcagccactgtcctatgaccatctgggttatttccaatctttttctctttctttttttttttttttttttttttgagacagagtcttgctctgtcgcccaggctggagtgcagtggcgtgatctcggctcactgccagctccgcctcctgggttcacgccattctcctgcctcagcctcccgagtagctgggactacaggcgcccgccaccacgctcggctaatttttttgtatttttagtagagacagtgtttcaccatattagccaggatggtcttgatctcctgacctcgtgatccacccacctcggcctcccaaagtgctgggattacaggcatgagccactgcgcccagcctatttccaatattttattcctaaaactgccacagtgaataatctcagatgtttatgttggcttatatttgtggcagtatatcttttggaagatttctagaagtgggatcactggattaaaggcaggtgcatatataattttgttagacattgccatcggggttatacatttgtcctcccttcaactatgtatgagagtacctgtttcctcgttgggtgcgtatcacatattggttaggaagcttctcataaaggtgtctaagtgacataagattcacctgttggtactaagcgtgagctggagacctgatgttttggagcctctaggaaagtagccaggttttgttagagaccttaatgtagaggacagttgaacaaaatcctgtaaaaaagtacaattaaaccaactgtagcaggtgctcttggcgccctgcccgtatccctttgccctaatcaattcagtacacagctgcttaacttcttaccacaagtgcatgcatttctttgctggttctctggttcctgaagcccacttgttcgttgaaatgcaggccataagtgccatgaaattaatgtgccttggaagtcaccttcaatcgatgactggcaagatttggtatgtttctataccaactcccttggtcttggggttagttgactctgaggattccagagcttccccagtgggattaagctccagcttcccaccatggtagctggcttgataacccatgctttatttgtgctaagtgctcccttaccctaccgatgattttttcacttttttttttttttttgagccgggatctctctctctctcacccaggctggagtgcaatggtgcaatattggctcactgcaacctccacctccagggttccagtgattctcctgcctcagcctcctgagtagctgggaatacaggcgcacaccaccatgcccagctaatttttgtatttttagtagagatggggtttgccatgttggccaggttggtctcgaactcctgaactcaggtgatcctcctgcctgggcctcccaaagtgctgggattacaggcttgtgaagcaccatgcccagctgatttttttttcactttctatgcaagctgcctgcattccaattcttgtctcaggatctgcttcttggaaacccaaactaattaggacacagacaaaaaaaagacatgtcccctaatttgttcctagaaagcacaaaacacacacgtgttttaaaaatcataatttagaaacaaatagttaggttatttaattaaatgtgttagcctcatatctccaataaaataaatcatgctattcgacccagtaatgtcttgatatgccacagaaatagtcaatttaaagaaactacaccactctgtgtgcagaagcacaaaacacttctttactttcaaggtgtttcatagtctatctggaaagacaagatgaatgaaagcaaagcattattgaataatacaattgacaccctatttgtgaaacaaaccacaagtactttgacaataagagttgacaataagcagagagacatttgaggaggatttcttatagggggtaggtttgtgctggtcttagagggaaagacttagtttcaaggagaggcaaacaagcacagttggagactgacaagattgtagggatctagatgaagtccatagagaataattctagagagaaacgtggttgggattgatctggaagagctcaaagtctacaccgagagttctgcctccagaccaccactgcaaaaaatgataacagagaaagaaaaaaacatacgacatagacattttaatctacaaaaaggaatgaagaacactagaaatagtacatataaaggtaaatttttatctcatttaaaaaatgttctaaaaagagaaataaatttagtttttaaaatcacacaaaatatattagaaatcaaaaacagtaagttgtttggaaaattccccaaatattaaaaaaaaaataacaacatacttctaaataacccataagtcaagtaaaaaagtataaaataaattagtaaatattttaactaaataaagacaaaaatacaatatgccaataattttgtgatgcaaccaaagcagtcatggagagaaatgtatagcatttgtttttttttttgtttttttttttactttaagttctgggatacatgtgcagaacgggcaggtttgttacataagtatacatgtgccatggtggtttgctgcacccatcaacccatcatctaggttttaagccccacatgcattaggtatttgctgtaatgctctctctccccttggccccaaccccctgacaggcccccgtgtgtgatgttcccctctctgtgtccatgtgttctcattgtttaacttccacttatgagtgaggacgtgtggtatttggttttctgttcctgtgttagtttgctgagaatgatggcttccagtttcatccatgcccctgcaaaggacatgaactcattcttttttatggctgcatagtattccatggtgtatatgtgccacattttctttatccaatctatagcattcttatattagaaaattggaaaaatatcaagtcagtggcctaactgccatcttaagaaactaggaaaaaaacctcagcaaattaaactcaaagtaagcaaaagaaaagaattacaaagtatgaatagaatttaattaaatggaaaacggaaagacaatatgaaaataaataaataaaacccaaacttggttatttaatcttggtgttgatggttttgagtcttttccattctggtttgatttttgtgcatttttgcctggagtgtttcatagatttctccactgctgctttttcttcagtttcctcatcaaaatcatcatcttcttcaacatcatcatcttcatcatcatcatcatcttctccatcagcaggaagttttaattttttctgtggaaacttgctaccacttccaggggcagattactttccagatatacttaagagtttcacattcttctcctcttcatcttctgactctgcatcttcctaagtgctgtccactaataggcatctgctctgaaccacactcttcaactgtaagaccgtgggtggtgtgatttcaaagcccccatggaaaccattggctgtacagacattttcaaagtcgccagtgttactttaattggactgccttcgtcattcattgtctctgcgtcaacaatgtgcaatcatgctttgcaccagccctcaaactgacaattcttaaagataagtggtgttccttttcatcattgtccgccttaaagggatcgtctttgtcggcctttagttcacaactgaaaacatagttctggggcctccgggggctcatgtccatctccatcgagtcctccatggggtggtggcacgtacttaggtgggagaaaaggtggacagagataaatgactgctgctccagggaacagctgtgcaggacggaatcacaccagccaaacttggttacttaagaagatcaataaatttggtaaacctctagaaagatgaacttaaaaaagggaaagaattaaagatgagagagagaaagtgagagagaggtcaggagttatattaagagagatggaacatcactactgatactttatagacattagaaggataataagagatttttgatgaatgcctttttgccaataatttctacatgttggatacaataatttttttaaaagaaacaaactacaaaatttcactaaagaaggaatggataaccagaatagtcctatatctattattaaaattgccttgcagttaaaattctctcacagagaaaaacctcggacctatttaactccaatggtgaattctaccaaatatataaagttaaaataatgccaattctacatgaactctccagaaaattgaaaaggaggaactacttcccaactcagctatgtggccaagaccagacaaacacattacaagaaaataaaactacagaccaaaatctctcatgaacatagaacaaaaaaatcgcatttaataacacaaaatttctagtaaattatcctgtgttcacaatcaggcgacctgggactcagagaaaatattgcaatgtttcattgagtcttcttccaagaggtcatctatgaagacttactttacaaaggaaacattcagacagaaatttggccctgtcctccagaaggaaggacccatagaccctagggacagtgctcccaagggcaaagagcctgttctcattcccaaggcatcctcttgttctgaacacaattcctttatgatattgtggctcttggtgtatcagtgctgggctgtgggcccagtcacaggggtgagacccaccgtgggctcttcacttgttaaggctccttggcctctgagatgtaccagagagcaatctaaactaccctatttgggtgtcaacaaggatggggaaggaaacatttaaaaaaatgttgggagtccatgcctaggcccttggtggccctgggtgtggagctgggggttgtggccatagccccatggcttagtggtcatgtctgctcttcctctgtgttcaggtggatcgttatgccttgctgtcaaccttgcagctgatgtacaccgtgggatactccttctctcttatctccctcttcctggctctcaccctcctcttgtttcttcggtgagtagaacttctgcaggcatgtgttcgggcaggtatagtagccctccttcatctacaggggatatgttctaagagttccagtagatgcctgaaaccaggggtagaacgaaacatagtgttcaaaccagggatagaaccaaccctatgtttggttctatctccatgttttttcctatacatacatacctctgataaagtttaatttataaattaggcacagtgagagattaacagcaataaccaatattgaaatagaacaattataatgctatactataataagagttatgtgaatgtggcctctctctaaatatcattacactatgttcacccttctttttgtgatgatcaaggaatggagctggtcaaggttagatttcatcactttactcagaacagcacataatttaaaactcatgaactatttatttaattatttatttctggaagtttttcgtttaatatttttgagccgcagtgcaccatgattgactgcaggtaactaaaacagtggaaaacaaaagtgtggataatgggggaactatggtattgtgtaatttgctcattggctacctctagaaggcactggaagactgggctggatgtgtcatgaatcatcaaagctggaaatgaccagagagaggctaagtccaatccatcccattttgcagaagaaggggaagaaagggatggcaatgtcccaatcagaggcattgagtcacctctggccataaagccagttggctacacagctagaatttgaacccaagactcctgacagctttacctcctttggattagacacctgctgtgcgcccggccctggtgtaaatccctaatcacacccattaccaccacagcccattcccactacaactcaatcagaggcattctttttacagaagagattaagaatcttccccaaggtaaacaaatggatggaagagctgggatttcaattcagggccctcagatgtcaattagctatcaaatttaagtgcttactcctaagcgcattacatgcattaagtcgtttaaatgtcatccctaattcaaattaggattcattctattcctgggaggttagcattattattacccccactttagacgtgagttaactgaaatatagagagatgaagtaacttgcccaagatcaccggctggtgggtgatgaagccaggatcacaaacaagcagtctaggatctgagcactttcactccctaaactttcagtattccaaagcctgtgtgccttttactaaatcatgcttttagaaatcaggcaagtgagacatttatggacccactagaaagctctccaaagctgtctctggtctcaggaatgtaagcggatataatgtggcagaatgagcatttgacataggtgtgggagacctggaaaccagctccagagcacctctccacctgggctctgctagccctgggttgggcctcatgtgactcctcaatcctgagatgttctgcagctcctagggtaaagtcatgaccatctaccccattgggagaaccatgcttgagctatgggagaactctgcaacttgtacacactgattatctgtgacctccttccttcatgccctgtcccaaagtcccaggaccaagccaggagaaaataactgcccagccctgtaggaagtcacttcggccaagcctgggacaaccaagtgtcagttctgcctaaggcttggggaaaagtgaggcccagtcgctgccctcaaatagcccccagtctagttagagagaagaatgtgtaaatcctaagacacaagaacctgcctcaggtccttttagaaactaaaaatataacaatagctttaaagcaatataggacagggtgtgtgctacccagggagcacagctttcctctggtgacagcaaggatgcacaatgtcacatcacacacaaagagtctgcaggagaccccaggtgcataaggaagaggtgatgagagctaacatttttctggacacttacttatgtgcacagattaacggatttaatcattccacaacccctggaggtaagtgctcttgttctcagaggcagaagaaactgggagacctatgctttggcctgagagtttctgtgtctgaatcccaactctgcgacttactgctctgggactttggacagatgacttcatccttctgctttaattctttcatttataaaatcagggtaataataattcctatacctccagtggtggtaaggagtaagaatactcaaatgtagctgcatatgtaaatgatttggaacacggctggcatgttgaagatgttttgtaggtgatagctattttttttttttctgaggtgaagtctcgctctgttgccaggctggcgtgcagtggcgtgatctaggctcactgcaacctccgactccctggttcaagcaattcttctgcctcagcctcccaagtagctgggattacaggcacgcgccaccacacccagctaacttttgtattattagtagaggtggggtttcaccatgttggccagggtggtctcgatctcctgacgtcatgatccgcctgtctcggcctccaaagtgctgggattacaggtgtgagccaccgcgcctggccggtgataactattattactctcattttacaaatgacgaaactgaggcacagagatttacggtcacataatccagcagtccagctctgcagcctatactatgaccctctgtctttagtgatagatacacaggcataaaaggcagaggcctgttggttggagccattctttcctgagggaaggcatttggttttctcctcgcacagaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagaggtaatccccttccccactgtttacactggactccccacctgatgggtcagtactgggaatcagaaggcaggcaggtgggactagggaggggcagcgggagataagagggtttccaagactttctggctagagaagtagtacgtgacttaacaaaaccaccacctgccaagagcaggccaggtgaaagaaaccaaaacagaagggttcaccatggctgctgtatgtccttgggtgggaatttcttcatgtgcaaacaaaagaattggaccagatcaacgtattttacaattatagctggccctctgtatccgtgagttctgcattcatgaatttaaccaactggggatagaagatacctgggaataaaaagggtgattgcgtctgacctgaacatgtacagacttttttttccttgtcattattccctaaacaatacagtataacaactattcacatagcgtttacattgcattaagtattacaagcaatctagcgatgatttaaagtatatgaaaggatgtgcataggttataggcaaatattccaccattttatagaagggacttgagcatctgtggattttggtatccacagggggtcctagaaacaatcccccaaggatactgagggacaattgtactattttcttgaagcagcaatgctttttcacattgaaatctgcatctattgagatagtttttcctttatcctgctaatgacgcagtaacctattaaactaaccttgcattcctggaataaatccaactaggttttgacatattattttctttctcctaagttgctgtctttagttcgctaatactgtgttttgttgagtatttccttgttgccattcatgagaaagattggcttgtaatgcctttgtcaggttggggatcaaatttgtgctagcctcgtaaaacaaattagagctggtttcctctttcactattctctggaagaatgtattaaagataagtattatttcttccttaaatgtttgatagattgtgccaattaagcattttggacccagaggtttctttattggtaagttttaaactatggattaattacgaatctaatatccagattctatttcttctgtcagctatagcaaatgagtttttctaggaattcatctatttcatctaactgttcgaatttattggcataatattgttcatgatattctctttggatctttttcaagtccattggatctgtaagagtgttctcattttcattcctgatattgattatttgtatctttgctcttttttctaccctttgatcatgttggcaacaagtttctcaactttattggacttttcaaagaataaacttttggcattgttgattatctttatctcatgttctctatttcattaacttctgcttttattatttcctcccatgtactttctttgggcttaatttgctattctttttctaacttttttttacatgatccttaaaataattgatattcagcatttttcttttttaaaaaatgcacttaaggctatacgttttattatataaggtttggtattaaccgtatgttgtaagttcatgcaatattttctttacattcagttaagaaataatttctaatttgtttcaattttttctttgatccatggattgcttagaagtctattttctaatttccaatcatatgaacattttttagttattgattttagcttaattgaactgaggttagagtactcttcagtgtttccattagggcagttgctgatggtgaattttctacatttttgtttgtctaaaaatgtctagaatgttaaggaggaggctggccttgaacacctacctgaagccctccttccttcatattttgatattattgccaacctccctgagatggtcagcaaaggtctgggagagaacagagtaaagagggagggggccgggcacggtggctaacacctgcaatcccagcactttgggaggccagggcgggtggatcacgaggtcaggagatcgagaccatcctggccaacatggtgaaaccctgtgtctactaaaaaaaaatatatatatatatatacatacatatacaaaaattagctaggtgtggtggcacttgcctgtaatcctagctactcggggggctgacgcaggagaatcacttgaaccagggagctggaggttgcagtgtgagctgagattgcacctctgcactccatcctggcaacagagtgagattctgtctcaaaaaaaaaaaaaaaaaaaaaaaaaaagagggagaggttgtctctgggaggcccttctcccccgactcgggatcagatgcaggggagcctggactcaccctcaggtgttttttcctctgcagatgtccacctcctgccgctcagtccaggttctcttgcattactttgtgggtgccaattacttatggctgctggttgaaggcctctacctccacacgctgctggagcccacagtgcttcctgagaggcggctgtggcccagatacctgctgttgggttggggtgagtgacctgaccttcagcttcctttcctggggatccatcaaaatatgggagcctgatagagactttagttggacttagaaacctaactggaggttgcttctgggacatataagtcctcaaagacagggagctttgaagaggggtatgtgtgtgcacacaaatgcacacatatgcacaggggccataggcccaacagcccaatggacacattcaaaaattgagaaagtctttggtggaatctgatgatattcctcctaccctgtccccaactgtattagtctgcttggaatgtcaaaacaaaatacctgtgtagtttaaataacagacattgatttcctatggttctggagggtgggaagttcaccatggttgggttctggtgagggctcttttcctggcttgcagtcagctgccttcttcctgtattctcacatggtgaggagagtgagaaagcaagctctctcgtctctttttaaaagggcactaatcctgtcatgaggaccccaccctcatgatctcagctaaacctaagtaagtactaccaaaggctctgtctccaaataccatcactggggtagggcttcaacatctgacttttgagaggacacctacatttagtccataataccaggtcttcaagaagagttttctgattaaaaaaatatgaccaagagtatctagatttggaccccctacctccacaaaccctttggagaatttggtgctacaggattcagaggaaataacctgggccagtaattcaggagattcgggttaatatccttggatttattctcagctgctttgtgacaagtatccagtcgctttccccctctgggccctggtttcttgggtggtaaaacaatggatgggccatgtgccaccctgggtctctccagctctcacagtccacaactccatgatgttaggtttgatgttgtaaccacctgtggttagcctcatccgctgtggtgggaggcaagcaggtttggccaaccaactcctaactacatttccctgtgttttctccccagccttccctgtgctatttgttgtaccctggggtttcgcccgtgcacacctggagaacacagggtaggtaattcaccaggtgttattctttcacgagccggtaattcccaggcatgcctaaatacaaagaatgacatcattttaccgtagaaaatatctgtcccttctcattttggccatctagaatattcttaggaatgggagataaaataatcagagatcttatagcaattagtttattaatttagttacacatgcaaattagctcaaagatgctgtataggttagctgcagccctgggtacgtaaggacaaaaatacaagagtggttactgcagtattgttcatagtgagaaaaaaaattaacaaaactaaacaaacaaaaaaccactgaatgctcatcaatatgggaatcattgaacaaactgtaatatacctatattgcagaatattatgaaactacttaaagaaaagcaagttcgttattatgggaacttttaggcactgattctcaacagcctgttttaagcctattgctgaaacgtatattgtgtgatcccatttttttcctccaaatagcacacacaaaaaactacataattaggaatttatgtttgtatgaacatggaggaaaattttggaaagatatacacactaggctgttaccactgaagagcaatttaatggtaaggaaagtaaactgtaccagtactaacaggaagggatttgggttctctcttctgcctctcccacccctcaggggactgattggtgggaagtagggcttgagtgcaagcatccttcttccagagagcatgaggctttgactttcaacctcctcttgtttttaagtcttctactgcctgcttctactgttgaccttaggtgctggacaacaaatgggaataagaaaatctggtggatcatccgaggacccatgatgctctgtgtaacagtaaggaccatcccatccacctctttgtctcggagcctagcagctgtggggaatccccccgccccacccgacttctgtcccccaggttctctgatcccttgagagagagaagctgaactatgagcattttctgctgaatgagaagttagaagtttcttgctctggttcaggacctcaatttggagttacattgtaagcctccttctctctgggtcttcaaactgtgtaaagagacctgcagtcagctctgtgctcctgtattgaagggctgagatgtgtgcaaggccctgaggataccaatgcctttagtcatggaggaacccagaatagcaggggtatcggcttatatcctaacaccatccacaggagggaggaagagactaagggaacttcttttagaggaagaaaacacacaattaatattaacccaaaattgtgatgcagcttagaatcaagacatagatgctactctgagaccttagggaggaaggacctttaatcattgtggtccagaatatttggaatggaaagggatggccaatccagagtcaaaaattcctttagataatagggtgtgagaatgagaactgtcaaagaagctagcaggaaggggcagaaagttagcaaacactgggaagggttagcaagatcccagagggaggcggaaagtattcctgcctagacacaccaccataatcttcgcgtgcccaccaggtgctgaacactacgtgttgttctctgcccaccctgttccccaaggggttgctggatgatctgtttttgccattttatataaataatctggcatttgtggtaccatcaaagaaaaaggctagtttttataggggagtttcaatatttgtcaataatagaaggcaactctctgtttagacctgggtgtgacctggagggaaaaatggtcctagaagtggtgggaaaaccgagagtgtggacaggcctgtgtcatctctggtctatgaggtggcacgtatgctgcggtatcttccctcctgtcactggacctgcagctgatagtgtgccagatgaggtctgggcacacacaccccacacatggcgtgcttagccctgccacatcctcctgccctccacagtcctctctccagccacactgcccagctggggtcctgtctggacaattccaccaacgtcccagaaacatttattaagcacttctgcataccagctccatttgtaagtgctttgtgtatgagtgtatgaactcatttaatcttcccaaccaacctgtgaagatatgccattcttaggtttattttactggtgagcacactgagatgagaaattacttgcctaaaatcatagagccagtcaatggaaactggatctcagcccaaagggtgtgatgggatgacagctggcacttttaaccgtagcactgtgcagctcaaaaactatttactgcctccagcccccacgcctgccatactgaatgctgcaggctcttttgcaccttagtaccttggttcagactctcctctggctccaactccttccctcgccatcttttccacctggtgatctgttcctcatctttcaagtcttgggtcaggcatcattctctctgtgctgctctacctggatgctcacctcacgaagtgaaaatggccacactctcctttgttccttcccagatcctgtgcaggcttctgctccagccctagccaacaccatttcaagtatctctttaaaacccattttctgccactgtaagccccatgttctgatcatcctggcagccagcccaagcatatggtgggttcttgataaacatattcagtgcacactcatggcctacattctggaccctgaaaggttcttgctaaccaggtagaacaaagtagaatggaggccagcagccatccctaggatagcgttgaggcatggtccagctggatccctagtgtttacttgcagtcttctaggagctacaccaatggttctcaaactgggttgctcttggaatcccctgggtgtctttaaaaattctttttgcctgagtcccacccccagacatttatgtttcattgatctcaggaggggcctgagttgaaaagcatgttgctacaaccttgcttttcaaaggatggtcctcagaccgggtagcaccagcatcgcctgagcgcttgttataaattcaggttctccagccccatctcccaggcctactgaatccgagtctgcattggaacaagctccccaggttttggatgaacattaaagtttgtgaacctctttgtctactcctggagttctcaaaactggttgtatgttagaaacatcatggcggcttataccccagacctatgacattagaaattctgggagtggggcctaggcactgtagttttttctgtttttttgtttgtttgtttgtttgtttgtttgttttgttttttgttttttgtttttttgagacggagtcttgctttgtcacccaggctggaatgcagcagtgcaatcttgactcactgcaacctctgcttcctgggttcaagcgattcttgtgcctcagcctccctagtagttgggactacaggcttccaccaccacacccggctaatttttgtatttttagtagagatggggtttcaccatgttggtcaggctggtctcgaactcctgacctcaagcaatctacccacctcggcctcccagactgctgggatttcaggcatgagccaccgtgtctggccccactgtagttttaaaacccctgaaatgatcctagtggctagaactactgctttgggccttgctgctttggccttctatggctggctgacccgcattctagtttcccttggtgcttcctagttgggacaagagaacatgctctatcttctcactttggataaaatgacctttacatgctgttgcttctgtgactccagtcatggtcagctctactgaaatggccactctcaccttagcttgtggtggactcctcatcttcccattcagacctctccttctcctactcactctacccagaaaatggctccaccacccacccacccaggcacccaagctggaaagcttggtgttctcctaacttctgtcctcttcctccctgcaacgtctattcagacttcaagtcctgtcaattcttcttctaaagatctctccaagccatttccttctccttaatcccttggtctctgctcttctttagccccttgtgattttgtgtgtgtgtgtgtgtgtgtgcagacctctgcaaacacctcctttttggtctctcttcttcattcttgcccctgacaatccatcctcttgttgcagcccaagtgatctttttggagtaaaatttgattatgtctctgttctacttgactgtttaatgggtcactatttccctcagatctggttctaaactccttagagtcattccctctctactcacctaaccagaattgcccgatgctctactcgtatggatacatttaaagttctccaattccaccatggtgtttccctcctcccatgcacacataagcctcaagtgcctgttggatggccccaggtctgcctgataaattctctttctccttggaaactgagtcctttattaatctctctatcccctaccctccacccccctgcaattaaaataagtcaacaggcatgcctagaagggaatatttcacaatcaccctcagctcttagagaggacattgcttaactattgttgtctgtgtctacaggcacttggactagaggaaacgggcttgaagagaaatgggagcattccctttggtcacaaggaagacatttaaccatgaacttgtaaaacactgacatataccccagagaaaggcattagatcttcatgtctatcagtttacaagaagataatctgtcctgaacaataaggagctaaacctgctgccctcccaatctgcacagctctaggattctaggactcctagaattggttctagggctccccagagagtggaatttatgtgtcccaccagacatggaagggaaaagaaaggccatgcagaaagaagtgaaagaggcaggctaggagtcaggagcctgggctctatgactgacttgtgatgtgtccttcagccaggtgagttggcctctctgggcctctgtttcttcatctatgaaatcagtcttgaactagaccagtggttttcaaccagaggagattctgacccctggggacatttggctgtgtctggagacatttttaattgtcataaattggggatggggataggaggagaatgttgctactggcatctagtgggtggaggtcagggatgctgctcaacaccctacaacacacagaaccacccccagaataaataattatcctgccccaaatattaagagtgccaacattgaaaaaccctggactagacagtagctgcacattaaaacaacctggggaggattaaaaaaatacccagcccagacttacccagactgatggaatcaaatctcctgccatgtagagcttccttagcactggaatctcattcagccactctcttgtatcttcctttagcattcattgagcaccttcactgggcttggcttggtgctaggttatttcagagtttctatcctcagggaattcagaatttaatagttatcattctgagactcatcagactatgactgaaccaatatctgccttcatttttggtcatatgaccacatgttgcaattttccactgatctgaatagacataaccccaactctaaaagagaattccttaaaccacaacgtggaaggaacctggattcctgaatgactgtatggagcagaactccctccactgcactagactgtgacataaccaataaaataaaataagataaaataaatctttattgtgttaagaaaaaaataataattctttggcccccacatatgttctacttaaactgaagtaagaaagagtaacaataatcaagactgagctagtagcacttggcatttctaggtacttaacaattttctttcaacttggtcaaatttgagcctgggcccaattttggggaacatggatcagaggcttctgaggaaaagccaactgtgcatggtgaaccaagcactgggaccaaggagagtgtcccatcccaggttccggctccctggtgaatatccctagttatcacagttggatctctcccaccatcccctagactgggtctgcatttgctgaccagcatctgggttgatgcgagtgtacaacatgctggaaatccagatgcgtcagcaaacttcatttactgctttgttggtacaaggttgcctgtgtttcagaaatgaccataatgtggcaacctgaagaatccagatgccctttgggtctcttgccaggcagaaattgtagaattcccacctctttctttgtataagacttcactacttcacctgtcatctgaaatgtacatttagagttgaatcatctcggaaactggcatattcttacagcctagtctccccagccctcagtagaatattggtaaagtcttgattagtcctgctcaaggacagccttagacaataattacatcatgcaaggtcattctatccataccctgcaccctgcagttaacagacccggtgaaatggctgttttgagctaacaaattgaatgaaccatctgttgactttatgaaatcataaagtcaaaagcctgcatttgctattgttgaatcttccgtgatagcctcagaacttggcaaagttgatgcactggtaaaatttgtcttcactggccttgtccctctttaggtcctctgccccaccaggaacccaggggctttctgtggcttcaggcttcccaagacatttcctcactcctgtgctctcctcttctaaagacttaaagtgtgactctccctgtactctgggttttcccaccccatcaaaacttagctttgctacaccccatcttctgctttaaatggtgataataagccagagcctaggtaacttactgaagtcttcattgttgcaaaaatgaatgaatgaatgaaaggagaaagggcttccttcctcctctcccagtgattccttagcttcagtgggttgtgtgcctttcagcagggctcttggggaaagagtgttttgactcacaagagtagctctacaggattagcattttagtccacacagcaggccagaggaggaggggtttggcggtagatggaagagtttaggggtagatgaggcctacccctgagctcccgctataccggcaatcacctctgccaacttgtaggcccagatctgtgcacagaagctggggtaacaagaaagtgtcaccaagaatgtcacatctgagaatgcatctgggatagatccttatatatttggggtccttagcacccacccccatctggtcacaaaatcctggaggagttggctgggttcttggaaaatgtcctcactcagcccctttcctgcttgtgtgaaaatgaagaacagcaccatccaaaagtacctgctgactcttgtcttcttggaagcccagatgagcagaggcttcatggtacccccagctagggtttcatcctgtggcagtgaggaagtgcctccttcgtacgttctatgggttgatgcccattttctcatgtctggtctctggaagacacagagaacagtgaatcaacatgcttcccattataacctttcattgcctaggagacagtcctgattgaaattaatttgctgaaataaatgcctttctgctgttaagcttgctttgtaagaaaaatgcctatgttcaataaatcactaagccaaggacacaacgttttctctttatgatgagaggcagatatcccattaaaagaaatacattacttgattacatttaccttgtatttaaactttctgttcctaaatattctttggctaggaacctccatcattcctgctggcttcaggccctcacatccagtcaataacaaagatcatttgactcatacttcttcatcatttcaaattgatcccttcctctccatcatggaagcaccagaactgctgctgatttcttttctccatcaccgtcccccaggaactctgaaactacttcccaactgatctcccctcctccagccttaccctcacccaatccattctccacactgctgctgaaattatctttctgaaatgcagaagtacaaatctgatcaggtcacttgcgtgcttaaaatctatcactggctcttcattgctttcagaagaaaacccaaactccttacctaccacggctgtgaaagaccctgcagaaacggacccccctctcctgcccagtctcacttctcacaaaccctgttctcattctccaagctctacccaaacccagccacctgcttttcaccacttccagggggctcttgatctctcctgaggctgcagccaagacggcagccagggccgcagccatctgaaggcttggctggggctggaggatcagctcccaaggtggcgcacacacgtagctggtggtgggtggtgctggttttgggcctgagaactcagttaccccacgtggatctcccaacaggctgcttgagtgtcttcacaaaatggtggctgacttcccctggagtgagaaacctaagagagagagagagagaaagagagagctgggtggaagccagccatccttttgaggacctagcccagaagtcacatagcaccacttctatgacaccatattcttttcgttaagtgcaagtaactaaatctagctcacctcacaaggggaataagggggattagcctccacttttgaaggcagaagggccaaggaatttgcaggcatatttttaaatttctttaaaggctgacaatggagggctggattttcccagtccatgacagtcgtggaatgtattctagggagtagagagcatattctgtctatgaattccatagcagcaacaggatctcaagttagacaccaatagggatggagttctttacagaagagaggcagaatagcgttctgtttaagtgaagggagggttataatcccatgaatctgggtttaattacaggcttaatcactgactagccatgcaacctgggaattacacttacttctctgtgcctgttttctcattgttttatgaggataaaaatagttgtggctaccttaaggggatgttgtaaaaactagatacaagaatgcctggaccattcttagcccaaagcctgacatggtgctaagtactaagtgataagtactcaatacgtggtagttaataataataacaataatagtaataataataatgtgaacgtccacctgcctttctagatggccttaatgatgggcctccttaaggcagaataataaactaaatcactttctgaaattccttccagactttcagttcagatgacctttgggactttggagattcagatggcctttgggacagtggagattcagatggcctttaggacagtggagatcacagctaagcatttactacctggccagctaactgctgaattgcccctggtttacattgaactgatggaactgatggccgagcccagcctgaccttgaagttcacagctatgtggaattcgtcacttacttacccaattctgctctttttttcaaggtcaatttcttcatcttcctgaaaattctcaagcttctcatttctaagctcaaagctcatcaaatgtgcttcagagattataaatacaggtgagtggcttaaggttggtccccagcagtccaaggttattgtaagtactctggctgttctgcccgctgtcttgggaaggacatttatctcctaaggccagggtatcagaaagagcagttctgggaaggtgctataggatcaagtgaggcttttgtcaatggtgaggaccttctatgacgatgaagcaaatggtgagtagtcaagggcattcacatcccccagcagaaaactgttaaaatgcccctaagagggcaggagtgatgtctcagacctgtaatcccaggactttgggaggctgggacaagaggattacttgaggccatgagtttgagaacagcctggacaacatggtgaaaccccgtttctaccaaaaatacaaaagttagccaggcgtggtgcatgcctgtagtcccaggctaaggtgaggggcttgcttgagcccagaaggtcgaggctgcagtgagccatgattgtgccactgcactccagcctgggtgaccctgtctcaaaaaaaaaaaaaaaaaagtttctaagaatgggtggttgtgggaaaaggacagtcttgtttgaagagaagtttggcagttgccttccttggggaaggatttgaagagaagagattatttgggtgtttttgagaccttgagaaatgagaccacaaacttttagggtctaaggaaagacatccttccacaggcatcctttaattgtgacttgttgtcgctgcatctcaccttcctctttctgagatgacagcagtcctcattcatagtcagtcagatcataggtatttattagatctgcattgttgtaaaagcaaatgaatgaatgaagagagataaagggtttcctccctcttttcctagttattctttactttctttcttttttttttttttttttttgacagagtcttgctcttgtcgcccaggctggagtgcaatggcatgatctcagctcgctgcaacctccacctcccagattcaagccattctcctgcctcagcctcctgagtagctgggattacaggcacctgccaccacgtccggctaatttttgtatttttagtagagacagagtttcaccatgttggccaggctgatctcaaactcctgacctcaagtgatccacccgcctcagcctcccaaagtgctgggattacaggcgtgagccaccgtgcctggccttgattgtcactcttgctgcagacacagtgggtacaaggtgacaggattccccgcttggccaaatccaggaggtttagagcgagggctagatgccccagtctttgtctgtctgtttgatttccctagtaaacaacttggtgtggcaatccctgctgctcccgatggcacccatggggttcgtgcaggttccgtggcaccannnnnnnnnnnnnnnnnnnnatgatccactagccttggcctcccaaagtgctgggattacaggcgtgagccaccacatgtggcctattctttgctttctatgtggcatatgcattcagcagggctctggaacgggagtgttttaacccacagagtagctctaagagtaggaatttcagtccacacaggaaggcagaagaggtgggcacgagtgaagatggccctagccctgtttctctcccctttataaggcctcacccaggtgctgggaagggagtttttccttttatctgacaaatatttaatagatgcctacaatgtgcctggtactgtgcttggaataaaaggtggacatgaggccaggttcggtgactcacgcctgtaatcccagtactttgggaggccaaggtgggcatatcacctgaggtcaggagttcaagactagcctggccaacatggcaaaaccctgtctctactaaaaatacaaaaattagctgggtgtggtggtgtgtgcctgtaatcccagctactcaggaggctgaggcaggagaatcacttgaattcgggaggcggaggttgcagtaagccgagatcgtgccattgtactccggcctgggtgacaagagcaaaactccatctcaaaaacaaacaaacaaaaaacggtgtacacgatgtagaccctgcatttgaggagcatgcattctactttgctaaggactaggatgttggcatggagcaggaggtggaacggagggagctggccacgaccctagacttgcctactggccttaggcaagtgccttggcccctttggcctgctttctggtgtgtaaaaatgggagtgtcactgcagactcatctcctgcttattatgaggattcaaggagtctgtagatatggttataaatatgggtggccactctaccctccctctaggaggtctagaagggtaaacatacccggttcaataatgggcagacatactatagttgctagttggagctttggtccaaacattttgctagaaacccgtagccctggggagctggcctggcctgggctccagggagccacgctgtctctcttggcgcctccagtcgaggctccaagtggccaagcagtctctctggctcccttcccaaaggcttagcctctctcaccactctttcagggtggagcttcaaagcctgctctagtccaccctgctgggtgcactcagggaggagagttctctcaataaacaggtgccaggaaaaccagggtgccccagaaagtggacagaggctagtgtttccaggagacagaaatggtgcagttgaccccaaagggactcagagctgacacactgctgctttgtgcccccaaagcctatcacgggccactggcaccttcgccatgcccaagacccacagcaacccctaaatagtttttcatcatagctcctcatcagcatccccggacagctggccagaagtgcagccttgtgagccctaccactgggtattctgactccataaatgcgggatagaacctcacagagcagccgtgtccaaccctttgaatggaaggacatttttgcttatccgttgtggtggatatcacaaaaactatgcatggacttttttttttttttttttttttttagctcatcagctattgttagtgttagtttattttacatggggcccaggacaactcttcttcttccaacggggctcagggaagccaaaaggttggatacccctgctgcagagtctcccaggagattctgatacacagccagtgtggaggactgctgggccagatgttctattgaaagaacacatgctaatgaataagcattagttaatcaactctattgcactctgcagaaagaactagtaaacagaaaggtggccaacgaaaatggcagggaaaccacagagggaggacgttctcagtggaatattctggtcgggccattataaatgtcatgcagcctcaatgttctcttttccagagtcccctctagagttttcagacttttctgatcacacatctctgtcagtaaagaaattctgagcacatccctcctcatgtatatgcatggtatcatgagctaatatatgtattataagatagaccaaaaaatagaaaatttaagaggacagataaaaattaatatatatacaatgcctattatcctctattataatattttcttccaatatcaaatagattgcccggcatagccctggagggtgcgtacccaccaggagccattggtctaggaaagggtaaatcaagatactggggagaccctcatggctgagcgatgatccagggtgactgctttgtggggagaaagagcaaccctgcctgacatatgcagtctgtctggaaattccttttttcctctcccctgcccttgttcaaagaaaaagcttaagaagaagaacttggggctgggtgcagtggttcatgcctgcaatcctagcactttgggagcctaaggggaagggatcacatgaggctaggagttctagaccagcctgagccagagtgagaccctttttctttaataataataataataaaagaggtaccttggtgtgtgtctacccaaagtcctcctagggtgagatgcctcaccttggtgagtttgccaccacctgggtatagtacagggaacccatctatattcttgagtggctgagactttgggaggctgactgaccccagctgagctcacaatatatataaactagaacactgttcatttttaacgtctgtggaaggtggggatggggtagagcattcctttcttgtgcccacatgcctcccaaaatttcctaatccgcaacaccagaagatccaggaatccaaagaacgttactggtgatcacatcacaaagcagagtcttgctgttgaaggatgctgaggttagcctgaaaaatcactatctgcccacagcaccacctacctgttgggaaggaggctcattccccagatccagtgtgccctccacagactagggtgagataggcactgagaacgtcctccctctgtggtttccctgccattttcattggccaccattctgtttacttgttctttgtgtagagtgcaatagagttgattagctaatgcttattcattagcaaaaaggcagggacctatctctcaggacacacctaaaccaccttatttaactccctgcgctggtaaatcctacagcatctatgaactcacttgcccattgtgctcttagaaagcctcgctaattctctcactttcaagttctgagagagtgctctttactataaccccagcagggcattggcacccctcagctcctcagctcacagtgccctcttccatgtcggaaagttgttcctcttcctcatccccttccatgtttgttttcccttaaagacttctgatgggataagaaggaggaggtgacagggcccagcatattttatccaaactcttgtaggtacaggctgcctccaattcttgaagattttgagaacttttagaatgtaaccctgatctggcctccctccaggattatattttaggaaagtttaaattaaacacatttaggccctgccaaagaggcaagttgctaggagctagagaaccttctgtagtcttagcccttgtccctgggcttccaccgtcaagcaaaggaaataaaaaatggtccatctgtctggcttggagaaagagaactgagccaagtgtgaaggaggaactttggggctataaacagggtaagcaatgccctaggaatgcggacagagttcagcagaccgtcagctcagctggagttctctgttctttgtggttcccagctcagaggcagctctcttcccctagataaagggccttaactctccatgggatgcacctgggcagagctcttgattcatttataaaggagaagcatttcattttcatttttatttttttgaaatggagtttcactcttgttgcccatgctggaatgcaatggcacgatcttggctcagcacaacttccgtctcccaggttcaagtgattctcctgccccagcctctgaagtagttgggattacaggcatgagacaccatgcccggttaattttgtatttttagtagagacggagtttctccatgttggtcaggctggtctccaactcccaacctcgggtgattcgcccacctcggcctcccaaagtgctgggattataggtgtgagccactgcgcccggcccgacaagcatttcttaacatgctaaaccccagttctttctgaaaggactttctgataggcaatgtaggaaacaaaagcttttccttaaccctcttagggtccctggctgggtctaaaaattagacaaagacagattaacaggagaaaaagcatccaagtttatttcataagtcttatatgacgtaggagacttcataaggaaaggaagacccaaagaaatggtcaaacttgtgtatttttatgctaggtttaatgcacagtggacagtcatgggggaagtatgattgaacaaaggagatctaatggttataaactgggggaaatttggcaaagcctgtttgtacagattcttgtgtcattgtgtcttcagaaataaggacgttcctttcctccacctctcacatgagggtcttgtgatccgcttcaggagaaggtcagaaaatccttcctaggtttcatgacctgtttcaggggagaagggcgggaggttagagagaccttcctgcttctgtgattttctcaaattctttcagcttaaaatactcagtatgtcaaggtgccatattttggagtaccacgttctgaaccacatcagcaaccaaagactaaaaatgttacaaattcaaggaaaattcgtttaaaaaattgagttataagcaaccgaaaggcagggatggcttctttaaaaatagtaataactaaaatgtattgatcatttatcgtgtgtcagataccattttttctgagggtttaccccatgttatttgtttaatccttgtgacagccctgtcaggtagatgctattactattataatactccttttacagatgaggaaactaacagagagagaggttaaataatttgcccacagtcatagcactaataattggcaacactgagatttgaactcaggcccagatactcttcctgtgtcctgctgcctttgactacaactccttctttcccactatattcactcatgtgccataagcagatgctcaataaatatttgttggatagttaaatgattgcaataaatggaaccatttaaataaacaaaaggttatggatgaaaatgagcataaacacagtctgtaagagtaaactgctattgctatttatggattttcatctggacagggacacaaatagtacttcgtctaaggagaagttagaataaggtgaagggtagacaatcccttcatgtctccatccagaagggtgagtagcccaaaactttattaaaaaattgttattctttatagatcattctgtactaaacgaaatgtgggatcagggaacaggaaaaggacattagcgggaaatccacataaaccccgaactttagttcctagtaatataccgtgttggtttcttagttttgacaaacgggcatggttatgtagtatgctaacattaggggaaactatgccgggggcggtggctcaaacctgtaatcccagcactttgggaggccgaggcgggcggatcacaaggtcaggagatcgagaccacggtgaaatcccgtctctactaaaaatacaaaaaattagctgggcacagtggcgggcgcctgtattcccaggtactcgggaagctgaggcaggagaatggcatgaacccggaaggcggaggttgcagtgagccgagatcccgccactgcactccagcctgggcgacagaacgagactccgtctcaaaaaaaaaaaaaaaaaacgttagggaaaactgagtgaagagacatgggaactctctgtactgccttagctaattttctgtaaatctaaaattattccaaaattaaaagtttgttttaaaaaaccataacaccataacatggcatcagaataagctgacaagacacaggtctgcttgtaggcatataagtctgtatcttgaaaacccagcccacccagagcaagggtcacaaattcagactcttacaagggccaagcaagtaacacaattgagtagtacaagccgggtgggggctggatgtcacagcttccttctaaagggacagccattgcccagctgtaaccaacgattgccatgcaagaatttgagcccagtgttgccagatctcctcatttttcaaaagaagccagaaacctggacactttttctagaaatattattatttaaagatgactccaataacaaaaattgctccgtggcctaagcaaaagttgtctgcaggtcagttactatccatggtcaccactttgtaacctctgggccagagggctttaaaaacactcctggaaatacaaaacccttgaaatgttctctcattaggagcatattaatgttgcctagcgaaatgacttctgtaggggtgggtgttggagtgggagtcgatctgagctcagctcaagagaaccacacagccaaggcccatgattccatctgtctgctcatcagcctttcctgacagtcaaggctctggttcacacaatcacatggccaggtggagtccctccgtcctggtggctcctgcacccctcttcttggctttagatcctttgggggcacaaaggtgaggttgtttatttcattgataacattgcatctgaatggcccttgcagacataggattcatagtaagctcttgctctcgtacagagttaaaccttccttaagaaactcccccatgaactgcgaatgccaccctgtttttctacacctttaattccatgggatctgaggggaagttcctcctagtctggcccctttagaagaagtgacctaagctaaaaaaaaaatcattacaattacgctcctctttcccaatgtgggtaagacagtagctttgttcgtaccccgaatatgagtcatctctgctaatgtagttagttttaaattaagaagcagctcaacagtaaagggcagttatttccaaacctgtatacttctcaggatccatgaggagttccttaaaaagtccacatccagccaggtgcagtggtttgcacctgtaatcccaacacttcgggagactgaggcaggagtagtatatcacttgaggctaggagtttgagaccagcctgggcaacaacataagatcccctctctataaaataaaataaaataaaataaaataaaataaaataaataaaataaaataaaataaaataaaataaaataaaataaaataaaataaaataattatccaggcacagttgtgcacacctatagtcccagcttctctggagtccgaagcaggaggattgcttgagcccaggagttcaaggctgcagtgagctagaatcgtgctactgtactccagcatgggtgacagagggagatcctgtctcttaaaaaaaattaacttcctgggacccaacctccagaggtgtggattcagggagttgatactgaggcccaggaaactatatgtatatattttaagagctctgtaaggaattttaatagtcagccacgtttgggaaccaccagtatgcaacatttgggtcccagctgtgcactttacacgtgggtggcacaaggaatgtttgtcttttttgtgtagtctatatacaacagtgaacctccacgccgcactttttatgaggaggatcagtttttcatttcctgcagccctcactatcaccagggttaaggggcaacatgagggctgacagcgaagtccagaaaggagtctgcaggtcggaactgcaggtcagatgcccccacatccagcccgaggtttactacttagtgtctgtatgaccctgggcaactcattttctctcccttctcatggtaacactggaaatactgatgttgaaagtccggagtaaagaaagagatagatgaaactgctaaccacatgataggaaatttaacaaacctggtaggggtggagtgtcccagggtggcagtcacttgcatggaaatctatccatcaggcaaaactttaagagctacagacatatgacaatctatacaggggaatttatgcattcattcattcaattcatgttttctgagcattccccatgcgtcaagtgtaggaacacaacagtaaacaagaccacaatggccctgaagcgttaaatgttgtagtgaaggagaccatctgggaaacaactatcaatatggtaagagctgcaacaaagtcatggcatggaagagcaggaaatgttgcttgttccccatgtggccctcttgactgttatttggttgtcatttacagattggcaaaatcaacactggtcctcattcctttattgggcgttcatgagatcctcttctctttcatcactgatgatcaagttgaaggatttgcaaaacttatacgacttttcattcagttgacactgagctcctttcatgtaagtagaaatctgaaccaaaatgccttgactttggagaaaacaaaatgcatgtggccgaaacaggctcagaattaaggagcccgtggatgaaaatagaattgtagcatcagcagcctttatcagtaagggcccttggcattagaagggcatgcagacggggaagtattgcgttgatcctgccagcatgattcagtgactaagaagggggaaatggtctctttcctgggtggtaatagttggtgtgactcatgatcatattaactatgagtgtcaatgtgaagccttttattaagtgcctatttttgctgggttctctgcagagcattgtgcaaagtaaacattgtctgtgcttcaggtgacatgtacacagaatgcaacacaaattggatagggactaatgagttcagaccaggaggctattgaaccttgacagatgtgtgggagttgaaactaggaacaagaggctagctgtggttgttacctggaaatattttggtcatctattgcttaaattattatctatttcttagtgtcttaagatggcaatttttaaaattatttttcatgattctgggagttaggaatctaggtaggacctagtagggatggctaacctttgcttctgtgatgcctcctggggctggaactaccaagatgtcttcttcactcacatgactggtgcctaagttggatggctcaaatagctgaggctagtcttatttgggtcaaatttctgaggcctcatttctcagtgtccatgacattccttaggcgttccatgtgttttctccttgtggtctctccacaggatagggcagttcagggctcccaagagtataaaagcaggagctgtcaggccttttttttttttttttttttgagacggagtctcgctctgtcgcccaggctggagtgcagtggcgggatctcggctcactgcaagctccccctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgctcccctgccaggccttttaaatgcctatgcctggaactggcacagtgatgcttctgctgcattctgtcatttaaagcaagtcacagacccagcctagattgaaagagtagggcactgcacaaaggcatgaatgctgggaggggcagctcattagtgaaggccactaatgcaacagattaccactaacagcacagcagcgcaggtcttcatagagtagttatctgaaaatgaatcatctttaaatgttggtgtgggggcaggacttctgagatgataaagagaggatctacaaaagctctccccaaaaggcaatgataaaattggacaattgtcaatagcaaccattttgggaccatacacattaactaaaaaaaaaaaaaaaaagaaatgagaaggattcagtcaagaaaaattactgaaattcagtaataacagtgggagtctatgttacttttgtctgggactgcttttgttctctaatccctgctccaccagtgaggaaattctagtgaaaactagcagcttcactgaagagggaggctgacttgatttggatcaaagagcagaaaaactctcatccttgggcattgccagatacagtggccgtcttggtgacaaagaaacagggaaggacagtgttacagcctgaagttatcattctatctggggtgaaaaaacatgctgatgggctagccagaaattttacgggaagatttggggaatgagacagccacagtgggccttgacaagcccccacatatttctcaggttgactggaaggttgtgtacatgcataaggttgcatacacactcaagaaggaccagaaaggacattcacacatttctggctgaatgtgagtttctgcacacatacagaggaaacatgagggggtctggtggaaagtaaaagccagggaaggcttcaaactgaactttgaatgtgttccccaagtgacatatggatccattggcaaagggtatggaagtcttatgggcttgaggtgtttgaaaacaacttctgatcaatcattggctgattattaagctattggaaacagcatcagatgaccagatttaaaaataaaaaccaaaattttttaaatgagcagagacatcactggccatataccacagcagagacagattccacataactagtagtccagacaattttctaaacaaaccaccaccaccactccagggatggggactggggaatcagaatcctgagttgttataatatattatctaaaacttccagttttttccaaaaatatgagatctgcaaagaaacaaaaaagtgtgacccatactcaggacaaaaaaaaaaaaaagcagtcattagaaactttctgggtgggataggggatgtctagatgttggacttatcagacaaagacttcaaagctattataaacatgttcagagatttaaagaaaaagttgttgaaataattaaaggaattcaattatctcaattcaatagagaacaattataaaataagaaccaaatggaaattctggagttgaacactacaataactgatatgaaaattttattaggaaagcttagatttaagattgcagaataaataacctgtgagcttgaagataggtcaatgagattacccagtctgtggaaaagaaagaaaaaagaatgaagaaaaataatagagcttcagagacctgtggaatgccatcaagcatactaacatacacataggagagtcccagaaggagagtaaagatagaaatggtagaataaatatttggataaataatggttgaaaattttccaaatttgaagaaaaatgttaatctacacatccaggaagcttgatgaactccaaaaagcataaaacaaagaaattcatgcctggaaacattacagtcaaacagttgaaagccaaaaatgaagagaaaatattgaaagcaacaagagaaaaattgttcattacatgtagggaccaatgatacaattaacagctgactactcatcagaacaatggaggccaggaggcagtggtataaaatattcagaatgctgaaagaaaacaattgtcaatcaagaattctaaatccagcaaaagtatgtttcaagataaaggtgaaataaagacattatcataaaaacaaagactgagagaaatcattattggcaaacacccctttcaagaaatatcaaaggatgtccttcatgctggaagaaaacgacaacagacagcaactcaaatccacatgaagaaataaaaaacagtggaaaaggtagatacacaggtaaatctgaaaggctatgtgtaggttttttttctcataactgattttaaaaatacaagattgtataaaataataactatacattgtatttttgggcttataacatataaagatctaatatatatgacaagaatatcacaggagaagaatgagtaaatagagatatataggagaacatttttatattttaccaggcttaagttagtgttaatatgaaatagattgtgttaagatgcatgttgtaatccctggaataaacactaagaaaataactttaaaaaatgtatttaaaatactagcaaaggaattaaaatggtacactggaaagtatctgtttaacatggaataatttcagcctcatgggattcacaaaatatccctatgaaggataaattattatacctattttaaagatgaaagaactgaggctcagaggactttcacatgctaacatgtatcagagatgaggtttttattcagaggttaagcccctgcctgtaaccactatgccatagtgcctctcaggtgccttgtgaagattagaaccaggagacaccaagttccctataccagtcttaaaggtcaagtgctgtctgatatattggagcaatataccagacagggtcaagtgctgagatttcgtacacagagcagagaaaatgtgtccgcccactgcatgctcaccaaaggccgaggagccagagcctgaagtgtggtatgagcagttggacaatatttttttccctcctgttggagttgaattctttgtggctttgaaccaagacagaggatccataagcaatttttttcccattatgaaaacatgtttatttcagtcttttagggaatttcaaaagataaggtttagtaatttggaatttttgtgttcctggccgtaatcttctttaaaaggtagtcctaaattagagggggaaaaaaaactctgcagctgttatgtagtaatatttggtggccttttttctccggaaggcatgggtcaggcaatgtgagcccttgatcacctgatctcactcacccaaggcccggtaaagacaagtaattcatgtggagctatgtgaggcagatttctgagaaagaatcctagactatcagactcttctgccttgggaggatgtgttggtcatctgattctgtgtaataaaccatgccaaaacttcatggcttaaaatagtaaccattttattattattattattattattattattattattattaccattatcattatcattttgagatggagttttgctcttgttgcccaggctggagtgcaatggtgttatctcggctcaccgcaacctccacctcccaggttcaagccattctcctgcctcagcctcccgagtagctgggattgcaagcatgagccaccacacacggcctcattttaatatttttaatgattcagtagactgggctgcttgggctcagggtagatagttcttttgatacatgtgattttcggctggggctgcaaacgtctgaaggcccaattggagtggcacatccaagatggttcattcacataactagacattgacgctagctgttggacaggacctcagctaagactatatagctcagggggcctcagttctcctccatgtggcctctccatgtatcttggatatctcacagcatggcggctggactctcaggaccttcctccatcttacttcctctaagatggaggaagtagaaacttccagccctcttaagtcataggcatagaactcccagaatgtcacttttacgacattgtatcagtaaaaaaaggagtcacaaagtcatcctagattcgaggggagagaaaaactaggtccactttttgatgcgaagagcagcctgagcccacagaaagtagaggaaccatcaaggccatctctggagactagctaccagcatggaagatttgttcctgaagccagctagagctctgctcatcaccctgtactgctgaggaacgtgaggaatcaaagtgactctgcagggtgttttgtaccaggactgagccagaaaacacacttagagggcttgtgtgtgggcagaggactcccaccttcggaatactcctgccgtgtttctctgcatcccaccaggcagaggcaagagcacaggtgggcagatgttgggggaactacacttggtggatcattttagagactccaccatgggaattggcaagaacaggcatcagccctaacagcttcctttccttgctgctttggagggtcctttactcttccaagagcctactgcttagagagttccaccagcctcctgctatcagtggagctttggagagactgccaaacagcggtgacatatgaagtaagagccatgtgttctgtgggacccactcccttcacacttgcttaatctagaatgagaaccagaccctaggatgttcctaaaactgtgaagcaagcacccgaggaagtgaaaaagacacatttgtcatgtggaatcctattttagccaacttgtttgtgagaatcctggcaccctaaaagccagctcttctgatatcatgtgcccagaggcaaatattacctgtcccgccaaccgcatagggcagctgtgaacctctgaccagattgcatgtgtgaaaatgattaagtgataacagtatgcccctgttatggaagctatagccatggaatatctaggtgcataagagaaggaaaattccacattcatgggcagaatccaagcatttggttgatgtcgtgattgccagtgtggagatcctggtctggctccagaagggacatgctgaacaaggcttacataaggaagagcagaaaagccttccccagtgccacatttcattatcatcaagagatataagaggagtcagcctgccactgggaccttcactctttagttggaaatgcatcctttccttgtgagttctggcattttctataaacatgcaagcattgggccctgcacacacatccagttccaatatatcagacacactgcccaaattccacagacccttacatcaattagggacagccaggacatgtaggtgatcacagtgactatctgacaaatcaggatatgtaggagcctgagaaagacaatggaaacaagcattaactggagcaccttagattccagcccattttgggctgagtattgtggcgatggtcatcctggaacatgggaaccacatgactgacagccctgccagaagctcagagagtagggagggtcaggggccaaaaggaaaggatgcaagtcaggcaaagaaaaaaaaaaaaggaccaggcacagtggctcatgcctgtaatccctgtactttgggagccaaggcaggcgggtcacctgaggtcaggagtttgagaccagcctgcccaacatggtgaaaccccgtctgtactaaaaatacaaaaaattagtcgggcgtggtggcgtccgcctgtaattccagctacttgggaggctgagacaggagaatgcttgaactcgggaggcggaggttgcagtgagccgaggttgagccactgcactctagcctggcgacaagagtgaaactccatctctaacaaacaaacaaataaacaaacattagccagtgcccactatgaccaagtagagatgcaacagtgaccttgcccaatatttgtataattgaatgaatgacacaaggtcttgggggtttaatcatcattgacccatgtgcacctgtgaacaatctaagcaaacacctaggctgatataggcggagcagggcgggcggggcgctggatgtcaaagtaagaacagatgccatggaaatccaagttaatgtaaccagtatgactaattctagttagtgtaagcaatgcagttgcacgcctcttctggagactccttacgacctgtgcagggctttggacgttgccagtaactctcagacacatcttctccggagtcagattttatgccatgtcctccttttgtttcaggggttcctggtggccttgcagtatggttttgccaatggagaggtatgatttccacgttgccatcctggtttcatgtgaggttgggactgcaaccctacccacctctggaggtttctgtggatgggatgatgctacgggagaatgtgcagtgaccagcatgtgtggggacaaatttgtattgtgagcttccggtacagagagcaggaggcagcttagacaaatggaaaaaaggtgtcgggatgggtataagggagttcagaagccagcactggctctgctggagatgcaaggagtattcaaatgtgacagaggaaacaagcttgaacctcagagtccaaaaatctgaattcacgccttggttcaccctcaggagttctgtgagttagctgggtcaccgcactttgtttagcctcactttcctcatcagtaacatgggagcaacaatcatccctgctttgtagtcttgctctgggtatgctgagcacatagcaaataaatgctcaacacctgggaactatgattacatttttttaaaaattatttttatttttttgagacagagtctcactctgttgcccaggctggaatgcagtggcatgataccagctcactgcaacctctgcctcccagattcaagcgattctcatgcctcagcctcctgagtagctgggattacaggtgcccaccaccacactcagctaatttttatatttttagtagagatggggtttcaccatgttggccaggctggtctcaaactcctgatctcaagtaatccacctgcttcagcctcccagagtgctgggattacaggcatgaaccatgaagcctggcctattattgcttttagttattcatattattgcatagcccaaccagctctctgcttccctgggaaaagatttgacagtgggaggggcagaggccagaacaggtgttttctcctgtctttaggagttggtagagtttccaaccccttttcaacctcctctcgccctactacaagtgtaaatatttatttctgtctcctcccattatgtacttccacttacatagaatgtacatagctcacattctatgtaagcttcttgacagcaaaaccatcttctgttttgctcactgctgcttcttctgtatcttcatgcagggggctcctcacctatcaagcaggtttcagctcacatgccaccccggcagagtcctttcctgaacaccctgtcttaagtttttgtttctttaccgtattgtcctgcttagtactctcacagtgtcatcaccaccagacatgtttatgtatctttgtttctccttgtctcccccagttaaaaggtaaatttcccaagggtggcacagagtagctactcaattaatatttgctaaatggacacatggctaaatgactccaagacagtaacctctcacttgtctcacccggcaggtgaaggctgagctgcggaaatactgggtccgcttcttgctagcccgccactcaggctgcagagcctgtgtcctggggaaggacttccggttcctaggaaaatgtcccaagaagctctcggaaggagatggcgctgagaagcttcggaagctgcagccctcacttaacagtgggcggctcctacatctagccatgcgaggtcttggggagctgggcgcccagccccaacaggaccatgcacgctggccccggggcagcagcctgtccgagtgcagtgagggggatgtcaccatggccaacaccatggaggagattctggaagagagtgagatctagggtggagttccaccaccctggctctgctcccagggactcttgagggggcccaggaagaggaagcaaagcaggacacacgttgctgggcacggaatcattctcgttccattcaccatgccactttgatatgaaagctatcacaaggttcttcaagctctgtatgaaagaggctgtgtgtcatgctcacagcctctgcctgctcttctcatcctaataacccccaccagtgtgttttccacaatgcccaccagaccctagggcctggctctaaattcaagccaatgaagtcccaccatgaagagaggtctcctgttatagagaagccagccaatatctcttcctttatcccttggggtgcatgctttccatctgaggttgggtttagggtgcgtgaaaacctcctaggaagcttttaaaatgcagaatcctagacttgtggctaagattctaagacagtgagtctgggaccatggccaggaattggagctgtttaataagcatcccaggtaattctgctgcaagcccacccttggagaacactgggcagggtgagagggagctagaagcgcccccatgtggccatggcaggatgctgcaagagacagtctgctctcccaggtcagctggggtgtgcctgccctccttggagagtatgtaactccacccaccagagtgccactcctctctgctcttcctctcctatcaagtcttgcctctctctctctttgcctcagttctctgtccctgcacagcaggagttctgcttgatcctccctttgaggattggccccagtgcctggggaccctctgaatgtcgtctttggtctgttcctctcctttctggctctatctacctttctgagtttggcttctaccagcctgatttacactaccattctcttggggcaaggaatgtccccaccatttttggtttgccattgatgcattgattgtcacacctgttgtcccaggaagttgacctataactctccatggccagagtccctgctgatcagaattcaatttgcccagtgggaataaatactgaaagcaggagggcccaggtaaagcaataggagtttggctggatctggacatgcccagggtggctctgagagatccaagactttgcatccaccagcctgtgggatctttcctgcctactgtgacccatggaggctgaggagggcccaggcagttggggtcaggctcaatgactgaaagtatagggcaagaggctgtaggaagatcaagggatggacatcctttggaaacagtgtgttaatgcacaggagtgtcactttcatggtatgtaaaatgcatgtgtacgtgggtggggtatgttgctatgggactaaataccaccttgtcttcgggggagtcagtttgatactcctcaagcagggctgccatatttagcaaacaaaaacaaggtactcaattaaatttgaatttcagacaaatagtcttcttgtataagtatatcccatgggcatatttaatctgagattggaattcaatcatgcatcttgtcttttactggcatctctgttttcaaggatactttgccacagggctgggactagggtgaaataatcaaggcactcatctctaaaaagctcaaagtaaatgatcaaaataaatcatattttaatgcaatattctaaaaaaacaaattaacaaactacagcccatgagccatttatagaaatgaaatttgattggagccaggggcaggataagggtgaggcaggagaggccagctcttgcaagtgcaggctctggtcctgactttcaaatgttgtctatgagggacttttaatgtgaatttttatttttagacaattgcattaaaatgttatttatattgactatggggacttttggggcccccttaaattttgcacttgaaatgggatccccacttgtgtcaccccatagtccagccctggttttaggatggggatggaggcaaaggcatcaggcaagtaatgaagcaa

SEQ ID NO: 16980 - DNA, 28393 bp, Human
  misc_feature (1)...(28393): n = A,T,C or G
gaatggaacctatagtagatgctcagcaaattctacatgatgcaaattaaaatcaaggatatgagtatcatgtcttaactgtttaaagagtaggttttactatgaagagatccataagtaaagagcatttgaaatgaaaactttttcctaaacttccctcttttttttaacattgtgtgtgtgaagttaatgttgtatttctaatatgagcttaatgttgcaattaatgtatagtggaaaataataacacgtatattaattcatttttgagacaagagttcgctctgttgcccaggctggagtgcagtggcatgatctccgttcactgcagcctccgcctctaggcctcaagcgatccaccggcttcatccttccaaagtgctgggattacaggagtaagccactgtgcccaagccatcaataaatttttatgggttagaagtttgggccaggcctggtggctcatgcctataatcccagcagtctgggaggccaaggcaggtggattacttgaggtcaggagtttcagaccagcctagccaacatggtgaaaacatgtctctataaaaatacaaaaagtagctgggtgtgctgggcgcagtggctcacgcctgtaatcccagcactttgggaggccgaggcaggcagatcacgaggtcaggagatcgagaccatcctggctaacacggtgaaaccccatctctactaaaaatacaaaaaaatagccgagcatggtggcgggcgcctgtagtcccagctacttgggaggctgaggcatgagaatggcgtgaacccaggaggtggagcttgcagtgaggcgagatcgcgccactgcactccagcctgggcgacagagcgagattctgtctcaaaaaaaaaaaaatagtagctggatgtggtggtgcgtgcctgtaatcccagctgctcaggatgctgaggcaggacaattgcttgaacccaggaggtggaggcggaggttgcagtgaaccaagattgcacctctgcactccagcctgggcaacagagcaagactgtctccaaaaaaaagaaagaaaaggccgggtgcagtagctcacacctataatcccagcactttgggaggccgaggagggcggatcacttgaggtcaggagttcaagatcagcctggccaacatggtgaaaccttgtctcttattgaaaatacaaaaattagccaggcatggtggttgatgcctgtactcgggagcctgaggcaggagaatcacttgaacctgggaggcagaggttgcagggagccaagattgtgccactgcactccagtgtgtgtgacataacaggactccgtctcaaaaaaaaaaaaaaaaaagaaaagaaacacatggaaccaaatcaggatgaaagaaactggaatagcagtttgttataggctgggcttgttggcttgttcctgtaattccagcactttgggaggcccaggcaggaggatcacttgagtctatgagtttaagaccaacctgggcaacaatgccagatcccatctttaaaaatatgaatagcacattaaattcattgattttttttttttaagtcttgctctgttgcccaggctggagtgcaatgacgtgatgtctgctcactgcaacctccacctcccggattcaagtgattcccctgcctcagcctcccgagtagctgggattacaggcacccgccaccacgcccagttaatttttgtatttttagtagagacagggtttcaccatgttggtcaggctggtctcgaattcctggcctcaggtgatccacccacctcagcctcccaaattattgctgggattacaagcgtgagccaccgcaccgggccggaatttttttaaaatgccaatactggtgacaggattagagtatattaactgattttacttagtctttccattcccacattaattagttctcaaaatttatttgcatgctacaaaagagctcaacaatttttttattacgtgcaatttttttaataggaataaaaaaatacgttgttggcctcattatcaagacgtcatctgacccaacttgtgtagaggtaagagtttattttggagcttattgggagagcataaaatcatttagatattgagtctgactacaacctaattctgtcaagacacatagtcacacatatgcacagtcagtcatttacagtagagctgtaatcatttgttaggattgtctggttatattcttatttatacttacctcaggctctcatttaatcttttacttttccttagaaagaaaaggtgtatatcggaaaattaaatatgatccttgttcaggtaagctttaacttaactgttttccttagaagaattatgcttattatttgaacaaaatgttcgacctacttaggaaataaagtatactaatattttgcagaagtagtgatagtattcttataataataggtaacctactgtctagtacttgaatgttaatttgctgtggcagtaatcatcaaataacgttaaagccatcatttatgtggctgcagtgtggactggactctgttggattcttatttatcttttcttttcttttttttttttttttggagacagtctccctctgttgcccaggctggagtgcagtggcatgatctcggctcactgcagcctctgctacccgggttcaagcgattgttctgcctcagcctcctgagtggctggaattacgggtgcttaccaccacgtttggctaattttttgtatttttagtagagacagggtttcaccatgttggccaggctggtctcaaactcttgacctcaggtgatccacccacctcgacctcccaaagtgctgggattataggtgtgagccgctgcacctggccggattgttttttaattttctgatatgcctgtgcatatttcctttgcatgtatgtctctgagtcctttgatttcctcgtccttctaattgatttccatgcttagtccttaaactgtctatgtagactaaatttataatttttatgtttatctgttttctatagtaatatcataaaattttttccagagaaccctggtatgtgtgggggaaaaaacagtaatttctatttaaataagacttagaaacatccaagcttccaaaaattttagtgtattcagtaattaactccagcttttattatactttagagctttctgttagcccttctctgagtggtgagagagaggagagaatataaagaaggttaacatgtatttttataatctgaaaaatcccttgtgtgtgccataaatagtccagacttgcatacaaatataatgcagttcatgaggcttttggttaaaagtttattcaggccccgattgcagtgcgtcctctcttttaaattcatatatccaaaccctactacatttcaaggctcaaattgcatccaataataagctgtcttaaccggtcactttttatcaccaatggttaattaaatccttgagtctcctaggataatttcttcttttcttgtttgaaatggagtgtcgctctgtcgcccatgctggagtgcagtggcaccgtcttagttcactgaaacctccacctcccaggttcaagcaattctcctgccttggcctccccagtagctgagactactggcccgcgccaccacccctggctaatttttgtatttttagtagagacggggtttcaccatgttggccaggctgctcttttttttttttttttttttgagatggagtctcatcctgttgcccagccttgagtgcagtggcctggtctcggctcactgcaacctctgcctcccaggttcaagagattctcctgcctcagcctcccgagcagctgggatcacaggcacacgtcaccatgcctcgctaatttttgtatttttagtagagacagggtttcaccatgttggccaggctggtcttgaactcctgacctcgtgatcctcctacctcggcctcccaaagtgctgggattacaggcacgagctaccacgcccagcctggccaggctgttctcagactcctggcctcaagtgatctgcccaccctggctccccacaaagtgctgggattacaggcatgagcaaccgcgcaaggcctcctagaataatttctacatatctatcaggcagatactaatacacagacagacccattagacggattggacctttcattaggataattgaaaagggtcctgcggtgattaagataaaagactttgtgttttgttttctacccagtagggtgaagagggtggcacatttcttcctttaataaaggaggagaaaatgaaaagtgatttatccttactcctgcctttatccattacataatttctttgaagtttgttttatttgcctttgagaaatgaagtgcgattaacatttcatgtcttgttttagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacaggcaagtaataattatgttttagaattttaaagtgatttctcaaacaatttcaagcagtttggatgtaaattgtagatattttaaggaactatgatcagtaatatgttaaattgcttgtagtggttttcaactgcagattaagaaatagtcctagacggggcctaataatttacctctgaaggttgaaaaatgaattgttcaagacacacttcaggaattgttttgtatggtaactagtttaataggttctaagcaaatgatttgtgtccaaacatacgtattagttattttattttattttgagacaagtcttgctctattgcctggggtggagtgcagcagcgcaatcttggctcaccacaacccccacctcctggattgaggtgattttcttgcctcagtttcccaaatagctgtgactgcaggtgcatgccacagagcctggcctcaaatcagttattgtctctgcttcttttcagttccccaattgttaacaatagtgttctttttaaaacaaaacagaaaactagatttgcctctaatagtaagcaactggtataaactatagttatacttccattaagttttaaacatttgttgtagtcattaggaaatctttttccccttgggttgcccaggctggtctcaaacaatccttctgccatggcctcccaaagttctgcgattacaggcatgagccactgtactgggctttaatcatttttattagtattatagataactgatacttatttctgtgtcttctaaatctgatatttttgtgtgtttttttttttagcatgtgcaatgaattctcacagatatttcaactgtgtcagtttgtaatggtaagtgtttttaatttcatttttaaaaacaataataggaaagcaattatttacaagtgtgttttgttataggaaaattctcaaaatgctccacttgtacatgcaaccttggaaacattgctcagatttctgaactggattcccctgggatatatttttgagaccaaattaatcagcacattgatttataaggtacagtgaatacatttcagttatttgtcaccggatagccacatatattcttttcacatgtaaagctctcatctctgcattctaaaccttattcaaccttgtttctaacacgaggacgctgctcaggagaaatttcccatattcacacctagtaaattatttaaagtgagtttcaaatctgattctgccacttagaccatgtaattttatgaattcattttgaacaatggatttgattatattgcttttagtttgagtaagttacagtgaggtaagtcaagtgctatttctgaaaaatgaaaagttcatcttttaactgataatttaaaattgataccatgttatggcttaagttctataatggtttagcctgggcaagttggtgaaaccggtctctactaaaaatacaaaacagccaggcgtggtggtgtatgcctgtagtcccagctactcgggaggctgtggcaggagaatctcaaactcaggaggcagaaggtgcagtgagccaagatcgtgccactgcactccagcctgggcaacagagcgagaccctgtctcaaaataagtaaagttctacagtggtttatccagagataatcactgttaccagttggttgtattatattttcagatgttttcttgactgatataatgaataaattaagtatctaattggaacattataacttgacctcttcaacttcgtagtttagtttggtaagataatatggatttatagtatttgaatgatcagtttattgcttaattatgtaaaaacctttctattgtcaacagtcctacagagaacattctcagacataagatattatgcaattgtccaaacattaatttatttaaatattttaatgtttaatcaccagattattaggtatgtttaattttaaggttttaatgccccctgatttccaaccccagacgataactgtttatcttctcaacaatagaatatataagccaattttcccatattcttattactcttagatacattgaccatttcccaaaattctaagcaatcacaagttttaggtcctgtgtaattacacagaaagtataacattcctaaaagtcatatcacagattctaggaaagttgttaaggagccttgttattttaggacacatcaaaagaaagcagtttaggccgggcgctgtggctcacgcctgtaatcccagcactttgggaggtcgaggtgagcggatcacgaggtcaggagatcgagaccagcctggcccaacgtggcaaaaccctgtctctactaaaaatacaaaaattagccgggcgtggtggcatgcatgtgtagtcccagctatttgagaggctgaggcaggagaatcgcttgaatccaagaggtgaggttgcagtgagccgagatcaagcccctgcatttcagcctgggcgagcgagactctgtctcaaaaaaacaaaaaaagtttgctcctaaagcatttactgtatactaggtaggcaataaaattccctctcagtatatctgcatgataaaatatgttcattcacttggcctgtttttgacatctacccctatatttaattgttaaagcctttttccttttaattgtgaattttaagtaaagtgtgtatcaggccaattaattttatggttccctccccccttttaaatagttcctgaatgttccaatgtttcgaaatgtctctctgaagtgcctcactgagattgctggtgtgagtgtaagccaatatgaagaacaatttgtaacactatttactctgacaatgatgcaactaaagcaggtaatataatactatcttgaaaattggctgaataattttagtgccttagaaaataccaaattccaaatgagttattttagaacgacgtatcaaagataagccataatcttttgtttattacataaaatttgtagtaagctacaaatttttatgatgtttccaaaaatttcttaaaattcaggtttggggtgtgttgtggtaatttatttctgcacactttaggagcttggtcttttgggagatacctgaccagacagtgggaaacctgggacttgttcctaacattgtgtctgaaggaattcttttcagccctagtttgattggttatctattaaatgatctagaaggttattcataatactgtgttcatggccaggcatggtggttaatactgtaatcccagaactttgggaggccagaatgggaggaccagttgatgccaggagttcgagaccagccaggacaacataaccagaccatacctacgaaagatttaaaaaatagctagctgtggtgttgcacacctgtagttccagctactctggaggctgaggcaataggatcgcttgagcctattaatacaaagttaaaatgagctatggtcacactattgcactccagcctggatgacagggtaaatccctgtctcttttaaaaaacaaggaaagatagattactatgtatgtttgtgatctgaatgaatgaattgattatttttacatttttcaatgtcagtgagaaatactagaaaaatttaaaggctgtgatagcggcctttaatttatttgagaagagtcaaaatctaagtcctagagatataagaataggtatactggacctaggagttctgtatgtggtttaatattagcaaaagggtgttgggatattagggcttaaaaataatagtgttggctgagtgcaatagctcagacctttaatcccagcactttgggaggctaaggtgggaggattgcttgagccaggagtttgagaccagcctggacaacataacaagataccgtctctacaaaaatgttaaaaataagcttagtgcgatggcacatacctgtggttccagctactcgggaggggctgaggaggactgattgagcctaggaggtggaggctgcagtgagctttggtcataccactgcactccagcctggacagagtgataccttgtctcaaaaaaataataataaaatattaagtgtctttagttgttttataaaatgcgaactgatcgtcccttttaaaatttgcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggtaagatatgtggagcttttgctcctaaaattctgctctgcctactaataactcttaaaagtgcctttttctaaaatgtatgtaccttttgagatttcttattacttaatatttgatcagtacattatatatattctcaattctgaattacagttataagcccagttttctgattttatgttctccataaagctaggactaaaaatttataatcaaaattaaattactaattattatatcatttctaaggttaaaatttcaaagaccttattttaaaatttcagttttaattcaaataacatgcatttgttcatttaaagatatacaattcatcgtgtaatcccagcactttgggaggcggaggtgggtggatcacttgaggcaggagttcgagaccagcctggcctacatcgtgaatctctgtctctattaaaaatacaaaaaaattagctgtgcgtggtgtcacatgactgtaatcccagctcctcaggaggctgaagcacaggaattgctttagcccagtaggctgaggttgcagtgagccaagatcacagtactgcactccagcctgagtgacagagcaagactctgtctgaaggaagaaaatgtctctctctctctctttatatatatatataaacttaagtatatatatatataaacataagtatatatatatatacacacacacacacaattcagtggcatattagtatatatacaatgttatacaaccattaatacctagatccaaaacattttcatcacccgaaggtgaccctttacccctaaaacagtcactttctcctttgttctctccccaacttctggcaaccattattttggtttctgtctctgtagatatatctattctgattataccatataaagggaatcatgcatgtgaccttttgtgtctggtttcttttatttggtgttgtgttttcaatgttcttccatgttgtaacctgtatcaatacctcactttttatcatgtctgaagaatattctcattgtatgaatattcagtattttgtttgttctctcctctgtgatggtacatttgggttgtgataccacttattggcacccaaggccttttaaataaatgtcgttccattaggagacatgataaaaatacatattgatcaactactatgtgagagatttttgaagtgctttagggcatgtcagaagaagcagagttactccagagtttgctgtctatttgataagtattgaaatctgagttgtgatgaataaaacatgaatttttattttcccttaaggtgtaacaagtgaaaagcaatttgaagttggtaatgtttaagaattattttaacagttttggtcttctgtgtaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtaacagagcggttggttgagtgttcttcctgttgcatactgtggttttgaggtctgaatccaaatacttctaatctgtgtaaataaattagctataaaaagagaacccaacaacttctccatgagtgtggaaaactagaacatgaaaggagttgagtctagaaccttgattctcaagagtgtggtccttctctcagtatcaacattggttgtgatttcgttaggcaaattcattggccacctgccaatctactaaaccagagtctaggaatgagacacaggaaactcctgtaacagaagttggttaaaaaaatcacattaaaacacacttaaataattataaagccatttttgtagaattacagtgaaaaaaaattttttcttttggagacagggtcttgctctgtggctcaggttggagtgcagtggcgtggtcatagctcactacaatcttgaactcctagactaaagcaattctcttgtgtcagcctcccaagtaattggttgcaggcacacaccaccatgcctagcaaattttaaattttttagttttacttcatttatatttacatagttttttctgttgtgctttaagccccagtatttttattgttttagagattgggtgtcattttgtgttgctcaagctgctctcaaattcctggccacaacagttctttttgcctcggccctccggaatagttggaattataggcatgaatccctacacatggctggcttgtggtttttttggttttgtttgtttttaactaagcttctacactaatgatttcagtgatctaacgatttttttcttgattgatatattgttgagtataggtccgtttattaatggttagtcgaatggctaaaccagaggaagtattggttgtagagaatgatcaaggagaagttgtgagagaattcatgaaggatacagattccataaatttgtataagaatatgagggaaacattgggtaagttaataaatactgttaatctttacctttataaatctattctggggtggaaatacattttaggaaatgtacttgtagtttctaaatattttctaaatgtattgttactcatcaataaaattctgctcattatttgcatttgaaaccatgtttttctttgtagtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggtatgcaagggataggtatgaattagaattgctaaataagtattatgttgttacaataaataatacaaatttgtcttatttacaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatggtaaatctctttctttactatattttgcttttatttttattgaagaaaataaatgaatgtttttgtcttgttagagacccatgatggagtccaggacaaaataaatgaatatttttgtcttgttagagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggtatgttaagcactgagcatatgttatttttagaaagtaacacttgtatcaatctgtatgtatcaatggaaataggagggcaactattggatccaatagaagtgtttctgattaaattttctttcttttttccttgagacagggtcttactctgttgcccaggcttgagtgcagtggcacaattacggctcactgcagccttgaactcccaggctcaggtgatcctcccaccttggcctcgtgggtagctgggactacaggcatgcactgccatcacactcagctaacctttttcccccccttggtagagatggggttttgccaagtggcccaggctggtcttgaactcctagcttcaagcgatacgcttgcctcagcctcccaaaatgattttatatgtgtgagccaccacgcccagcctggttaaattttcatagtgagacagattcttgaccagaagattgttaggctgttgtcctatgtaaaattattccgaacaaacaaaatcaggtgttttttgttttgttttgttttggggtgtgtgtgtgtgtgtgtgtgtgtgtgtgtgtgtgtgtttgttttttgagatggagtttcactctgtcgtccatgctggagtgcagtggcgcaatctcggctcactgcagccttgcctcctggggtcaaacgattctcttcctcagtggctatgattaacaggtgcttgccaccacgcccagctaatttttttatttttagtagagacggggtttctccatgttggtcaggctcatctccaactcctgacctcatgatccgcccgcctcggcctcccaaagtgctgggattacaggcgtgagccaccaccatgcctggccagtttgggttgtttgtttgtttgttttttgaggtggagtcttcctctgtcacccaggctcgagtgcagtattgcaatctcggctcactgcaacctctgcctcccaggttcaagcaattcaaacctcccaagtaactggaattataggcacctgccaccacgcttggctaatttctttgtatttgtagaagagatggggtttcaccacgttggtcaggctggtctgcaactcctgaccacaagtgattggcctgccttggcttctcaaagtattgggattacaggagtgatccactgcacctgggccaaaatcagtttcaagacgtttgtgaattgcttgtgtgtggttttccttattagggtgtataacataaacgttaaaatgtctgctttttaaaataggttcatacgttttatgaagctgtggggtacatgattggtgcacaaacagatcaaacagtacaagaacacttgatagaaaagtacatgttactccctaatcaagtgtgggatagtataatccagcaggcaaccaaagtaagtatttctaccttttcttaaaagttttcatgggatttaacaagacgtgttctttacaaatgtattgaattcaagccttttaacatgtatgtgtgatccataagtgcttttatgtgtgtctttctataatttattatctgggcgaggtgtggtggctcacgcctgtaatcctggcacattggaaggccgaggcgggcggatcacctgaggccagaagttcgagatcagcctggccaacatggcaaaaccccgtctctactaaaaatacaaaaattagctgggcgtggttgcacatgcctgtaatcccagctactgaggaggcttaggcaggagaatcacttgaacccaagaggcagaggttgcagtgagccgagattgagctactgttctctagccgagacgacagagcaagactctgtctcaaaaaaaaaaaaataaatgaaaaatctgggccgggctcggtggctcacgcctgtaatcccagcactttgggagaccgagacgggtggatcactaggtcaggagattgagaccatcctggccaacgtggtgaaaccccgtctctactaaaaatacaaaaattagccaggcatggtggtgggcgcctgtaatcccagctactcgggaggctgagccaggagaatggcttgaacccaggaggcggagcttgcagtgagtcaagagcatgccactgcactccagcctggtgacagaggaagactctgtctcaaaaaaaaaaaaaaatactgtaatttccattctcatttgatattaaaataggaatagctgggtgtggtggctcatgcctgtaatcccagcactttgggaggccgaggcaggcggatcaccaggtcaggggatcgagaccatcatggctaacgcagtgaaaccctgtctctactaaaaatacaaaaattagctgagtgtggcggcgggcgcctgtaagtcccagctactcaggaggctgaggcaggagaatggcgtgaacctgggaggcagagcttgcagtgagccgagatcacgccgctgcactctagcctgggcaacagaacgagactccgtcccaaaaaaaaaaaaatagaactatattacttcattcttaagtagatgtagacaaaaaggcgtttgnnnnnnnnnnnnnnnnnnnntgttcgtttttaccatttgggattataaatatggtttagggtaagggaagcgtaatggcttttgctttggtaattatgtggatttttttttttttttgagatggagtttcactcttggtgcccgggctggagtgcaatggcgtgatctcggctcactgcaacctctgcctcccgagctcaagcagttctcctgcctcagcctcccaagtggctgggattacaagcaagcaccattgtgcctggctaattttgtatttttagtagagacagggtttctccatgttggtcaggctggtcttgaactcccgacctcaggtgatgcacccgactcagcctcccaaagtgctgggattataggtgtgagccacctcgcctggccattatgatggataattcttttttttttttgagacggagtcttgctctttcgcccaggctggagtgcagtggtgcgatctcggctcactgcaaactccatctctagcgttcacgccgttctcctgcctcaacctcccgagtaggtgggactacaggcggctgccaccacgcctggctattttttttgtatttttagtagagacggggtttcaccgtgttatccaggatggtcccgatctcctgaactcatcatccgcccgcctcggcctctcagagtgctgggattacaggcgtgagccactgttcccagccgtggataattcttatatgataaatggaatttgctttttttcctccaagaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtaggtgattctgatttcttacacaatgcagtataaacaaaccacttctcttctactgccttaagtcaaacatttgatgttttttacagatttaaatcagacctcccatttcccaaatgaccctagacatatttaaaacagttaagtgtacctttcccttttaaaattagtcttaaagcttattttcccaataaattttgtgaacttttggctttaaactttttaatggtaaaatggaattgcatctaatgtacacctgagtaccactgtataagtttagtggtaaaattagattccatttgattctgttttgtaggtgaaatggttacaaagcaaccattgattagaagtatgcgaactgtaaaaagggaaactttaaagttaatatctggttgggtgagccgatccaatgatccacagatggtaagtgagagatgctttgcttttgatttctagtgttgatgctgtgttttatggaatatgctatactctattatgtgcattttgctaatttaaagcatatcaactttgtggttattttatggcattttatttattgtagtccttacgttaatatactaatagctgtattccatcttcaaaagaaactgctgttaatcagtagcgaagggtggtgatatgtaacaagatagctaagaaaattgggtcattttatgtttccatagataggttaggaggatttaattaatggagtaccggtgcagtttttgcattcctcttgatttttagaacaattgctagagctacaaagttgtcattactttacctctttagcaaagtgattgcttcccagattaaaggcctgaaagtcttttttacaccctttttcctaaatgatttgcagaaaaggaaatcattttcagtaataaaaaccagctgcgtatgcctcaacttgtaaaattgtgaattagttttaggttttaactgtatcgtttcattcttgttattcaattgagccttgggagagtccaaaaaattctaatactactattacttggaatagtgttggttttttgttttttggtttttttttttacaagtgtgctagttattttcatagttttgaaatttcagtattgtttcttgttaaggaaatacttttcagtaaacttgttctgaatataattcttgtggaatacttaagttggctaacctaaatatcgaaaggttctgaacatgcgtattatgtgaacagaactgtatttaaaatttgaaagcagaaagtaagatgtattgaaggaattgtgatgtttgtaatttacaagaagcttgagcacgtgtcgggagcacagtgggaataatacaaagggtatcatcttttgtaacattaatgttaaagtttgggatatttgttcacatgaaacattgtgtttattttccttgtcttggcttttcacggtggctcatgcctgtaatcccagcactttgggaggccgaggcgggtggatcacttgaagtcaggaggctgaggcaggagaatcacttgaaccccagaggtggaggtgacagtgagccaagattgcgccattgcaccccagtctgggccacaagtgggaaacttcgtctcaaaaaaaaaaaaagaacaagaagttactctttaagtataactcagtttacttagaatcatgaaaatcttactgggcattgtagcatgcacctgtaatcccaaccaccagggagggtaaggcaggcgaatcaccccagctcaagtccagtttaggcaacatggcaagattcagtttcaaaaaaataatagaaatccatagtctttcttattttctgagagtaattgattgatgttatttctgcttgtgaaaatactcaccagttagcattcattagattaaaacattagtctgagttgggtggatcacgaggtcaggaaatcaagaccatcctggctaacacggtgaaacaccccgtctctactaaaaatataaaaaattagctgggcgtggtggcaggtgcctgtactcccagctactcgataggctgaggcaggagaatggcgtgaacctggaggcggagcttgcagtgagccaagatggcaccactgcactccagcctgggcgacagagcaagactccgtctcaaaaataaaaagacagtattgagggctcgcttgctgccatcttacatatacagtatacgtagaatcctgattctgccacctaagttggagacacccactgaattttgagcctcacttttcttattgtgagagttttgtagctgggcatggtgctatacctatagtcccagctactcaggagactgaggcacaagaattgcttgaacctgggaggtggaggttgcagtgagcagagatttgccactgcactctggtctgagtgacagtgagactgtctcaaaaaaaaaaagtcttgaatgacagtgtgtccatgagacttcccaacccattgtgatttcctgctttcttttgctaaaaactgttttgacgtaggaaaccctaatacaaaccctacctgttttcagtagatgatcatgctacatctcatagacaggaataaccttgttgtttaaaatagtcaccatgtacctaaattaaaacataacttttttttccctccccaacaggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggtgtgtaatatttcagttatgtaagggggaaattctgcaggatagccttaattcttgaaagctaaagtatgtctgtggatataacataattttaatgccatggagtttaaatatttaaacttgtatattagggaaatactttcttggttttcaagaacttacttcccaggagtttgaaaccaacctgggcaatatagtgagacttcatctctacaaaaagttcaaaaagtaaccagtcatggtggcatgtgccggtagtcccaactactcgaaaggctgaagtgggggggggggtcacttgagcctgggagttcaagatggcagtgagctgagattgcgccactgcactccaagaagaagaatttactacacagaatcttgattggtaaaaagtaaatatggaaaacagattttagcattcacatggtatgtagcatttattgaaacctcataggtcggggcatccttttatgaacgtagttgtattaattggtttgaataaatgagaaagtaagtctgcatgtttcaattataaaagtgtagtatatgcttataagaaactgaaaaatgtgttaacaagagaaaataggctggccatggtggcttacacctgtaatcccagcacttcagaaggccaaggcgggcggatgacctgaggtcgggagttcaagaccagcctgcctaacgtggcaaaaccccatctctattaaaaatacaaaaatggccaggcgtggtggctcaacacctgtaatcccaacactttgagaggccgaggccggtggatcacctgaggtcaggatttcaagaccagcctgaccaacatggtgaaaccccatctctactcaaagattaggctgggtgccgtggctcacgcttgtaatcccagcactttgggaggccgaggtgggcagatcacgaggtcaggagatggagaccatggtgaaaccctgtctctactaaaaatacaaaaaattatccgggtgtggtggtgggcgcctgtagtcccagctactcggagaggctgaggcaggagaatggcatgaacccgggaggcggagcttgcagtgagccaagatcgcgccacgcaatccagcctgggtgacagagcaagactctgtctaaagaaaaaaaattagctgggcatggtgccgcatgcctgtagtcccagctactcgggaggctgaggcaggagaatctcttgaacccaggaggcggaggttgcagtcagctgagattgcgccactgcactacagcctgggtgacagagtgagactgtttaaaaagaaaaaagagataaaagatacgttaagtggacacatttacacggtaacttaaatttttttgtaatctgtagtggtgatttcaaattaaaaacaaaagtgatagtagtagtcttatggtaataatggtttagatgagttctctattaaaaaggttgtctttctccttcaatttgataactcatgtgcgtaacgggacagtttcattttccgtgagaggtggattgtattttacttgggtttacctttcaggaggcattctatcttctgtggtttattgaaaactccaaatatttatactggattaagccttgcttttcccctcctgtctagcacaacaaagacactgaaacattattttgtttccaccacttatttttaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggtaaataaaagatgttcttttattcatttgcctgccaatccaaaaatacaaatatagttaattgtacataggaaggtattacttgttcagagttttgagtgtgtgaattacatatatgaacatctgagaaaatcctataagcagtttaatcaactgttccactccactccaagtgagtccataggcagaattgagttatggggagagcggcctagtaataattggtttgcgtaatacaaagttctactgggtagtgatgttgtagaagttcatatagaatcagctgagctttcagaaatggtgaaagggtggtaatagtcataacttagattgtaatttttttcccataggcttttaaaaaatattcatgaggttctttttttatttcaatagtttttggggaacaggtggtttttggttacatgaataagttcttcagtggtgatttctgagattttggtgcacctgtcatgtgagcagtatgaactctactttatgtgtagtcttatccctcatgtgtatgaactccaccttatgtgtagtcttatccctcacccactcctgcccttccccacaagtccccaaagtccattatatgatctttatgcctttacatcttcacagtttagctctcacacaacttattataatttataagtaagccagcattggatatagttgtattccattattaatttaagaaaccttatgcaagtaattattagtcatcatcccaaaaaaaagggagaacagggttagattcagaatactttgataagagctaaatactatcatgagtgctgtcagtctgtagtaactttccattggtattctatgtcttttaggcttacagatactttttacactcttacaaaatgttgcacaagaagaagctgcagctcagagtttttatcaaacttatttttgtgatattctccagcatatcttttctgttgtgacagacacttcacatactgctggtaagaatttaatacgatttaaatgttaagtgccagctgggcacagggcctcacgcctataatcccagcactttgggaggtcgaggcggggagattatgaggtcaggagttcgagaacagcctggccaccatggtgaaactgtctgtactaaaaataccataaaaaaataaaagatacaataaaaatactgggcatggtggcatgtgattgcaatcccacctattcgggaggctgaggcaggagaatggcttggaccgaggaggcagaggttgcagtgaactaagattgcgccacggcattccagcttgggtgacagagcgagactccgtctaaaaaaaaaaaacaaaacaaaaaaaaacgctaagatctatagttatattacattttggagttaataattttcttcttatcaacaggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagagtaaatataccttttaataaacgtagaatgttcctggtcgggcacagtggctcacacctgtaatcccagcactttgggaagcctaaggtgggaggattgcttgggcccaaaagttggagaccaacctagacaacaaaacaagatcccgtctctacaaaaaaaaaagtagtcagaagtggtatgcatctgtaggaccagctgttggagaggctgaggcgagagggttgtttgcatcctggagtttaagactgcagtgagctatgatcgcaccactgtacaccagcctgggtgatagagtgagaccctgcctctttaaaaaagcaaaaaaaaaaaaaaaaaaaaaaaggccacgcacggtggctcatgactgtaatcccaacactttgggaggctgaggtgggtgaatcacaaggtcaggagttcaagaccagcctggccaagatggtgaaaccccgtttctactaaaaatacaaaaaattagttgggcatggtggtgggtgcctgaaatcccagctacttgggaggctgagggggagaactgcttgaacccaggaggcagaggttgcagtgagccgagattgtgccactgcactccagtgtgggtgacagagcaagactgtctcaaaaaataaaaaggctgggcacggtggcaaacgcctgtaatccaagcactttgggaggcctaggcgggcagattacctgaggtcaggagtttgagatttgcctgaccaacatggagaaaccctgtctctactaaaaatacaaattagccgggcatggtggtgcatgcctgtaatcccagctacttgggaggctgaggcaggagaatagcttcagaggttgcggtgagccgcgattgtgcgattgtactccaacctggtaaacgagcaaaactttgtctcaaaaattaaaaaaaaattcttgattaaaaaaaaaaaacattattgggacgctgaggcaggagaatgtcttgaacccgggaggcagagattacagtgagcagagatcatgccactgtactccagcctggtgacagagcaatactctgtctcgggggaaaaataaatcattatttaatcattgtgttttgatttgcagtgctcaagtaaagctctttgtgacagggcttttcagcttaaatcaagatattcctgctttcaaggaacatttaagagatttcctagttcaaataaaggtatgtatttatttgctcttgcagaaatattaggggtagatgtgaccacttttatgttacattgtagaatttttatcacttgatttgtcatgccaaataaatggggtttcaagataatacgtttacacaatctctgtaatcaaaaaacctgagactggtaatacagtgaaaaactaaagtccaataaggatagatatgtttgagatgttattcggataaacttattactaatgtaattcattttaggtagtcttaaatgtataatggaatattgggtaagaaaaacgttggtagttctttttataattttataccaattttgttagttgagggaacttgtgaaagttactagatagaatgtctttcttctgctgttatacagtgctttattcatacttttgggaagggtttttctttgaacatcttgctttaaagaaatttggaagtactgtgaaaccctaagtagttgatgaatagtttatccatgattgttgaataagaattagtctcttagctcttaaatattttctccaaaatacaaaggttttttttttttactgtaaaaatattagccaatttttaaaaaactaatgaaagttacctaggctgggcgcagttgctcatgcctgtaatcccagcactttgggaggccaaggtgggtgggtcacctgatgtcgggagtttgagactagcacggccaacatggtgaaacccccgtctctactaataatacaaaaattagccaggcgtggtggcgcacagctgtattcgcagctacttgagaggctgaggcaagagaattgcttgaacccacgaggcaaaggttgcggtgagccgagatcacgtcattgcactccaacctgggtgacaagagtgaaacttcatctcaaaaaaaaaaaaaaaaagttaactgatagctacgaagtcaatgataatataactaaacttaatttaatgacagttattaattagccttaggagaaacatctttcttggtatcttggcatatgaagaatttttagctgggcacagtggctcacacctgtaatcccagcactttgggaggccgaggcagacagatcagttgaggtcaggagttcaggatcagcccggccaacatggtgaaacctcatctctactaaaaatacaaaaattagccaggtctggtggcaggtgcctgtagtcccagctactcgggaggcagaggcaggagaatcacttgaacccaggaggcagaggtttcagtgagctgagatcataacactgcacgccagcctgggcgacagagcaagactgcctctcaaaagaaaagagaaaaaagtgtctgggtgcagtggctcatgcctgtaatcctagcactttgggaggccgagacaggtggattgtctgagcttgggagtttgagatcagcctgggcaacatggtgaaactacgtctctagtaaaaatacaaaaaatgagccagatgtggtggtgcctgtaatcccagctgctggggaggctgaggcaggagaattgcttgcatcttggaggaagaggttgagataatgtgctggggctacagaacaagactctatcacaaagagaacaaaatttgtgtgaatacatagtaggtgtatatacttaggggatgggatgcatgagatacttcggtagaagcatacaatgcataataatcacattgaagactatttactgtaaggtatcacaccattttttttgttttttttgggggggcacagtctcgcttttatcacccaggctggagagcagtggcgtgatcttggctcactgcaacctccgccatgcaggttcaagtgattctcctgcctcagcctcccaagtagctgggattacaggcgcctgtgccaccatgcatggctaattttagtaatgacagggtttcaccatgttggccagggtggtctcctgacatcaagtattcttcccgtctctgcctcccaaagttgggattacaggcgtgagccaccatgccggggcccatgattcttttgtaatcttcccccccaccagttaacaggtttgcagttcattcagctatgtagtatactgtgtcactatcctataatttaaaacccagccactttatggataatttatattccttccttctctaaaaaggaaattgctcatctatgatttctttctttgcaagttgaagtttattgcgttgacatttcaactatctgttttcacaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacatttatttttcctttattgactcatttattcctatattaatgatagtgggtatttgtgtttaagcatcaagtaacattttaaatgaagttggaccccttgatttacaaacaagatttctaaggttattgttcctagtaaatgcagcagttgtgtaaaatgaacatgttcctaagataccttttgttctcaagaaacaaattcctcctgtggcattttgactcattttacctttatttgggattagagggcacttcttgtctaactctacttagcatctaaatgtaacaaagaataaacattagccttggaatgagaacacagatgtaacctggtacaaatactaattgtattcttaaaaaatgtaagtaaactaagtagccatgagccttctcaaaagggtgagtggagccaggcttggtagctcacacctgtaatccctgccctttgggaggccaaggtgggcggatcacttgaggccaagagtcccagacctgcctggccaacacagtgaaaccctgtctctacaaaaaaatacaaaaattagccaagtgtggtggcacgtgcctgtagttccagctgcttgggaggctgagccaggagaatctcttgaatttgggaaggagaggttgctgtgagctgagattgtgccactgcactccagccagagtgagacactctctctcagatatagattgatttttttttttgcggggtggggggtgggggtgatagaatcttgctctgttgctcaggctggagtgcagtggcgtgatctcggctcactactacctccgcctcccggattcaagcgattctccagcctcagcctccagagaagctggggctgcaggcacgcatcaacgcaaccagctgtttgtgcttttactaaagatggggttttgccatgtttagacaggctggtctcaaactcctgacctcaggtgatccacccacctcagcctcccaaagtgctgggattataggcgtgagccaccgtgcctggccttccctatacattttatataatgggtgtgtaaatggacaactaaggattatcagacatctaagggcagtctcaatatgaattttaaaatggaaacgggcaagttgaaaacagactgcacaggcaaaagtaaacaaaaatatcaatcaccagtacccttagaaaagttgagagctttctgcaaccaagaaaaacaataccacagtaaaggtatatcaagagaacagaattttggaaattagagaatagcagaaataaaaaatgagttgcagaggcaggtgcggtggctcacgtgtgtaatcccagcgctttgggaggccaaggcgggcggatcacgaggtcaggagatggagaccatcctggctaacactgtgaaaccctgtctctactaaaaatacaaagaaattagccgggcatggtggtgggcacctgtagtcccagctacttgggaggctgacgcaggagaatggcgtgaacccgggaggcggagcttgcagtgagctgagacggcgccactgcactccagcctgggcgacagcgagactcctcaaaaagaaaaaaaaagaaatttaaatctcccaaaaatagagggaaaagagaaaaagatgcaaaatataaacttttaaaaatttgaggaccactccataagtaaacatgagttccaaacagaagaaaatggagtgtatggaaaaaaggattcaagagaatctccacaaacagaagggtatcaatttgctcataacaaatcaccaaatatccatcccataagatacaaatacacccccagttgtccaggtgtggtgacacacacttgtcctcccagctacccaggaggctgaggcaggaggattccttgagccaggaaagtggtggaatatgcctgtagtcccagctacttgggaggctgaggcaggaggatcacctcaaagcatgccgttcaaagcatgctgggcctatgaattgtcactgcactgcagcctgggcaacacagtgagatctctg

SEQ ID NO: 16981 - DNA, 101015 bp, Human
  misc_feature (1)...(101015): n = A,T,C or G
tctgagtcagcttcatttttgggctgactctggttttgtggtggcaaaatcgggcatcaactgtattgggcatatgtcaccagcttattaaccacagaggaaaacaaagttattttataaatgagtttgataaaatttgagaactgaggctaatggccttgcttgtgatgtctttccattcttgaacaattcacacctatgaagcaggagcagaacattctggcttgacaagttagaacctgtactcatttgtgatgctaggctgggacaactctacctgaagcatttgttccgaagggcaaaacgataacttcccaaaagaaagttaaagaatgctattaggaaaaagggaacataggatgtggaatccaaaatgacaaatttttattactctgtcctaccctctttttctctacctgcctcttgttgtttaaatatgttagttcaattggaataaagtcaagatttggcctacaggccttacattttgataattttcagagatttattataatatattttgtatttgttttataataaacttttataggttgaatttttttccctcctatgtctaatttgggggaaaaatgaatgaaggggaattatcttatattgaccaagaatgaatttagaatgtattaataataataagagtttgattgaaaaccatttttgttagcatgggacagatttgttcttgataaatagaaataagcaagggatgatgttagcaagtgagctgccaaagctttacaaaggggaatttacatttagactatatttattacatgataataattttactatggattatgaaatagtggatgtattatggttcactaaatcagtaaaaatcacatagctgttaatgatttggaacccggcttgtgaagcacgacttgtcatagctatcaagtggttgaaagtgttggtatgagagttaaggacttcagtgctcaagtccaagtctggctgattttgtggtgtgtggccttggacctgatttctctgggatgcaatttccctatatgtgtagtagagtaataaaatgtagtcaccacacagtggtggaggaattaaatgcactgacagggaggtgcaggtttccttgtatttttcaaacaatgcatatgttcagctttattttcccaggtacctaataggaccccttgcagtaagtcacttaatgattctccatggtccctatggcaccatttattttagcactatactgttctctaagatggcaccataaaggactaaatattacccaaagcaagaggagtaaatactgctatatgggttgtactttcagtacctatttttgagcttgcaaaggagcatggagaatgattacagctagctctcaggctttgcagctcatttcatatatcattgcctatattttaatattcctttaaaggtttttgttttggacatcatccttcctcccactcctcatcccatttccccaaagcagtgtgatattttatttatcgttacaaaaatggaagcaggaggctgaatttttctgagataagtggtcagtatggtgtaacggaaaaatcagagcaccaagaattagatttaaattagtatgtgaatttggctgcattcttgctggtcaaccttgggtttatcactggcctctctgattctattttttcatctataaaataaacaaaacaataaagctgactgtgatacatctttgctataaaggctaaatggataatgtcaacaatgggaaagtgtgatccaagtgcaaattgtcattatgattgtgatgattataaatatatgtatcagtatattaggaatttgttgacaactggattcctgtgtgctctgctcccatttctccaactcccagagatgtagaggatccccgccagatggctgatttgccagcggtgtcttgttttgttattgtaaatattacatgcccgaactgggaggccttgcttataatgtaatatgttttgttctttatctcttgcagcttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtacaccccagggccagagtccacagactcaacaaggaaaaattttttttttctttagctttctccataaacacagagcacatttcagcactgtgattagggaaacatacatttttgtttattggtaataacaacaatgactgcctgacatgctatgcgtgttttttttgatctaatgagggttggtatatttagctttgcatatgtttgccaaaacagagctagcaaaggacctcatcaatgtttaaattcaaataagcactgcagctaccaactgtgatatgatatgtgtcaaacaaagtaaccatttgagtcagattggtgtctttgttgtgcatttttgacctgttttgttttgtctctggtaatgctgcagccataagggcacctgcagacggtttgtgcattcagcagatagaaaggacaatctcaaatgaagttatgaggaatatgtgtgtatatacatatatctacctattagggccaatgatgtacttatttgagtaccaacgagtaaaaactagggatatcctttgatcaccattgtcacaaacaccccatcatagtttactggcaaatagcaaatatcatttttgatgactatcattttgatgactgtcatttttaattgtctcttggttcccttttagccatgaaaatcattattccagttaccattctgaaacccaagggatgattctatcccaatgtagttgatttctgacatgaaagctgaaatatatatgttcaaaaataaggtgcaacatgatttctattttctttcatttgcgatactggcatcacaggtagattggtatttaaagaaaaatagcaatgatgactgatacagataaaacctatataacataacttcccgtgcacacatggtttttatgaaaatcacttagagcagatagatagatcttttagctagaaatcactagcttgagtgatttctcacattcatgcagctagtttataaaatctgggattcaaactctggggtactcatttcttttctatctcccttgattagtaacactaataattaactaattgaataagaacttaagtattgattacattggggcagtgattcacattagctttggaaaatactttttgctgcccatcaacatcagatgaacatgggagatggacggaactacatattgtccctgaaaattacaagactttatctaatcattcattgtcacagtaagtttgataatatatgcacattggtttcttgtggtataaataatgtgactgtattatttattttattttattagaacagaatgctcaccctctcctacaaaatactctcacatgttcaaaaacaaatacacaatatatcctacttaattgcatatttgaaatttgtataagtttctattacaataacttttctggaacacatggcagagtcttgtttaatttttttatcccctaaaacactgtgtcttgggttgttttttaatctctgtctacctagcagttggagttgtgggaaaaaaaaatgtcccattgttagcacgttaatctccaaactgttaagatgcgtgctatgtaaggtattgagagataaattgttctgcatccttaaggccagaagatgtgtactttattgaaaatggtacagaaaattcaatgaaaaagaataactactccttatacgaagcagccaaaacttactatcaaagaccaatgaaagtttattagatacagtgagaacaattttaagatagctgaaacccagaaaacatttcaaaaatcacaaatccatcacaagtagcaatgagagggaagtagaaaaggatgacaatggctcaaattatgccctaccttaagaagtgacgcctatgtgtttttttcactttcattttcatgtcttccaattgcttatgctatttgtagctgtgatgcttcgaacctgttatatgtaaatgtataccctcgtgctacttatttgaactattgcaacaggacatgttctgcttagacataatcactcaagtgaactcaaatcctgattcagagccaagtttacaaaagtaatcctgaattattccttaacctccatacactctattcatttataataagcatttataaaaccagtagatccttctgtgctatccaggcatgctctcatggttttcctcctatattcatctaacttggcttcacactggtaagtgttgcttttcctaaaactgacttcaggtcctcagtttatttcaggaactcatgacaatgtctttccaatatattttaatgcactagctttcacatgatgatgttatgaaataattaacttattgctttctaatcttctgctgaccttctagatttatgacttaacaaaatgcagaaagccacaggttcatgccaatggcattttaagatcctcttgtgctcaaaaaagtgtcatgatcaggaaagataccagtaatgaccacatctgaataactctgctggccatggtggcaagaatcagaaaccaccaccatgccttttccttcccccttagtctggcttgcagtgtttttctcactctgttatcagtttgtaccaatatctcttggccttcaagttcctctttccaagagtacaatatgaaggggtttgtaggaggaattattcatgtcacttcctatagtgtcattctatttctcacttctttctcaggcaaatttggtttttggggaaactaacagacaaacaaattgccttaaaatttgcctctaataatccatgcttgcctcagttctaagtaattttacatatattggctatttaataataataatgaattctataaggtagatgatataccatcctatgtttatttccttatcttttattattatgttttgagatagggtctcactctgtcacccaggctggagtgcagtggctgatcagggctcactgcagcctcaaccttctggtctcaggtgatcctcccactccagcctcatgagcagctgggactacaggtgtgtgccaccatgctcagctaacttccttattttttgtagagaccaggtcttgctatgttgcccaggctggtctcgacctcctaggttgaagcaattcacctgccttggcctcccaaagtgcttggattacagacatgagcaaccactcctgcctttgggtacttccttgatgtaagatgttttaataggtcctattagaatgcaacaaataaagcagtctttaccttcatgagtttgagttaatgtggcaaaatgcttctaagtcatttctttcttaactttcagtcaaattaatgatctgtggagcccttcctcatggccttaaagatgtacctttccaatctcctacttgcggaagtataattgaccagtgctcaccaatggctgtgctctgaaatccattgctgtgttggtccagagaccacaatttccagcagtcacttccactcattgtggcagggatatgtaggcctgctcctgggagctgtagaagtccactgacacatgactttggctaggggctcttcatcagccttgctggaactgttgcacggctgccttgagggataagacttccacccaactcttcttccttccctctcctctttcctgtaattagaccatcccggtctgaagcctctccaaacctcctctggcttcctcccaatttttcctcgtgggcatttcccctaatatatttcctgcatgtttaatcccatttaatcatcttttcagacatcacaaatgattacatctgccgtttggacctcaatagcactcattagaaatataaggcaagccaggtagagtggcccgcacctaaaatctcagcactttagggaagagccaggtggaaaaatgacttgagcccaggagtttgacaccagcctgggcaaaatagcaagatcctatctctacaaaaaaaaaaaaaaaagccaggcatggtaatgcgtgcctgtagcctagttactcacggagctaaggctggaggatcccttgaacctaggaagttcaaggttacaatgagctgtgatcacaccactgcactccagcatggttgacagagcaagaccctatctttaaatatatatatatatacacttgtgtgtgtgtgtgtgtgtgtgtgtgtgtgtgtgtgtgtgtgtattaggcagttcaggaacagtttgttcaatgagcatgaatcttttaactgaaatgatgaaacaaactctttagtgggtcatctaaggaaaatatcctgtaattagttttcttacaaggtttaggaaaattgtttgataagccactaggatagggctcagcagcctatggcccacaggtcaaatttgaccagccatcttgttttgtagataaagttttattggacacagctgcactcattcatttatatgttgtctatggctgctatttcactaaaatggtggagctaaattgttacacaagagaccatttggcccaccaagcctaagatgtttactgtctgggcctttacagaaaaatctgaccaactcctgcactaggatataaattcctaagaagcagggatgtttctgtcttgttcttgttcactgctctatcgacaggatttagaacaggactggtgcataggctctcaataaatacttgtgaaataattacattgactaagttttagtcccttaatctctgcaggtttcagcccaatgtcaccaagcctgagggcaatatgctgaggcttgtgtgttgattgtaataggtacccacaaatagctgatgggtcagaagaggactttgaacagaagcagtctactgcaaagatgtctgacccaactaagaacactgagtgaatgtttttttgggtttttttgtttgtttgtttttcttttccgtactctgagaagcataagaaatttggactccttccttactcgtgatgctaatttagggggcaggggcagggagagagagttggatgccatcagctgcaacaagcagagcacctcatggcgacttgaaagaagccattttggtagcagttgttagtgactagagggtgtcactaaccagagggaagctgcttatttacagctactcgataagcctgtgggaaacaacccagactccggagatagactctctgggttgcattctgactctactgagcattagctgtattgggagagttatttctacccacagttctctgtctgtaatataagtcttatctctattaaattctgtaaccaaatgaagtggttattatattataaatataatatagggttatattattatgttataatatatacatatataatgagggtattaccattataaataaaatatatttatatataaataaatagagaatattatgtaatagttatataatattaattatatattacatcacaactaagatgaacaataattccataagattatctaatttctacattcatattttctcatttttccactaaaacttttataggagttttgtttttcaagatttaatagtccatttaaatttggagcagtcttctactttttttccctgatattgacattcttaagaaactgggctgttttgtcaatcatttcacgttctgcatttgtctgaatatttctttattatgacctttagtttacccttcaatcccctatggtttctgtaaactggaagttgagtctaaagactggtttaggttgaatggaatattgtggcagaggtgttctgtggaattactggtcacttcctattggatctcttcaggagacacatatgccagattgccactcccttagttatgctgttctttaacttggttagggttataacctccatatcactgcatctcgatagttcatttttccctaggaaattaacagataacctgtagggtaatacttggtcacattgtccattattaaccaagtaaattacttcaatcattttgcaaaatgctgattttctaactctctcattccctctgcatgtatcaaccttaattcttctgttagaattaattgccaaggcatcatattttatgttacaaatttttctttggaaaaaaaaataaagcaaaaggaaacataaccctaaaaacagggcctatttcaaagttaatgagtcgttgaaagagatttttggccaggcacgctggctcacacctgttatcccagcacgttaggaggctgaggtgggcagattgcttgaacccaggagtttgagaccagcctgggcaacatggcagagccctgtctttacaaaaaaaaaaaaaatacaaacaattgctgggcacacctcaccggagcccaagaggctgcagtgactgtggtcatgccactgcattccagcctgggtgacagagtgagactctgtctctaaaaaaaagagattttctttctacctcaatctctgacttttagcattaatattaatttaaaggatcagaggcactcttgaaaatattaaagggagctgggtgaaattttccagctcactttctcttggaaactaataattttcatttttaaatgtttacttttttaaaaaaaagaactaaaattttgtagcccgtaaatcctcaatttcaggttttatgtctctcttactcttaggtatattttggaaaatttattctttgaaattgttccttgaggggcatgtttcacatacgctttactccttttccttcttcttatttaaaaattttctttttttttccccaaagatgtgcttttggaatgtgtttaggctaagaaggaaatgtcttttgtcattttaatggaacacttcaactattgctaagcagcgaattccatagtcgcatggcaagaaagtggtcaatttatcatagtttgctatgcaattctcttggttgcccgcttcagacctagtttaatacatcagtggagagagttgaaataaagcagcaatggggtcaaggtgatggggaaagaagaggagggattggcatttgtgctctaaactgccctgatctttagatcggcatttagcctggacttctgatattggactccttccttctcctatattcagatgctgctctagatttagactgtcatcactgacctctaacttgatattcatgtcggccctgttaccctttctgtgaccatgactcaagcctgaaagacagctcactgtccattgcccagaatgtcatctaactcagctatgagcgctgcagtgtcctaggcccccagggggtctggaggcttagaggactccagatgagccttcctgcctctgtgcagctgacattctaggaggggcagaaagacagcaaatgagtgaatagatatgatagttttcaatagtgataattctgtaaagaaaattaaataaggtgatgtgatggagggtgaggaaggtattactataaagaaggtggccagaaagggactctctaagatgatgagaagaaatcagccatgcatctaggaaggggtgggcatgccaagcagaggaaactgcaagtgcaaatcttccaagattggaatgaatttggctagtcaatgtggcagaaagaagactgtgtagttggagcataataaacaagaagtgaacagggttctgatcacgtgggtcttttcagaccaggctgagggctttggaattcattctaattgcaaagggaagccattagcatgttgcaaaggagatggcatgatctgatttatgtgttcaaaaagatccctctggatgctgtgtgacaaatggacttgaggtagggcaagtaggagaaggaagacaaactgggaactgtagtggtctccagactgagatatgggcagctttgttttcaattttaaatggttccattttgttctcaatggacatggaggagaatacttactgtcttttggaaattaaaatttttggtgtctgagaatgtcaggaactgtgatcagagagtacggcgaataagaaagaaaatagatttcatttaactgcatatgatatgcttgatttagtgagacaatgtacctcataagcaaatactgagtatccataaacaaatattgagtgttgtctctgtgccaagctttgttctaaatgtcaccaaaacatacaagtgtttcattccctatttcattattttataaattgtcactcaataaacaaatacaaatcttacttggacaataatatgtttaatagttgaaagttatatcttgtgcatctccaatatttatattctctaccatttatccccactgagctactccaaactctaccttcaaattgtttgttttgaaatgaaataatacagaatagaaaaaatgttttttaaaacgctgaaaccctttacaaacatgaatatgattagtagtagtacattttagacgggctttcagatccttactaatgactgtataaatgagtcatagcagtttaaacttttttagagtataaatgctccatctcaccattctctgccccatcccctcctcaccctcctgttccaccccttgcggggctaggactgtagggtgaggcaagtgagaccacatcagaccaaatcatacatgtgcagaatcagatcctgtctttatttttaaatgatattctgttaaatgtggatttcttgaattaattgtaaaattttaaaaatgttacattaaaatattacttaccttgattactgagatttctggcacccctttaagttttgcaactgaggcatttgcctctctcacctcagcctagttcctgccttgctcccttcaaatacatcccctactcctgcaaattcctgtagcccaagtccagcccagggtctattggtgtattttgttttttattttattttattttttgagatagggtctcactctgtcacccaggctgtagtgcagtggcataattatggctcactgcaaactctgcctgccaggcccaagtgattctccttccttagcctcctgagtagctgggactacaggcacaaaccaccatgcccagttaatttttgtatgtttttgtagagatggggttttgccgtgttacccaggctggccttgaactcctgagctcaagcaagccacctgctacagcctcccaaagggttgggattacaggtgtgagccaccacacctggccctgttggtatatgttgagtagactttctgtgtgcatctgatgtaatcctagatttagagacgctgcagaaaaggaggacggctctaatggcatcatttgtagaggaactttacattgatattgacctggcagaagtatttccaggtccttttaaataagcagttttaggaaagatgtggtagttaaaaaatgtttcaaataatgtgaggagcttttaaaattaatttatcttctttctttgttttatacctcccttaaggagtaaagagagggaaggacaagaaagagtcaggaacagggcattgacacaatttgaaggcatctgctaggactggagtgtgcattctttgcctggagaatgataggtttaggtgcacagctcacagactcatgtcataataaggcccagctggacacatgggtcattgtgattcaagatgaattgagccttcacagtttctagaggaccaccagagtagtaatagtggtgttgaaaggatgagaacaatctgtctctcatacaatctgggttctgggtcatttcatttcctcagattggtttgactcaccgtctccttaattttctttgcaaagcagcagaatcagaataaaactacctgagtttgaaaccccactcttcccttggttcctgtgtgaacttgggcttctgtctgaagctcagttttctcatttgtaaagtgatgataacaatttctcctttgataggtggtcatgatatccggaaaggctagcattacctagtgtgataggcgttctataaatgtgtgataatgagtctttctaaactatgtcaagagaattttgcacatttctaattgttttttgccaggtgatccaccaaggcaggtatcttttacatgcctattagttattcttaattattcacaatatctaagaccttgtacttaatactaacgtgcacttacagatattggagataaaatatatgaagcaactagcacaggagaatatcctagggttttaggacacagaagtcctaaaacacaatatgtttgttcaattgcaatttcaatctcaaaccaaaataatatctgaaaggcatgtaaaacattagttggtagaatataagtagaatgtaaaccttttttttttttttttttttttttgagacagagtcttactctgtcgcccaggctggagtgcagtggcgcgatcccggctcactgcaagctccgcctcccgggttcacgccattctcctgcgtcagcctcccgagtagctgggactacaggcgcccgctaccacgcccggctaagtttttgtatttttagtagagacggggtttcaccatgtttgccaggatggtctcgatctcttgacctcgtgatccacccgccttggcctcccaaagtgctgggattacaggcgtgagccactgcgcccggcggtaaaccatttgttaaattattcttgaaaaaatatttaacgacaaaataaaacttaaaaaagttctttgattcgtgactgaagtttgaaatattttcatcttttatcttaaggtactaaatcaaacttctcgacttgagatacagctgctggagaattcattatccacctacaagctagagaagcaacttcttcaacagacaaatgaaatcttgaagatccatgaaaaaaacaggtgaggattgctttattccaaaaatgtttctgtgtgtacttatttatatccttcacctctctgccaactcttaaacaaataaggttgaggtggtttacaaaaatgaaatatagagccaaattaatattaatataaaaataaaggagagcttaaggtaaattcagctagtatgtcaggaataaattaatattgttgctgatactcttgaaatatttgctttatataacttttagcattaatttctctaatggtagtagttcaaatctcaccatatctacaaaaatttgattctatgactaaataaagtgacataaaatattgacatttttcagcagaatgaaaacctataacaacagagaatagagcctcttaaattcctactcaaaccccaattcttaggcttttacaaagctacagcgtttttgaattcagaaatatagcactagagagaaggaaaatgtatattttttctagaaaataatttacctataaagctgatcaagggtttggttttttagttgtcatttacagccatttactttggacatagtaaatttctttggttagctttatagatgtcatcacaccatcttgttttataaattatgaatcatttcagttgattgaattggaacttagacatcttgaatgctgggacaatgaaagagtgtattattttgaagtcattaacattgatgatgaacaattcaaaacactgacttccttaggacaagtttcttgcattacattgatttttcttcggggtatctagataacttgaagaaggttcagttcctatgcataatattgaggtgaagaccatggtattgatagaaactggttaaatgccattgaattggtggcactagagttccctttatattccacaccaggaaggcacctaagaggactgctagttctgttctttacaagtgagggaacagagactcagtggaaggcagtgacctgtccaaggtcacacaacttgctagtggccgaaattggaatgtaatttaggtgtcaggatctttccactataacacatggcctcttcatattatctacaaactaaaagaatttcccaacttcatgctaaaagtagagcataatgcaacaattacaattaaacttctgcatgaaaaatacaaacctggctgttggtttagaatctgaaaggggtcactcatgctgtatgacttgtatttctaagtgttacatttatttatccttgtactgtgacatggggttagctgtataactacaaataaacttgacaggacttgacccttattgcatgattaaatgttctagaactaacaatcctgttgaaatataccatttattctcctgcaatttcacagtaaccagacctatacatgtatgtaataggtatgcttcaaccaccccttaatctagggtcacccctttatggtttaattttgtcaccaaaagtgaaccacatttacagtcatatttcaagatgctatttgtgaaggctttgcccaggaatcatggataagtaaaacgatgacaattttcccttatttttctgagtcgtcgtttggttttataattatacaatagcacgtttattatagcataaggacaaaaaaaaacacacaggaaaattaaaaaccacagctttatcatacagaaagagctgcatattttgctgcattttatatataaatatcattttcacaaaaagttctgtcataccttacacacagtctggaagtctgacttctttggagatagatgtcattttacattaataaaatattctctaatattcttaataactgcatatttcattttactggtataacctaaggtggtttgaatccatctctcagtagttatgttaccacctgatttatttctgaaagagttgccagcatgaatttacattctttagtttttccctactgatctgcatattatatctttgtctgtatctgacccttgagctgtcatgataccataacataaactgggaggcctgaaaagtctcctccctaactgcaaaacaaatgccatccttatgcaccacttgtactcaggtactctgtctctttctcttttcttccctccttctcatatttatccttccttccttccttccttcctatccttcttgtcttcttccttccctccctccctccctccctccctcctttctttctttcttttctttctttctttttctttctttctttctttctttctctttatttcttaaaaatgtatcctttctaccttaattctggatcatttcagattttcttgtcttcccatcatgatttttatgcagcatctggtatcatttcctactatagaattctcactatgaaatattatattttaaaggcaaactgctttaaagttgttctctctgctctatcagtaaaagtgagttagggtgcaagctctcaaaagagctccactctgggtcaggtagaaggggcttccatgcacttcagtatctcaaaggaatctgacttctgatcccaaacatatttgtgccttctgctgatgaactttcccctctcattaaattctaatttcaacagaaaactcaggttttcttacacgtgtaaatcacatcatttattgctaatgttaattttttcaggattatagcaatttccttttctagtaatataggtatttcactacaaattcagagatttgggttttaattggaaattcatttctgtgctcacacagacaaaaacctgcatgcatcttacacttccattccacatctctttctttttcgacagtggacccctcaagtatggcattatctcacatgtggttctggggtatttttctatcaatttctatgcctcctggtattgctgtatctctatagttatctgtctatcttcttgtctaagggcctaatgtgtgtgatggagtattggcagaacatctgttcttaaattagacatagtcttccataaacaacttaaaaaaaagagaagtgtttttctttatacaaataaaaaatacccatttgtgatacatagcatactttccctattctgtttattgttattgtttattttcatatgtgcaatggaattaggggagctctgccaggcaatttatattgcaacaaagaaatgtgctcctcctatttaagtggagagaggttcaaagtcaagcatgaagctgtttatgttttaaaaaaatagtttatcgattaccactggttattccttatatgaatcttaatcctccaaatgcaacaagaagctatttctacattaaggcatctctgaaatgcagcaacaacatgcctttagttggtcaggtctggtttggatcagctaatacactttgcaggggggattatctaaattaagctttgtttcctccccaaggaatgtcaggggttgtgtctgggtgtgggacttaccaggtttgagtaagatggggcttcagccgccaagtcagtgagctggcccttaggaaggtccaccactgctttggcaaaatgaggaggaatattttatggttaggattatactacacaaacatgctgagaggtcctgctgatttacatcctgacaaattaaatgcatcacttgtaggattggaaatggatttttggcctcatgagattcacttctctatcccctacatggccagaagcacaaagcagaaacaggattagcaacgtttgctctgctgtttgttttcctaacagtccagagggagtcactctaaaaagcttccagtttgctctctttaggcaatatgtttttcttttgttggatgctacccgaaacttaaaacctggttttgtttcttacctcaaagaaacaacacttgggagtaaggaatctgtaactcaaccatataattggaattacacaaccaagaacctaagtaaatgggaaacattaatattttaccttgcccacaaagggagtgagatgaacacaaagtaggacacaaaatgtaaactttcactagtttcctccagtatgtttcctactgctttctaaaacaatggaatagaggtgtacaggaaatgatgtcctaatgcagtttccttcagttgaaccaaatatgtgactgggtctgttagtcgaaaggtttggtcaactggccagttttcccagcacccgcccatctctgacttaaccccaactttttgcaaggcggaagcaaagccaggctaaagaatattccagaaggagcccttctgtctcaccagggtatacaggaagggaaatcaaaaccccatgtatacaaagacggagcacacgggctttcttgattgtgctgagtatgcagagtgaagattaaggaagtcttcagtaagaccgttcagagtgaactgaaacgagacatgtgatggccattcctacatagtttgagcaatactagctgccgcatagctactagtacaaggtaaacatctgtgccaggtgctttaacttactatttccaatcctccaaccaatcctgcaaagtatgtattattatttctattttacacttaaaaaaagccctgaggctcacagaaatcaagtaagttgcttatgaccaaacagctaaggatatggcaaaattagagttcaagttcatggtgattctctgccttaattattataaaaatatttttgcaatgtgatgaggcctcaagtataattgatgtagttgtcaagttattctcttaaaacaaacaaatattcatttgaagaaaggggtagaccagttgtttttggcctgtcactatataggtcattatttagtccttctaatattagagcagaagatataaactatttattttaccttgggaattcactgaacttatttgacatgctcatctatcttctagctggagttatgggaagttattaagttaattaattttaagtgattgaaacatgtgcaacttcaagataccaaattatgccttactaattattgcaataaaatacagtattgatatttaatgcttaatatgcctaaagaaatgaaaaatgaaatcatagtcttttaaattaaagctatctttcatttgataaattatttacaaaatgctaaagtaacttgctaacttctaacattaaactaggctgaattatattagttgtttataacaaggataaaaaaggtgactttttgaatttatattattctagtctttttcttgtaaatagaacacctacatactagaatgttaccttttttccctgttaatttttaaaataatatttaatagcatatagcattttcctttttttaaattataataaccgtagtatcttggcatgaaatacaattctgatcaaattggaaatctaaggctcatcttaattcttctctttccctaatcccccacaactcaccagtcactgttgatgctatcaattccatcttctaaatatttttctaatccgtcccatcctttccattcccactgactatgtcttaggtcaagctgccatgaattcttgtctaggccactgcagtgacctctgggtttaagctatgtgccactccagtccttatccagaagctgtgccaaagtcttctttctaaaatgcaagtcagactattttcctctattaattccctctcaaccaaatgacaattctctataactgatagaagagagttcaagttctttagcacacaatacagtccatgatcactataatcttacttttgcagacttacttccaataatcttattttttagaggatacacgctaatagttaagagcatgagctctgaggccagactgcctggtttcacttttccttgattcctgggataatcgactaagtcacatattatttgtgtgactttgtgcaacttacatagactctatgtgttttggtttcctaatttgtaacataacaatgacaataattgtactgtatgaagttaagatgaagattgagttaatgtgtgtaaatcactgagaacagtgcctgacatgagcagcagtgtttaatcatgttagttgttagtatgacactgaacacatgatgttatttcagacatatttgatgtttgcctgacattccttattcaactcacaaatttctgttcatccttggaaactcattgcatgtgtcagcgtctctaacagtccgtctctggctctaccagatagatttgctcattatgacctatgtgatagccctgtacctgtttcctccccataatttcacttatctgatcacattataatatatgtatgtttctgtgtgtgcatgtttatttatctatatccatactattaggctgtgaccttctaggacacagagaatgtgttttattttcattgtcttcctgctcccgggcacaattttctacacataagcatatttagtattaaatgcattttgaatgttaaatgaataaggaactgggaaatgtcccaatagctctaacccaacaaatgccatttatccatacgacacacagagactcacacacacacaaagactcacacacacacacaactaataaaaatacttatagtggaaaaaacaaatcatattgtttacattaaatactgtaaatccatttatcgttttcaacatgaataaaatagagatcgtgtttacaccactattctgcattgtcaaaagcccattgcatggcactcaatgttactattgtatactctgaggttcactaattcagcccacctttaaaatttctggatagcatttgcacaggccattctagacctatgactgtttcctccatttctatgataaataaaaacaagtaagacaaacttgttgtatatacatgtatattaaattatatacatgcatatacagttgtaagtcaaatttcccctaattccacacccctacaccataccacctgctagcagagaatcatcattaagagattaaattcagtgcttactcttccagatgttttctctaaacatactaacatatgtgtatatatagagtgtgcatatttatgtgtgtgtttacacagatgtacactcatatataattgcacacatgcacaagtacttgtttatatgatatgtgcatatatgtgtagattattttatcattggggttttttctactatttatttcataataatttgtcatacatatattacacatataaccataaacagatatacctcattcattttcaagaatgagtagcaatctatttttatagatgcactataatttataacctattataagtattatttatgttaatagatatataatttatcaaaactataattagtgatgtgataatttaaattttttatagatattcacaagttatcttcacattttaccttctccctaagagtacctgggctttcaaatttcccaaaactttgctagccatctaattaatctcggcttcttcagaagttaagttgtgcatgtttttgtgtgtattaaccatttgcatttcttctgtgactagatttctttttctgtgactacatactagcctatttatgtatgtttaacattttttctactatattgtttatccttttttaaattaactcatatgagctctttaatggatattaaaactttgtaatatatgttacaaaattttctctagtttattatttattgtccaacttattttttaatagaaacattacatctctgtgttatgaaatgtatcaatctttttttttcttagttgctggtttttataatacatttagcttattcttctttaccccaaactttacatttatttgccaatatttacttatagtatctatgcttctactccaaatttgaatttccaaacaaatatgatttcagactttgagaggaaatttattgcattccaattagacacgtaaagtataaatttaacctgaactaaatctgtgtgtatttaaatggggagaaaaattactctttacaaacccatatttgcaacacatgttgacaccatacatgttgaaaatagtggaaaatattggaacatctgtaaatagattcagacagataaaaatgaggtttctatattttcaacatcttcctccttgtttgaagggctatatttatactcatagagcttaggcaactgtcaccactgtgaattcattggctgctacgttaagaactctattgtgggaaacaatttgaaagggatatccttttctgtgaaagcttcaagatatgttcaatgatttgaaatatttccaataagatgttggagaaggcagtgtaaaacaggggtatggagaagtctaccagaaacttcaaataggacttgctgtacactcatttagaaccttttactaaagttcgaggcacagattattttgtttattttattcattaaagtgcacctctgcctcaaatagaagctaagtgccagaattctatgcatgtctcttctcaaagtgtttccagaaagacgggaaacaggaagtcctaagactcctgtgagaaactctctccttggatttctagctcaatttgtatagatttaggtgcatggtttcataaagtgttgttccatggaaccctaatcctaaaagaagcatcttaataaaaactgtttgtttaatataggcctccctaaatcttaacaatgaaactcttattttgcttcaaagaacatactgaatatgctctaggaaacagtgcactggtgttcagtaaccatccaggttttgtgtttaaaatgcaaacctaagctaaacatgtagctgagactgtcatcagggaaaatctgactactttgactatctaactttaggacactggggctgcagtgttgtccttcatatcaacctctctatataaagatccccatgctagctgaggtggccactcccaacggacctggataacgaaaatagtaaagaatcaatgaaaggcttcagggacaaaatgaaatatgagcagtatattaacaatataattaaaattaacacataaatttaatggaagaggtattaagacagggtagtatttaagaaaattctagtccagatgttaaaaatcgacttgacaaagtaattctgtttttatacgtgggaaagataaacaggttcaaatattgtgaaggataagctcccagaacaactaaatggagagcagcaaatattaaggatatgtgaaggcagtgccttggttcctggtataacatgatgaataaaaggaataggaagagattatagtgtgttaagtcaaagagatgagactataggatgttcattgacacagcagtgggatgtcttgagtagatttccagtctaacaacttagaagacatggctttttattcctggttctgacacttaatatctgcatgattttgaagaaaacatttgattcttacctatccatgagggtctgtaacatctgctcattctatgttactatattgctttaagaatcaaaggagataaaggtttcaaattgctatataactataatggtgtgttacaagaataagataataagtagagatggtatatggagttttctggcaagtgaggtttgcattgaaaccattttggaagtaatgacaaggaagggctgacttccaaagtagatactagccaataaatgggaggaatcaaagagaagagagcagtcttttggaagccaaatatgaagagaagatgaaaaaaggggatgagtgtagtcaaaagaaatggaagggtcaagaagagatcagtcttgcctgaagaagtctaaaaagttgtcattaatatgaaaaatgtccctaataaataaagttggtagataattactgaagtacaaatgttattaagggcgctccaagtgaagaaatgtgatgagaaaatgatgagaagagataattaactggtaagacttgccattagagaaacaatgtaacatgtttccaatttgcttgtagttgttatgcatattacttgggtttccaaatcctgtggaatgtctgtgctgtagagtagccttcttagttccatggacagtctctttttcacattacatgcactgtctattctaagatgacaaactatatgggtatcttttgatacctgctagtaagggagcattaaaggttgtctgatgaattatgaaaattaatgttctgtctaacgtgctaatgtgcgttatattatatattatacatattatgtattccttttactcagaaaagcagatcttttccacaagccagtgtccagaattgtttcctttagtaccaggacttctttgatctactttccattctcagctctttccaagttatcctgaaaaacaaaacaaatcaaacaagcccaccttctttactgacatctcagatagcagctatctctgcgcatatgtccgcttgaacaaggaatacatcaaaaataaacagaaaaacactgatgcaaaaatttaaaaaaaaagtattatgtctgaaacagaagtttcttttagcttctgcattttcatttgaggtttttattctctaaaaataaaccctagagtaagaatagtgtcattttatattttacagaattattggcacttagcaactaataaatacaaattataactatagcatgatattttccaaaccagaatgttacctactgattaggaaaactgaaaggccagtgcccatcttatttcaagtacaaaatggtaattcagaatttttatccagtattatatgactataacgttcaaattttgatatctacatgcttgccagtttaataggtaatgctaagttttctcactagtagactataacgcctatgaatttaaaaggcaattttcttataagttaacaactctaaattatgggcatcttgcctctgatcattaccccaggactagcaagaaaagtaaataaaaagtaaacagagaataagctaagacactggtcgtggttaattctcagatctaaaggccaaaaattaatgggcacagagaagatctcctttgacgcctaccccagtaggtgggatgaaacttttaaccaataaagatagtgaagaagttttttgtttttgtttgtgttttaccacgaacttctccaacaaaaagttactggcaaagaaaaataacatggtaaaagaagatgaatcatacctaccccttacagatgttgtttttcatcttacactgcttaccttgcctaagtttttcatttccaaaagaatttttaaaaaataagtgatcatcacagtttccctatattactgtacccaagctctatctaaattgggtttactttatgatcggtgcagggcagggctcctttctctcttggtattggtagaatgaaagcaattcaaaacagaaatgggacttctactgcagaagtcacacagtttctgctaatgggtctcaatgagaaactttcttatgtgaatgtgtgcacactactaaaggtattataaattagtagagtcttagaagcctcaggtatttttcaggcttgacttcacaggcagctttcctgccatattcttcgagtacaagtttgttggcaaagatttggaatgcccaggagtagttctggccacacttctttttcctcttcctcttcttctaaacaatggaaatgtattctctgaatattctggaggctgaaagtcccagatcaaggatcaaggtgcctgcagggctaggctctctctgaaggccctagggaagactcggttccaggcctctctcctacctgccagtagttccttggcttgaggcagcagtgctccaatctttacacaaccttttccctgtgtgcacatctgatctgtctctcaacattttccctttttataaggacaccaatcatagtggattagaagctcatcctcctccaggatgacctcatcttaactaattacatctgcaacgaatctgtttctaaataaggccacattcttgacttcctggaggttgggacttcacacacacacacacacacacatatatatatacatatatatacatatatacacacacacacatatatatatatacatattttttttttttggctggggggcaagcatgggcaggccataattgaactcgtaacaaccacttaaaacagtacctgacactggccgggcacagtggctcatgcctgtaatcccagcactttgggaggccgaggcgggcagatcacaaggtcaggagatcgagaccatcctggccaacacggcaaaaccccatctctactaaaaatacaaaaaattagctgggcatggtggcaggcgcctgtagtcccaactactcgggaggctgaggcaggagaatggcgtgaacccaggaggcggaacttgcagtgagtagagattgagccaagatcacgccactgtgctccagcctgggcgacagagcaagactctgtcttaaaacaaacaaacaacaacaacaaaaagcaaaacaaaaaaacagtacctgacacatagcaaccatgtcataaatgagaggtatcatgactagtatgattgacatcatcatcaccatctaccatgctgatccatccacaaggtttctggcatctaccaggatggcacagcttctgccacatggacttctctcgattccctcacagtcttttatgccatttaagccttggacccacacttcttaatctgtgtaaaagacaatcagatgttacactttgtcccccagtacctggtgttggaagatttggctcttcaaacatgctctattttataatttaagtattgaatctaaaacactccctagtgtcccctttttgaaaggaatgattcagtgctgtatttctccaaggtaaattaagtgcccattctggtatgtggcattttaataacaccttgtaaactaaggacgggttgaaccttctgaaaacagaactgagaaaaccgagtaagcctttccccggaggaaaactagtatattagacactccataaaatgttaatgctttttatttccagtcagttggtaggctccaaaaatgcttctgctttctctatcatttttaatgtgcaatatacaaggggaatatcctataaagagctcagggagaaggaagggcctcagttaaagatttcaacactctgagcaaagcatcccaactcctttcagaagaccataccatcagccaaagggagtcttccttttgttaccatttatacagtgacttgggaacttgtagtgtcattaagcctcatcctgaagcttgagttgagaaataaaggaagctagtggttatgatacaggaccagttatcaaaaatcacaagaattcattgtgactttagatagatcacttttggctcctgtggtttctgtgtcaatatagttttctttttgtatgtgtgtgtgattgagaatgtatattgctgttttttcttttttcacctaacatattttgagcattttctaatatccttaaaatgattaaaaatattttcaacagtttcaaaataagagatttttttctttcttaatgtcattgtacataaacctttgtgtttctgattatttcatatttttctctttatttctgattttgcagatggtcaatatactattcttgatcccacagaactatcgtgaaatttagtcaatgttaacgttttgaaaaccccaaataaatgaagcaaagtgaataaaaagtagtttctacgtgttgtttgtttttttcctgaactattctgtttcctcttaggcccatttctttagtgaaagttatactataacttctttagagtatagctatttgggtgtaagttagctaccttggatataagatacacccaaggaaaccaagaaactaaatcatagttaaaagcaaacattactctgacaatatctggtttacttattttttatttgacatgttatatgtgtaactcctattctgaagaatacatattcttaagtctctcacttaaaaatatttttacagtgaaatgtaaaatttctcatcttaaataaattcaggaaccaattgaattataagggtttttttgtataacattttttcaaatctaagttttattttcacttccttgtagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggtggtaagaatgtcttcctcactttggtattgttaatattttatttcctttgatcaagtaaatactcaatatagctttctacagtgcattgattgctgtgtaaaaaatagcagaagaactttatggttagaatcatttatgaagttatgttgataattttctcatgtttctacctggagaatgtattcataagcctaaatttgtgaatccacaatgtctttctgaaagagctttctaatttcttctttctttgtcttttaaccttagataaagtctgtgatactgtcgtgaataaataattggtattatggtgttagacacttaactatatataggacagagatgagccaatgttaaaaattagttcatagtgctgggagagtttcaggaggatttccatttttaaatgaatatttattatttccttttaaagggaatggggtaggaaattgtgggttgcagagaaacggagacagactatttgaaacaagtattatgagtgaggcaggattattgttattaaaaatgtttattaagatcacttgtgcttagtcctgtgcaggatagatttaatcagggtatttaagttcattaattctggggtatctttgtgacagtggagatacaaatttttgatatcactagaatgtctggagtcattgaacctttgggaatatctacaaccctgtatttctttagaaggcatacatctgtctatccatccatccacctaacaattattgaatgaatgcctctgcttgcacctgtttccttcaagcagaacctctagtgagcctcagtagagctcttcaaagtttggaacttgaagtcatcttctgtatttctctaatcagcctttctctgaatgaagatggaattgtaaatggtgatgagtgaaagagaataccacttacatctgcaagttgttgttattaagctgtggcttatgtgaccattcatgaagtggttcagtgagcatatgcaatgtacacatggggaggctcctttaatttaaaagtggatttgagctatgtgacaaatttgttcaatttcatgctttcatctatagttatgaatagggaagataactccatattaagtgattttgttttaaagacatttcatatttctctattacactccattacctcgagttatatctcctttagatagtctaaacaagcctttaatatgctttgtaaagtaatattttttaaacagtgagttcccagagctccatttgggtgtgctcagtaatgtggttgggaagggaaaagcctgctaatcagtcagactctgccaaaatcttgagttagagtccactggaaggaaagcatggtagtattttgccagagaattttaatagaactcatgagtatttaacgattaagtattaatacaagttatatctattctcatattgagctgaatacattttgggaaagattgaaaacacatttttcttatcatcctaagacttaaagcacatggagtggaatagtggtttttatttcatgattttagggatgtcaagccctagtgattctcacagagctcatatgtctgcgtacttatcataatttaacttcttttctgagtatttgcctaataaatgtgtctttaagcttttagaggaagaggatgtgactttagaagtaaacattctggctaggtttcaactttgggcgcaatatcagggaagcaaacatctgttcaatttaagaaacatttttgaaaaatgaggatagccatgatagatggtacccttcatagccattcaggaagtgaaaaaagtaactgtgtctgttctatgatgtagtatatccaaaaatagtaataataatcatagaaactgaatttgtctaaatattccaggcctctagatatcttttctttttaatgacaaaactctgaaatgaatcttgatttaactacaggatttgccatcttaatttaaggtgattgcctaattttccaataggttctctgctgtcatgaccatagattttatttgcttcttgttaatctcttttttctttaatcttactgttaagcgttctaactaaatatttagttacttttagaactcataagagacacaaaagtggaaagtggctctcataaggtttttatgaagattttcattgtctgcatatctttattttcactggagccttagtcgttggctatggtgaatttaaaattttaaatggctaatagcataatactagattgaatatcagttattaaaatgaacttttattcaaattctaaaacacatgggtaaagcctttctttgttttatgaccaaaatttatatatcatataaatttattatttattgaaggattatatgtaaatattttacttataaatttatatatatgcaaatatttcaaaataagcataccagaataaacgcatcaaatattctaaaatgtacattttaaagctcaaatataggtattctacaagatcttaaaaaacacgagctgtgtcgtcatccaaaaagccaaacattttaattgaccctaaaaggtcttctggtttcaatctgacccactaatctgtggagacagcctgaatataatactgcaaggccagactaaaaaaatgttaatgagcttcccctgtcattggcaaccagtttaaccttaaggaagctgtctcatcatgtataaagtcaggagaattctgtctatttcaccacaatagggaaagaattacattagatgctcaatatacaagcgaagatcccattgctgaagacacagttgattcattaaactttagtttcttctttctccttcgatggacaagattcagttaagtacattcattatgtgctttataagcaaaacttcctctgcagaaaatgtttaaatacaatgccccggagtgtttgagtgttgacagtcatccaggcagcttttttggcctccattttctgatctctaaaatgggatcataatatctacccggtaggtatgtagtacaccataaatatatacaacttttgtcaattatgtagttcaaaattgccaaaaaagtggattgtaaatgttctgaccacaaagaaatgacgagtatgtgaggtaatggatatgttaattagcttgatcattctgcagtgtatacatgtaccaaaacatcacgttttactccaaaaatatatacagttattatttgtcattaaaaaattcaaatttaaaaaagaaatagagggcctagaataaatacatacataaacaagtaaatgaattaatttcttaaatgttgaaatattaaaagaggttagtataaaacgcatagcttctgtgttaagtcatagtcaacattaaaataatcgtaattatctttattttagtgccttctaaaatgcctataatgcattaaagttatatgataaagaattcctaggaagtgttggctagacatgtactttttttcccaaacatttgtttgatccagaaactgtaaatctatctttgcattcagagagtgcttttgtttagtttcacagcactttttctactaacacatctgatgttgtgagatacttttaagaaggacaactaataaacacattatctgaaataattcaccaaactttcctcttcttattcctaatagacaataatggtgtcttaggcaaatagtcaattcaaactgaattgcatccactttgtaaggcttctgagtaacacatttatttttgcctaaccttcatctgcaaacattgggccacatttattcttagaaacattatccactaaagaaatattgccctcagtgttatcacaatgtcaaagctcagcctattgcttcatgtttttggcaattcaaaattaccaaaattaaatatttgctggaattaagtaatttacattaataaggcatacaaacaaggtttggaatctttcaggggagagtaatcagttactgtgactattaaaaaaccactagttggccaggcgcggtggctcatgcctgtaatcccagaactttgggaggccaaagtgggtggatcacttgaggtcagaagttcaagaccagcttggccaatatggtgaaaccccatctctactaaaaatacagaaattagctgggcatggtggcacatgcctgtaatcccagctactcaggaggctgaggcaggagaattgcttgaacccaggaggcgaaggttgcagtgagctgagatcacgccactgcactccagcctgggcaacagagtaagactctgtctcaaaaaaaaaaaaaataaaaataaaaataaattcactggttatctatgtacactggtgattaaaatgtcatctcatgttgaacatacacgtggcaaatatataattgggaatttaattactaacagcatgtaaaaaaaggaaggaaggaaaaaagaaaagaaaaagtttttaaaaaaagtatttagactgtattataaacttacatagtctgattgtctcacactgctcaaatcagctcgaagctcatttctgctgtagcaggatgtggttcataaatttatccattcattcaaaacagttctgcagcaactgttctgttctggggaaatgatatttattcatttttatttaacaaatatttggtaagtttctataatgtgccaaatattgctcagactactgggaagaagaaaagatgtatttcattctgtggctttaaggaacctagggtttgataggagagaaaaaagtaaacaattatttttcagaattatttgctagaagtgagcctagggtgcctggacccgagcaaagctcacagagaaatattaaaatcatggcaggaacagaaggataagggcagaatccagcatctctagagttttcttggggattttactgaatccttattatgattctagtttgcttaggctttccacgtgttagcccttacaacagcaacatgagggagttaccatgtctagcataattttataacctctacagagaatttgagaatttgcccaaagttacaaagctggaaatcattgatctaggattaaaatataagcaagcttgttctagtgggaagatgatagttaagtctaaaaaatgaagaaagtgaaggacacaccagagagtacaaacggcatgtttattttccagaagtcatgggagcgggctgtagcctaagtcttaaaatgaatttagagagaggatctctgagggagaccaaaaaggccacattttttctataaaatcaatgagcagtcattgtcaatatatgatgataatggtgatatttgtgttttacaaaaatctccccagtgacaatgtaggaaaaatatactgtaaagctgagaagcctggagtaggggaccagatgggtgcttttaccgttattataatatcagcaaatacttgacacaagccagtcttctgagacctttgcatatattagtttatttaattctggtaacaacactgtatgataggttctattaccaactctatatgaaaggtaagctaagcacagagaggtgaataatgcttaaatatcacactactagcaagtgagcaagctgagatttgaacccagagtcttgttctgaatactgtacattacacgctgcaccatattggacagggaaggtagagttgatgatttttgtcagaatttcaaagtgatctctaggaaagaaatagtaaggtccatattaaacaggggtaaatggaaaagtaagtggaagaaatttgtaaaaatagaaaaattagaatcatcaagaaataatgacttcctagaagtctaatctaataccaattgcacatttctaggttaaacaactgagggagcatagatcacattctttaaaaccagcaacatgggagatgaaatagattggaagggaaaaaatagtgagttttagtttgggatattttgactgagttgcctgtgggacagagtctggcaggcagataaatcggattctagaaggagaacaatgatttgtcctcagaggagacaagaggtaaaatcatagaaagtgcatataaagcaatggctcttattcatgtaggggtcacagatccatcaggaaaccagatgcaaacggctatttttcctttccacttaccccaaccccaaaatgcaaggatataagcacacatttgtgtacaatttgagagcatttacataccaaagttatgagtgcattgtatgaaaaaatgacagtgtaaaatcaaagacagaaaaatttgaaggtttttaagggacaggttaaaaaaaagagaccgaaagaaaaatatagacagcgtgaaaaacagtagtaagcagtgttttgggaaggtttaaaaaaaaaggacagttatgaaggatgttcttttcagtggcaagtaagcatgacagtcaagtttttaaaaagaaccttctgtatgcagaggtttggtatgctacatggctcagttgcatatctcagagactaaaatgagtgagaggaagttaacagaaatcattatatacctgcattcaagaaacttgaatgtgaaaggacagataacaactttaagtagggaggcacacggagtagaggaaacttaaaaataagtactgagagacaagaacatgtttatatacttaattctctcataagaagttcaaatttcaactcataggagcttctcatgaagttcatttttaagaatcatttcacattatcacagagacataatggctgatactacaaatgtttaagtgaccactatttgagctaaagtgcctttcccagaagctgattgcagtggtatggaacatttgatcattattatgggtcctctagtcttcttaaagggggaaatgaggcatttgctttcttctcagtgctgaggagtcatttggcttgattctcagaataattctaccatctgaaaggaatttacctcccatgttgtgtctgttgagtttatgaagtttatatcattctgtaagggatgagatagtttgaactgcaagtcccttgagttaagaatgactctaaaaacatcacaagtgatgggaggaaattaaaactttttgaatgtcagtcatataaacattgataaaaatggaatatatcagtttcgttgactgggtaaaatacttggtttttcatttactacttgtagtgcacaatttaagattaggtagaaagagaaagaaaaatacaggaagtcatctgctgaacactgcagtgagtacttgtttccatttaatgagggaaatgctttatcttgacagaaaattatatgtcaaacatttacaatttccttaaaatgaaccacactatctagcacttcctttcataaaacccagtggcttaaggcaaaattgactgtttatttttggaaatggtatatttctcctttttgatggagcgtgttatctgccttttagaatagtcataatttctgtaaaaaaaattgtgaatagtggatagccaaattaatgataacaaaataaaaaataacatagtccttgacctctcccatgaactatttctaaaccccatctttcggaggagatttgaaattttgtggttaattctcttttggaattggagtttttaacttcagaaacaagatgaactatctgaaaagggatatctcctggttccagctgggcttggaagttacaggggtaaaaggccacaaaaagagtgtttccttgatgttccaatattaccatgagcaaactccatccttcttcccttatgctttcatagcctggttggctaaagcgaaggagcacagatagtttgaatagactttcaattaagtcatttcctggtctcatccacactcaagtcaaattcaacagatattttctaaaccagggacaaaacagaacagtagacattagtcacggataagatatggcactttacactgaaccaaatgacacctataattactctgagagacagtaagaaaaaatgttttattaacagcattaaatatgtatgcatcatatcaactatagagtgaagacctcatgaaattttttatactgtaagaagggagaaaaagaaggtaaaatctggggaatgttgcaactgtacacttagctttaaatgtgtataaacaaatatttatttttagcataagattttctaaaagtcaattgcaaagaatctttaaaactagtaacattttggccagtcgtggtggctcacgcctgtagtcccagcactttgggaggccgaggcaggtggatcacgaggtcaggagatcgagaccatcctggctaacacagtgaaatcccatctctactaaaaatacaaaaaaaaaattagccaggagtggtggtgggcgcctgtagtcccaactactcgggaggctgaggcaggagaatggcagaaacctgggaggtggagcttgcagtgagttgagattgcgccgctgcactccagcctgggcgacagagcaagactctgtctcaaaaaaaaaaaaaaaaaaaaaaaaaaaaaccacctagtaacatttttagcttcctataggaactcataatttattatcaaccaaaggatatcaacatgaaaactaactttaagtacactggaatctcatgcttgtgctagtttgggtgttcacattctgagtggggttatgtctgctaaggagtcatattaatatgcagcctacaaagaattactcatctttttaatggatttatgaataagtcagattatcaaatgtaatatcaaatgtcagacctcttttaacttgtgtatttattatatgtttgcatgtatcttaattatcttaattatttttaggtgtgaacgttccattttcacaagtgggatgacgtcctttagaatagtgagtttgaactttgggtataattttaagtggaaatttggttctaaagggagattttgccagttgtttaggcctcatggacacacagacacgcacaaacctaatcttaatcataattaattatccaacctatctctctagagctaggaattatagattgagatggtttctctccagtatctgggagcaggtgtataccatcgagagggcaggcatggtggtttagaaggagcaggaatcatgacatctctgttctagtcccagctctgctgtcagattgcttaacatagaagtatggcacaccttagagtttgcctggtatcctacacaaacctacatactttatgactcatatcaagcattccaactttgtctcttggttttgtgtcactcctaataaccggtgaagccctgtattcagaggagaagcccatgtagagccagggctggtagtcaagtactgttctttaagtatatcacaccacaagagtaagaatcaaggtgacgtacttgtggtgacagtcaggacttatttacttaaaacttcaaagtggaattttgtgtatgtgtcagttttcaaaaacatctggcaactgctttctatgtttacagcattgcccaaggactttcattccatttttaatggctgttgctgaaataaattatatttgtctgctcatagcagagcacaaaagatgccccttaagctttcccacatgtatgggaaatcttttgtacaaaaccaatatattttagccaggctgaaaaaaagtatatgggaaattaacacacacgaaacacctgaaatgtctttgtgaataaaatgagctcctgaacaaatggcaagggccgtgcagcattcgtaactgcccaacagggtgcccaaagggaaaacaaagaaattaattttatgtaaaatgaaagattacttgattaaacaaagatggtgtgtatttccagttgtaccttttagtcaagtatttttccccattctttttttttttttttttttgaaacggagtctcgctctgtcgcccaggctggagtgcagtggtgcgatctctgctcactgcaagctccgcctcccaggttcactccattctcctgcctcagcctcccgagtagctgggactacaggcgcccgccaccacgcccacctaattttttgtatttttagtagagacggggtttcaccattttagccaggatggtctccatctcctgaccttgtgatccgcccgcctcggacttccagagtgctgggattacaggcgtgagccaccgcacccagctttttccccattcttgattactttaggtagtaataggcattgaatatacgttgttatacacatgagattcgtttcacattggaagataattgcaaaatttatttgaacatggtaatcaaactacagtacaaatatgtagaattgatatttaattattcttccactttaaaacagactttaaattagagctacacttatgacataggatgctttgcatctctacataaatgtaagagtttgtatgtcttatgtatatcgtagtattattgaaaatttgtatatctgcaattatatatcatgggcaatatattcttcagataattaaaatgtatccctttagtaaaattttatgaaaatttttaaatgtgatgaaaaattacctgcattttttatcctctcctttctttttttggaagagaaaattgaataaaattatggctttttttctaataatttaatccgttattatccatatgaattaattttcatcataataccgtgatgcctctggaaaagtatatagcatgccccctttatattgttcagtgcccaaattcttatcatttcttagttttgcctactttttaaaattttctgtcttttcctcacacacatacacacgtactttcaatgatccaattccttgtctccatgcctgatactagaagatgaacacagacacacacacacatactttcaatgatccaatttcttgtctccatgcctgatactagaagatgaacacacacacactcacacacactcacatacatacacacagtcacacacatacacacacactcacatacacactcatacacacacacatacatacacacacacacacactcacactaacacatacacacacacacatattcccactctcactaccccgccagcctatcctctctgtctttgaagcttctagcaaatagtccgtaggctgggagaccaactaccaggcttatgagaataatacctaaaattaataggggtaaatcctgagtcagtgtgactttaagggtatgaacatgataaaatccaatatggctgctttgggacctctcacttatcctctgttagctcttgacattgtgggctgtcacggcttcacttttctgctgagggttttcatctcagacaattctactgcctgtggctctctgctatcctcatgtcaacatattctttgttcttatcattgctgcctcctctctcttttcccatacaacctgcttccatgagatgaggctgtaccctttcagacttatggcttatactgaataactcaggaccttgggtgtgctcttgtcagcagagataagtattgctggggattctgtgacagatgactcactgaagttctatttgggtttcactttactcaaaggccagtaagaagtagttaagattttcagctttatagtcagagagttctactacttacaagttttggtgaagttagtagcatttctgagcttcaacttcccatgtaaagcaatatattgataaatactcctcataagaaatttataaggattgaacaaaatgaagcatgtaaaacatacttggcacacaaaattcagagtttaccacatagtaagtgttcaattaatgctagttgattttattatgatcatgattattatagttccataaaaaatggtagttaagattttatagattatctataaaattacatataaataatttaaatgagagcaaagaagttcttttttaaaaatgtttaattaaaataataattcactagataaatgatgttcaagtgttcccttattccagggttagagggactttgagaaaagaagtagttgttttaaataaaaaagtacacttttagttaatcaaagacttcaaattaagagtatttaagaatagaatgtatgtgtttgttatactgtctcacacacatacacacatgcacacacacatataaccatattcaattgccatttttgtaggttaaaaacagtcatgctgagatatcagcccacagatatttaggtttgtatgcatatgctttctataagaaaaaaataccaacctcaacattttccatttataagcatacagcttgtatgtatttgtgtagctatatatatttgtatatctgtttataaagtcattggtaaatatccctcacccctatacctacccataaaatattgaaacttggactgcctggaaatcttttaattcttccacacccttgaaatgcaagacattaccttcttccacttttaaagattcttttgaataaattaggattccagagagtgtcttcaaaatgttttctctatgaaatgcccacacacctggctgaaaagcacaaaatctaatccatcaattgtttgcttgtttgcaccttgtcagatgtgctgttttcttcctttatatgctcagttaatttcagtgacctgttgtgttgaaatcacaggttcagggtcaatttctagtgctatgatcttcctaataatgatgtctcaaggactatccttgaacaaataacctgatccacatgtattctgatgttcggtaaatactggaaatacatgaaccattagccatatttaaggtttaaaatgaacgattgaagaactgatttctttatagcaactcatcagaaaatgggtaagagaaagggctttggctttttacactgtctctggtagcaaggctaattgccttctgtgttctcggctagtgttgctgaggctaataattaccaattccacattccaggaagttttttcttgagggttcatctgaattgaagtgaccctctgccttagatttcatggtcctcccctgaagtcagtctggtggtggatgcaccatctagatttaaattggttgggtaaaggaagggaagatcaggataaagtcaacagctgctagcatcagggtctcaggttgcttattgactgaatgttggctggtgaaagacagacatgcacctgtttgtgtctctattctatccctttagatgacaaagatttggttgtatagataaggctaaatgaaaagaatgaataatgattccttcctaggactttctagatttatttgctgatattggtgtgggcaaagtctttgaactagcataccaggctcttaaatttaggtcagataagcttttctatatgttatattctttcaactgttatctcttctaggtagccttcctggtgtccacctggcagaaggagtatattcttgcatgttcccaatgtgcttgatacatacctctaagataacaattgtctgcattctctctctttggtgctgtatttaaactggtgacattatagccttacaagttattgccagctatcttgtgaccaggttgattgccaagaataagtgggtcaagaaaaagactaagaaaccaatttctggtcacattgtttgaaaccttaccatgacttacttaaagtactacattggattctttagttacatgatccaataaattatctttttgcttaagccaccttgaattgagttttgtcctatcataaaagttactaatcatgggtatagcgttcatggaagatctttttcgcatcaggctgtgatcacatgacaggcaggcttgggctttcttatgtctgtatctccattgcctaggaaaagtcttaaaaatagcaaatgtccatcaatatttgttgaaataataatataggatgattgaactaagagaggataagaagcagagggacaaatggaaaagccatactctaattgtcttattagaaaaaaattaacactttaattaatttttaactgataaaaactggagaaggatagtgggactaataagggaaagagcaaacacctggtttggaaggaaagattatggaacattaaacaaatgaaagttggtgtagcaggaaggactgcccaacaggcaagtagatatatgaatctgaaggtaaagagagaggcaaatactcagtgttaaaaagtgcctgtgtatattagaaatcttttgtgccgcagttggaagccatgatagatagtttgcaaaatgaacagatatataagaaatagagatccaagaatggaaacttagtgaacatctatatggtaggtgatgagaggaaaataaaccgataaaagaggaaagagaaaaaacaattggagaagttgaaagggactaggagaggtcaacaaaaaacgcgaggggaaagataggcaaagacaacttctatagggtagaggaagggagtggaggagacatatcaaatggctttgatcttcagagtaaaccataaaggtcatttataaagagtgagagaagataagatgtagttttttaaaacagtagaaagatttgcaatacactctacaggaaatgtcgtaggaagtttattacaaatgactcagtgtttgcagtctacaagggggttgagaaagtgaatgaatgcccatctgggggttgggatttacctatgcaaaggtgagtggatgaaaggacaatgggtggagagaccagggatgccaaatggaccattattaaattcctgactctgggatcgaggctaagaagaaagaaaagggaggctcggaaagcagtgataggaatggcagggatctaaattctcaatgagagggaagatgaactcatcagaaattaaagaataagaaaggaaaaataagaatatctggtcaaagaaagaattttagacataaagatcaaccttttaactcgtgcttcaaatcagttcattattacaaaaagtgtaaaccactttgagagatagatacagccctctttcaggtctccggaaggttccccctgacatctgttcggtgatgcttcttttactcttccatcaaatcttagtccagacttttttttttaatttttaatttttgaagagacatggtctcactgtactgcccaggttggtcttgaactcctggcctcaagggatcctcctgcctctacctcccaaaacactggtattacagggtgagccactgctcttggccccatcaagtctattgtatctatctgtctcgtgtcatttactaaatattcctccaatttctatcttctatctaactgaagctcaagacctcctaaaaatcttatcactggtgctgacacttgcaatgttcaggaaattcaaatgttattgtctctctaggttttagaatgtttcctaggtgtccagttttataatatctatgcatgacattggacttcagaactctgcagtacttaacaaagaaacgagtcatgcaaaaagtcatgagattgaaacttctataaccaacatgttgacatataaatcgtttataatttcatctgaaataatctttaaatcttaactatttaggtaaagcttaaaatacacagcaagatgagattgcctgttttggggttttcttaaatgtaaacaatggtataatctgatttattcaatgaatgaaaccagccaattagccaaatttgaccaggagaggctaattcaatgtgatcctaaatataactagtcaactataactgctatgttttaattagaaggtggaagacagcagcatccaccaccccctagactggccttccacattctgctagtgtctcttccataagaaggagtaacaggataatattgctgttaacagtgttgtcattaccataacaactaccattcttgagtacttattatgcttcactgtctttgcactgtgttaggtaattcatacacccatctcagaggtatttataactacctcactttatagattaaggacaaaaaaaactctaaaggtcaatctacccttatcaaagggaccttattcaaaccgtagtatataataaaaataccaaaggtaagctgtggatgaaacttttacaatgattttcaatgccttgctactctaaaatgtagcctaaattaactttcaggcatatgcttgctagttggtaagtaattaaaaacaatcaatctaatctttctggaaagaatgacttttttgaaagaatataagtatctcaatttttcaaacataccaaattaaatttcaagaaaatacaatatctatttcagatatgttaccataacaacaaaaaatccataatataaccataatactaggtgtaccttttgatggtagaattctcaaaccattttcccaagtatagaatttgtattcatggttttgacaacaaatttatactgttagttttcacaaaaataagttaatacccaactttttccttttttctcggttactaaaaatgtgtgtgaaatagcttcctcttcccacacatagccacttcaccaacatcttcctgaagtggaaagaaaaagcaaaaatgggaggagagatggcagacaagagtgaagggaatgtgttcttcatacataactaaaaaagggagggcaggatgtggtatatacaagagaagcattttctccatagataaatgactttctctctctcaaaagagaaaaatgggtttaccgttgggttcctgctgaccacatcttcctgtgttttttgtcctctcaagtgatcataaattttagttggtatttcttcacatctctttttctgggcatctgatttgcttattttcaactttccaacagaataaaggatccagtaggtgggatttaaaatttttttttgttttagaaaaatagcagtccgtaaagttagaataaacgaataccagtaaactacgtcaatgcttttgaaatggatacctttatataatccattgacatcctcagtgtcattaaagatggcttttgagtaagcatttatatatgcatctttaaattgctatttgcatacattctgtgcagtacttcttcactatcatatgaatctgtagccctttaattagttgatttattttgtgttgacatggcaattgtgatggtggtatttagatgtaattattagtatgattcattaaaaccattagtgcagacttgagctacatagaaaatcataatgttattaaatgctttagtactatttttctgctgtggcaacatatctgacataaatatttcattttcttgaaatataatttaatattttttaaaaatctgagtaatttatattgaaatagtaattatttccataaagattagactgctcaatacctataagttagtaaacattaggcaactaaaggccagtatttagtatgaaaccagtattaagttaggccaggattttagatttttagatcatttaaaattaatgtaaaagttctgattcatagtttgcctttgttatttttattataaaagactattataactcaatgtgtttgaatgcagatatttattgataggaaactttaagggcaagataacaaaatagtcttaatcttaatttctagaaaaaggttaaataaaaccaattactaaaataatacataatagaaaatactaaatcataaatactttataaatataacacatatatctttagctaagaactattaaatgtgggtcattttgcatttttatttcatttgtaagaagttaataatggataaagctcagtaaataaaataaggttttcctcagtagagacagtctctaactattaatagattttctgtcttcacttgacttctagtgtttactgtgactctttcacctgtataatttaatttcaaagtcttatttgtttgttcttttatttgtgtatcatctgcctgatgatttaactttagggcattaaagaaagaacaaagtaaagtttggtttcattttcattgtaggtagttaagttgggtcataaactcttttctacttcccaaatctaattattgttaagagttgttgattctttttgttttgctttgttttgttggtaaaattttctagaagctcttcaatataaagtcacagaaaaacagtacttccattgttttagtgttttaaacttccatattgcatttttatgtttgaatttatcttcatgtcttcctgctccaaaaagtgtgttagcactttttttagactttcctgtgaaatgtaggtaagaacgttttagagattttgcaggaaacttgacgtaattgctaccaattgaagatattacatgcccaggtcatttgttccttaagttgatgttttggaaaggatacatagaaaaaaaagaattaagaaattaagtaaaatataagcattcagttaaaaatggctctacagctttttccttcagttttttttttttaattttgtaagctacctcaaaatctagtattgtctttatgattgactttttactatgtgcgatattgacatttgtgtggaggaaatgaagacatgcttagctattattggagtcagtttggctactaatggtactgatattcacatattgcaatctttttttttttttttgcagttttactaaagggaggaaaaagagaggaagagaaaccatttagagactgtgcagatgtatatcaagctggttttaataaaagtggaatctacactatttatattaataatatgccagaacccaaaaaggtaaaaccagaagtgtttgtttacaagatgtaagccagatcccagttgaattgctggataatcagattgatttgtgagcttgttaaactggaaatatatatagagatgcctgaacttttttctcccagagatactctgtttcccaggtccataaaggatgaaaaccctattgtacagaaatccccaatccacacaccttttctttcacacaaaattttgcatttattccctggtgtccctaggatgtccccttgctcatacatgtttgccttgtacagattacatgttgaggtcatgtctaccgtgagtctatgggaaagagaagccatcttccaaagacccaacaatccagagaacacacattatccaaagccaaatactgtgaggagagggaggggtagatatagctatttgcaagttattgctcctgttaggataggagaaacatttcctatcttacttcataatcttgaaagaatttgctttccatatttacataaaagagtgggttggaggatcggattcatcagtatgttgaacaggacccaaggtaaactttggagtaagcaaacattatcttcctgctgtaacatctcttttgtatactgtcttccaccatttattcattaaatcatccatctatgccttcattcaatactgttaagtggatgtcatgcatttgttaggaacatgaatatagagcaaacagtttctagtgtaatgatgaagatagacaattatgcagatagttataaaatgctatcaataagtatagtgatagaaatggtctgtgtaaagcagggtatatgggaagttttgaggtgagacagctgaagagagtgagattaggcaagaaccttgctcttcagtgtctgtgagttttaactggaagcccagggtcccaagaggaccgcatgcccttacaggataaaacaactgtcctcccctcatgcccccacctaaattacttgtctcttatccccatttcctctggggcctgtgcaatgctcttggaatcttctctgattccctcaggcaactttacatgactttctcactaccagagttctaaaaggcagagattgtgccttttatctttgatttcctggaacctagcatagtttctggcacatagtaggtctcaatagatatgtgctggaataaatgagtaagtgacctgctgatggcaatatcaacacttccatgcagtgcatagtaaatcagtctaacttacttagtcttcctgattgttagtctcctttgataggcaaaggaaatgaatcctggagcccagtttgccagatgccacttaattggcaacccaggaagtctggactatagtccaggtctgatacaattctattttcccttttaccactgtcctctgtctctcttgatttccgtaatgaatagttgtttatgttagctctaaatggtttctttttcccctttgctgggacaaaattttcttcttgaaagatacctttgatgttgtctataagggggtaaaatgtaggagtggagtgggcacaggagggaggacaggcaggaggcactcttctgtactttgctacctcagccatctaccagagaagtgtggttttgctgtttttcatgtttgatttctgtgcaagattacattgaatcccatggcttaaagaagcaaacaaatgaaaaattgaaatacaatggcaagtctgggaatgaggagatgaagataacttattctaaggaagatatcctaaaatcacacttaagcttaaattcaattcacacacacacacacatcataaacacacaccatacacacagcagatgaagtatgtgagaatttgatctggagtaggaggtggagttaaaacatttgctttatcatttacctacagtactactcaagacctgaaagaacctctaaattattgtcagttccactagagcttataatctgactataaaaataaaattaactaaaaatactaagcgaacttccatttagactcatagtgattctgtgatataaatgaatcgaaaaataattcccaaagttttcagatcaagaatattcacaattttagaatttttttgacttcatcatcagtactaccatgtggtctgtgggaaggggtgcagtacaaatacagctttagtcattctatggactttagttcatatataaccacaactacactctagtttgaaacattatgagatgcaaatggtgcacaggctatttgcagaaccactgcgcctggtaatgtgaagaaaaagatcccacctcaattcataatcctgaataggtttgcttttcatgcttacataaaatagaatgttggagaatccaatttactccttccatggctggctcctgggttggtttcatcaggaaagcaagattcaagcttacgcttctacaaaatggtggattttaaatatgatggagtttttgggttttcttaaataaataaaacttagaatattatattcacaaatgtcaagtacctactgaattaacttctgatatttaggctaagaaaaaataataatctgaacaggttagcagtaacatacccatacgtacccataaggagcaaattttatcactgctgaatggccaccatggcttttcagagagaagaaggagaagttccaatattacctggtcaggactattgttagatttagatttagttttattgaaatactagcagagtgtggtgagaaggggagataactgagctgaagagagaaagacctggccttcttctggacttagatgttcattctcttgttttattatttccctattataatcatagattctcttacaagtagtaacattgttctataataaagatgggtatttcagactgacatacatacacatttttgcaggtaaaaaatttagtgtttaatcccttagtataattgcatagcatagcactggtaagaacaaatattgtgtgaatttcctcaaaagtaatttacaagctgattaacaaaatagctcaaatgtattgagcatttacagtttgccagtcttcttctaagcatatatatctctatatatagatagatatagatctctatatatagatgtatactatactatactatatatatactatatatagatatatagagatatatatagatctctatagatatagatacctatatctagatataactatatatatagttatatctagatataactacatatctagatacctagatataactagttatatctagatatctagatataactagtatatagtatatatacagtatatctagatataactacatatctagatatatagtatatctagatataactacatatctagatatatagtatatctagatataactacatatctaaatatatagtatatctagatgtaactacatatctagatatatagtatatctagatataactacatatctagatatatagtatatctagatataactatatatatagtatatatagtatagtatagtatgtatctaaatatactatataactatatatctatatatagatatttatatctatatatagagatctatatatagatatataatatacctatatatctgctgtctatatctatatatgctatatatatctatatatgctatgtatatctaaatatctatatatatgcttagtgtatatatatgcttagtacatatatatgcttagtatatatatgcttagtatatatatatgcttagtgtatatatatatgcttagtatatatatgtatgtttttatatatatatnnnnnnnnnnnnnnnnnnnnactcccattatccctactttagaaagttaacctgccccatacaaattcttagcaaatattgaatattgactttgaaacaaaggaatctaattctaggatacacccttttaatcagaggattaagcaggatcattatttatgttaacgataattgaaattgtatcatttataattttaaatatgaacctgttgccccatggggtggtaaacacatggtgtgacatgtgagctacacaggcaagggtttatttttagaaaattaggtaagttgattcatgttctcattataacccacctcattctcaccttcctataatctcagttttttccatcttgaaataaattgtcagcattctctcaatcctataaaaagtgctagcaaaattcatcgttaagactttcacccttccatgtagactgtacattgtaaacaggaagtttggtgctacccctgggtaggcttagccaaagcattgctcattataatgtttccagaagttttggcaagggtaagaatctcaaggcaacctacacaaaaaccgaagcatcaaatatgcatggtatggacgaaaaaataaactagggttattaaaggaaagtgacaaaccaatgagcagaaattattcatcttgtagtcagtgtgtgagttgcaagtataacaggattgtagtacagtaattttttcgattgacattgttccatgccaaaaaaaaatgtctttgaaagttagagaaatgttatcttttcaaatgtggaagccaaagacggttttctaggactatttaacttttcaagcagaaagaaaattagatttaggtcatttctgtatttactttttgcttttatgttattaatggcttgtgtttatttttctttctgaattcccttcaatgtatagtagtaggaaacaagactttccctttcattttatgtttccaaaaccaaatgcctagtttcatccaaaaaacaaaccatttaatcattactctgcttattgtaaaatattaaaaatttgattctgaactcgtaattcccctaattcttggaaaagtactgtaacaaatgggttaagcccttttcatttatggtatggaaaaataattaacattcacaagtctaatcattccaacttctatggaacataaaagtataaaaactatgtgaatcaaatttccccgttttgtttgggtttaagcctccgtattatgttaaaaggtgtttaatgcttgaaagctttgaccttgcctgggataggagccagttcagtcattttcttggatagagttaagcccaagtcatatgatcaataaatgcaataggcatagttaatgtagcagggtcttgtccacaggaaggacactgccagatagcacagaccacacaatactggcaaatgaacttttcaagtctttcatgtctcaaatctttctaaaacctaccatctatttttttaaatttccttcatctgttaagcataggcttttatttttttttctgactaaaaataataggcttttgttttgtctttgctagagtgagtccaacctcttaaatatagatatatgtatgcgtgtgtgtgtgtatatatatatatatgcatacataatacatatagaaaggtggcatgctcaaagattagtgatgccaatattataataactagagcctagaaatcataattataaagataatttattgaacttctacatgttttggttttgtatattttctattatttataataaattataaaatttgtatgcaatgttatataactatagtatattaaatttaaatattatatacatattaaatattacattatatacatagagtgtataatgcgtagcataaacatatattatgtcatcagtaatacatgtaagagatgggagtagtgtcaatgcctattaagtgccaaatgctgttctaaaaattctatatgcattaactcatcaaattctcagaaaatatctaagaggtacatacagagagcagaggtggattttaaattcaggcaatgtagcactcaagttggcgctattaaccaaggtgtcattcagctccattgtgcctatataacacaaagagcagctgttatcattgatgttattaagtctacataagaattgggaagcatatgttcaaccctttaacctctctgtccctcagcttccaacttagtaatctgcctgggtaatttatatttcccaatggtttttcctctaggtctttatttaagaagcattctcagcacatctgaacatttacaagtcactggattcctctgtttagaaggaaagttgtctttttcaaaaatttccgagtgatttaaaagctaagatgcctctgtttagaaggaaagttgtctttttcaaaaatttgtgagtgacttaaaaactaagtgcatagagttttaataatctaggtaacagtaatttaaaaactgtacaatatagtttcctctctgcactctacatttataaatgtagtgattcttttccctgagtatgtaagtggactttacagctttgcaaacacaacttggcaaactttcaggcaatcagtgtccattaggaaataaaaatttgaataaaaacattcattctggattaacaagtcagggcacgataaaatttaattgagaaactagtgatattagctgcttctagaaaaatgtttccttgatattttcacttcccttttttctcatttgaatttcactggtaaagctccactttgaccacttctcttgaatcaccacctatgccctcttgaaactatgccatctgattttattcccacaggaatctgcattctctctcaccaaggtcactaaaggcttcttcattcaaattgaagttatattttcttaatcattttttatcttgacttttctgaaacctttgatgatcacctccccaactctaaatccatctttcttagcattccattaatcaaattttcctattttatctctcctgttccatctctatttgtttatcaaatattcattcagtacccgctacaggctaagcacacctctaggtactggggacagcagtcaattgaaagaaatccctgcccacctaaagtttcctgatgtattctgtccttctcaggtgttcaccaaagcccgttctttgacccttctcactccctgccacacacatctgtttccacctttttctttacttatttaagtaattgcatttgtcttcatgctattaacaaatgcttttaagcagattattcccaataattttcaattaggtagacataggattcaattctgaatccagttcaaatcaattttaaatcccagatccagagcttattgttgagtataatcactggtaagttactgaactactctaaacctcagtattttttcatctgtaaaatggagatgatcatcatacctacatcctactaggactatcatgagaataaattagaaaatgcatgtaaggtgtttatattatttggtccttaacaagcatgtcattgttaatagcaattcctttctttcttccttatgctcttatccatatttttatccttggtctagatcatctcgaagtgctcgataaactttttctttggatatctgtgctacctcaaaggctaaggtgtccaaaactacgatcattttctttgctagcctttgaggtatccaaaactatgatcattttctttgctcgtgttttctttcttaaatttctcatttagattattgtctccatgattcttcaggctattagagctgaaaattgtgaactctgtctccttaattctatgggatcagtcactattgaaacttggagatgtttgagtacctgacccatattttatttataataatacccccagttgtaagtgaaaactgatgcccaagaatggttgttgagtaaatcaaaaaataaatgaataaatgaagtagaattacggaaaataaaagtgtagctcgaggttatgttgactgagagcaggtgcagaaattaaaggaatagtggtggtggggactactgggacaggaatcaacatttcaaatgtacaatcttggaggtgagtcaattcctagggttaatgaagacatactgtatgtgtggctgttgtcaaagtagggcgagagccttgggaggagagttgtcctatttcatatgcccacaagtaggcatgtatatcttggacccttccactctgaggaagtacatggacaattcgctctttgaatgacatttcttgccactgcttttataccctttttgctacttgtgttccaaatgcaatgcctcagggaaaacacttgaggttttttctttaatcagggcttagctctgtgtcctcatagcctgcttgctgctgttgcatcatatcccacctttagccaagcttcaacatgctttagtattcagttgttgaggaaatagtgtttcccatagtccccgttgaataatcaagctgccacattcatgctacatcaattacagtgattgctctccgacgataatcccattacagatatgtttctcttcttgggtagaccctgggggaaatgagtcaatttctaaataaataccattgtattttgaataattaaaatatgcataagtctttgaaagatttgtataaattttccacatgggaaagaagttattgtcacagtcagaagagatacaatatgtcatgttctcctgttattgttcgtgactaaaatacaagcaaataatatattctacatatgctatgccacaaatgttgcctctagtgaaatattgactcaaggatatctactgtaacatgtacatatataagaattgataggcaatgaaatatgtgatagttaaagacattatattttaaaaattttttattcttattgtactcccatttcaatcaatttaaagttttaaaattctgagtcatgtgttttggcaatcaaatggtctgtaactttggaaatttggtagcatttccaaaactttgaacatactcaaatgcttattttcatttaaaacaaagattttttaaaatgttgtatagtctgagacaaagacttaattttcagctgactaaaatttgtgcacgtaatttattcatcattgatggaatttaatcagaaataactcaaatatgaatcagaggaagaaataaccaataatatatctaaattaacattgttcaatatagtaatttcggtttttgtaatctgcagacctgttcgccttattcctattttgaaacatgtaggatatatgttttttaaagtagaagtattttttacttgactttgttttccatttgtcaggtgttttgcaatatggatgtcaatgggggaggttggactgtaatacaacatcgtgaagatggaagtctagatttccaaagaggctggaaggaatataaaatggtaagatgcaagaatttatggtgctttttggtgttttatcttgaagttatcttctccatactatatgatgaatcttggtatttttaggtggttttgagttatttttgacataaaatgatacattagtattattttcattagacacaaaacactcataaatcactttcagtaaatgatttccacgtgtgcgtcagaaagaaaaacgtattactgaaattatttggtgaactgttgtgtattgtctgtatttgttcctagttgcatgagggtgggggaagctagaactcagaccttcgttggatacgtgagcctgaccaagggagctgtgcagggttgcaggttgtggaacaggatgggtaatagcaatggcctcacccacataactggctaattgttgctggctgttgactggaagcttctcccatgtgacctttccatgtggctaagctaagcttctttcagtaaagtgatccagggttatcagacttcttacgtagcacttgtcatcctccaaagacaaagcaggagctttcagccttttttagttttattagacccagaaatgaaacagtgttacttccattgcattctgttggttatggttggtcacaaggaaagtccagatttaaggcacgaggagtacacaaaggtatgaactgtgagccatggctcactggggtctgcaaaataacagcaggcatcatcatcatcatcatcatcacagttcttctcttttttaatgctcaatatgtctgccctatatgtaatttcttatcaatttttaatatcagccctattaactaacactatgcccattttaaaaggaaacagagatgagcaagggttgaaataatccaaaatccagtaatcacatagtcggtgcctacaatattaactattaaaatctgctgacagaatgtaaaggcatagtaatgcaggagaatctatatttatggattctcattcttttgcagctgaaacctctagataattcttgtcttgactttttgacaaattttctctcaccaggtagagagaaagaaatgctatactagcctcagttctgtcttgatattcttgcagacaatttgtaaaaactatggttgatttgcatcagagtttgcccattaataggctcatagttggtcaaatgacagtaaataaggggttttaataaatgaatggaggtttctagtggtgtcactgcatctacatttttatcagatactcagtcgaacagtctgaaagcacgtttaaaaagtttggacttacacaaagttggaatcctgatgtctttgttatttcataaactcaagatggaaaggtaggctgaagccagcaagatataattccacagagatgattgtagaatatttcacctagataaaaaatacctaaattaactctgagaaaacagggtaagggtgacaaattgccttaaggacttagtatttgaaagagaggtttatttggttctaagctcattttgaattaacaaagattaatgtactcagtgtacattactagtagtttagggggtcacataaaatgcagaactcactggtgtctgccatgttctggttacatcaaaaacatagtttcaattctagaggttttcaaacaagtgaacttatcctaggggttataagcaggatgggaggaatttagaaattacatctgtaacaggtaaacacctggagaaaaaaagaattaggcataaacctgatagctattttagttaactggatggaggtaggtgatagtagagcctgcttctcaaaatgtggtccagggaccagcagtattagcatcctctggaaactgaatggaaacacgaatctcaagctctggaccagatttactgaattagaatgtgcatttgaacactgcctgagaggggagtgcaataatgaatggagtaatattccaagaaggcaaaatttgaccaagtatgaacaaaactctctaatgattaatcccaacatcaaatagactgcctattagtggggcaagcccccccccccccccatcttcagtggaaatagaaagtatatcattatcttttgggattggtatggagaattggaatgctaggtcagatttgaaggcctcttcctacctaggtgattctaaaaatatatgagggataaaagattatctatattcaaaaacaaaaagactttgaattatgtttatattaacagttataggccaggcacggtagctcaagcctgtaatcccagcactttgggaggccgaggtgggtggatcactaggtcaggagatcgagaccatcttggccaatatggtgaaaccccgtctctactaaaacaacaaaaaattagccgggtgtggtggcacgtgcctgtaatcccagctacttgggaggctgaggcaggggaatcgcttgaacctgggaggcagaggttgcagtgagctgagatcacgccactgcactccagcctagcgaccgagaaagactctgtctaaaaacaaaacaaaacaaaacacaattatagtcttcactctgccatttacaagaggagagattttcgacagatcacctaacctgcaccttagctttctaactagttaaaataggacaatgataatacttcacctgcctcacagtgatgtttcaaggattagaagtaatgtaagtaaagcactttggcacactgaattttcagtgaacagtagttatttttattatccaagatgaaaacatcaaagcaaaaatttcacttaactatgccaaaaatactgttttgcaaaccatctgaattcatgattattttcaccactaaaatgtgatgtgaagaagtcatctgaaaatcagactgtagatagagactcaggctaatctgaaatacattattattaaaattaatgataacagaaaaataaatataaagttgtcatcatggtgactttccaaaatggtgaattcttaactgtaaacatctgctgccttggcaagctaggcatgttaagtaagagatactgacttgttaagtatggaatcaattcatgtcttgtaagtatttaccaaatatatccatttctaagcaattcttttttcattattggaacaaaactgaaattctttaatcatcatgttttatggagtttacccctcctcccttttttaaaataagaaaggctatcatgctttattcaaacttgaaacatttatcagatgaatgtcaattttgcatgatcaaaaaatgagataagctccaacattttgaaatattctggctaaaaatgaggctgaatttttttaattgaaaatattcatcatatgttacaagatggttaaaacacatggtagacagtgtttcggttctttctctagagtttttctttcacctaaagacaaaataacatgactccaccaggaatggatatagactccttatgccagttcttatcaatcacacctacttctatttcctgcatccaaagaactgcctgctcacttcttcagctaagggtgtacatccttcgggataacaagaacttggcatgccccaactcttctccagtctttaccaatctactattatatatactaggatgctacatttcttccttgggcaatgagtgcagaaatcaagttttctctctctttcctttctgcctttcctctctccttccttcccttcatagtgattgatatctatgggctgcctcttgcttcataagatttccatcacatgtaattacaaatatatactatatattatcattatttttaaacctctgtcaatatgaaaggtttaccactttttggattctcggcattggctttaagcctacaagtatcttacctaagcttagctgtcacttaaccttcctcatgaggagattcagcaaaatctggtttatggatttgtaaagatgtttgtctgaaaggaaagtctggagtaggctttttaatgaggcacttagggaagatattagctccttcaagtcataaggataccctttagtggcctccagcagtaacacttatcagcagtactttcacatataaaacgcaatgaggctaggagttccagatagtacccaaaatggcctaattttatactgttgtaggcaatgactaatgtcctggaggcaaacttgctttattttgagaacaattacccccataaacagagcttcctatccactcaaaaatttcagtgtgagcaccattccttctgggagttctttgtttctggaaagaagttgagagcacattttcagctatattttaacatcttcacattaaaaagagaaaaatgcatatgaaattaaaaattttgaaatacaaaatttgtttcagtctttcttgagttgcacgtctcagcatttagaggagatgcacaatttaactgcatatgaaagtgccctgaaagccacagcgctgtcttatctgttttttattttttaaataatttgtgtgaaaaaagatgcaacccatggaatacatgggctgtgtctggtttcaattttacttcatctataaaaagtcaacgcttcctgagagcattatcagacaaaacaaataaagtatcagagacaattattttattaacttggaaaagcacaaaccaaaattgaacatttctgcaggttttggcaaaaactaacaaatgttgatctttcctttgcatgtgtttttgagtaatatgtgccttttaaggccaattttaagtcagcattagttcagattaaatttcagtgtctttttatccttttattagagcgttagagaagaaataaaatcaattaacaatgtatctgagttactgaatcaaaacctttcaggtgattgtgtttgacatcattaaacatcatttttacaaaagtacatggcatagtatccttagattttattcatgaaaaagaggaaattgtattgtaattgtttactcattcgttgctgctttttcaatatcagcacagaatttcatatatactttcatttttatttttatggaagttacaggctattgggggtaaaataaagacctgtggtaaactgttatgtgccataatgtgtaagcctattttggagcatatgcattggttgactctgtcttttaggcatgaatatgaatttttgaaggacagtcccagacatgtaatcaaaatttgcctccctatagggacctcagtatgaagatgagattttactcctgcattttccctgtataccactcaaataatttgatttaattaatatgttctttttagtttgcacttggaatatctattccacatcatatttatatggatctctaccttcagttcatagcagacttacatgtgcaaccttttacatgtatagctctccctctgagtccaccccagacatactgaatcagaatcttcacgggggacctaaccatctgtatttttttaaaacccccacagctgtttctgatatgcattcctggttgaaagcaattattacaaatattaacttattagcatggtataataccttaaaaattacctcttgtgtagctcctaaaactcgtgagatatggaaagagagggcttgaaagagatagcactaagggagagtcgaaggaaacagatacttaagtacttggaagcaaaggtaagaataagaaagtagtctgtgctttcattagtactatagtttagtcccaattgaaatcagttggttgtaatttcttatttaataattaactttttggattaaaatgacaatactcatttgtataaaccaactctcaatttagtaaaatattacattagtcctctgagagccttttaaataattatttcagtatccctttattaatttttgggctaatacaagacccaagattattctttttccttttcttatacaaagtagaaaggaacttgtttccccacatatgactcacagtctcatggaagagaagcaactaaccagaaaattactgtgtattatgacatatattttaactataacaacagctagatttttaagtgttttctgtctatcagtgctcagttaagtgcttcggttatattatcaattttattctcaaaaccttgtatatgaaaatgatgtctgtaatccctgttttgcagacagagaaactgaggctcagaaacaaagtcgatatttctacagcaaatatgtggcagttcaaggctttaatctggagccagagataaggggtagaggttatttcatccaagccaagcctttgtcctacatatcagatctgtggtcatgcctggtaaactatccaaaagacagtttactaatgtgggaacacaattccccttctttcacgtatttttcatctttataatgaaacagttgtttctggatcactgcacttggctattagaaggtttcctccctatattgcagccattttgattcattgtactcaaaccttttgctctcatactagagcatgcttggacagttttttgggaaggagctcgaaataaatgttagtttctaaatgcaaattatactgcgttctttttagtcacttcttcctgaaagacaaaaatgcaaactgtttaggaagggatatttatttccatttagagggaagtacaggcctgcatgtggagacagggatggaggctgtcctaggaatgaggctaatgcttgtccatttctaaggctcacccaggatcactgcgtgtttccctggggaagttggagagttttatccacacagcgctttcaacagcatggaaatatgtgacccaaaacttaacacttcatcattcccagcctctttattcacattgagtataagtgttgaatcccttttcaatgactgcacagaaaagggaatcatcaagtggcaagagggagagttttgacatgtctgagctgcaaaaaaatgcaaggaaaatcccagtggtcttctttttcttcccaggggctgttgtaattgataaagtgctaattctttgactttcagcctcctgtaactttctgttttgtttatgctttggagaaggtaagctttgctcttctccttagtaggtagcattggctgccataaaaatgtgtaaaattcttagcacaccagaaattgctctaatatttcctgccactgtgaaacttttacaaagtgtgacttgagcatcttaggaacagagaagtaaagagccaatggagtactaacttcagtggtcttatagctttactgtgagctatgggtggatggtcttcagaagagtatatactcaatgcaatctggaccaagcatattcagcctatcaaaaaacttagttaaattggggaataactttaaaagtgtacacatatgttaattttaactttaaatataacagtatacatcacatacccattaataaaaaaaaataaaacgagggccaaagcctggaattctgtgtcatcagttctttcctaaaactttcccatagtagaatgcatccaatctctagtttcagttttttaaaaatagaacagtacatgaagacacatgcaaggcaatatgttaaaaattctttaaatttttaaaatttttcccagtcttttagagttccaacaattcgtaattttaaaaaaagttttactaatttgcttttattgagcaaatccggatatttataaaaaattaaaactctcttttcccactaatatttaacttatttgcataacattttataaatattgcaataactgaactggcataaatgggtttggtaccaaacacctttgaactttggtaagtaactcagttggcagaggaggtagtgcgcaagtgacccagttgggcactttaagaaacatttcaccaagactcaactgtactgtctacaacaagaattgtgctttaaggttacttttccatgtgttattgtaaaatgctgtaatattttgttttccttcctccttacctccatttctctctccctttcttgcttctttcctctatcctttcctttctacctttttctttgaatttcaaaacaaccctattggaatgctcagtgcatgtcagctcttcactggtttttggaaattcacaaatacaacacagtttctatcatcagggagctcacaacatggccagtgaaacaaatatgtagatcaagaattacattgaacttcaagcactgccaatgagtattttctgaggcaattgtgaatactccaaatctagaatgccagcaagtttctaggggttctttcttttcctatcactaacatctccaacattaagcgctggctttcttttgggaccacttttttctccctacaaagaaactattttgaatacttaacaaccttgacttcccccaaagagaacaataaagtcatgttgacattcagaagccaagcagtcagctaggttcactcaggagcacttacaaatcagccttctgcctcaaaattccaatgccagtgcagctttgtaaataattacagtcatggatttacagggttgcttattaatatttaaaaataagaaagttaaagctccaaaagtcatggttctagtaatctattagtttggtgcaaaagtaattatggtttttaccattgaaagtaatggcaaaaactgcaattacttttgcaccaacctaaatatgaagttattgttgaaacataattgcatttgtgaataataatagtaaaaataatattgttaaataacttgtctaatatcactctcatagtgttcattgaaaaatctttaaactctattcaaaatattttgttaactagtaatttagaaacattttcaaaagcaaaccttgaattgagaattgttttccagttaaacctattaactagatttattttatacaaaatgtctcatccacacagatttgaataacagaggttttattgtactaagtaagaattagacagaagctttgatgaagagacacagaattattgaaatgtcaatcactggagaaaaagtgtaaaatgtaaaaaacaaaaacctttactttttaataatttttaattattatttagaaaatagttaaatgctgaacatgaaaagaattcctctctaaagtaacaactgcatctctatattgtttcccagggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggtaagtcatgctacagtgtagtgttcgactaccttttacctagccacttaataattgtagtgggaaaatatgaaaaaaagaaatgaaaatcatccttcaaaatgaaaattcttttttttttgtctagacctattacaaagaggtacaaaaaagcctgtaaagactttttcaaagatttaaatttcagttttcgtaggttgactatctttgatattggcttaaattttagggaatggtgaatgaagtcaagcatactgttgttctgtggttatcatgcagttgcagtgaattcatatatataaaactgataagtttcatactcaaactcattggcttaaataatctctttattctaaaaaaagattttctggttctactttttttgatgacctttcttgaattagcatttttcaaatgatcttgaagatgacaaaagtaaaatttttttatgtttgaatgatttacataaaagagaagatgaggcatgatttagagggttttcttggtaaatctaaaaagcaaaaataaattgtaataatggcatcaatatacataatacatgattgcagatgtaaaaatagataaactatacacttaatgatacatgtttccaattatcctttttcaatgagaagctcgtctactagggaaaaataaacacacaaaaatatggctaaggaaataatgtgatgtggtggattcattgcacgaacacttattgtgttacttctgtgttcctggaattctactgggcgctggtcttacagacgtcaaagtcaagctttgttactaactaggtcactaaaaactggctggcattccttgggaacagggaagatattttagttactcttctactgctactcattaatgcaattcttgatgcctagcaggtctttaattgtgtgtgcctcagtttcattcttagtaaattagagttgtaatgatttttaactctcaatattgtgactgctctacctctgtcttgaaaatatgattgtatgaattaaagggtgggcacattgcttcaagtaattgcaacaatagcaacccaacccttgcgtgtgttttgtttcaacctgtgtggttatctcatagttcaactgtttctgctgcttatttgtcttttcaagacaaaccttttttttttaattttttaaaagtttgaattctgcatattttcataggcacaactcatttcattttaatggattatgtatggggttggatccttggagacataataatcattttctcgacaaatagtaatgatgtcaccacaacagagaatgagaaatagatctaaaagagttgatagtctcatggtgggggtggaggggaagcgagggtgtacttaatggcagctcaagaaaccaaagaagagacatttataaaatgcaatggagtgtaagaagaaatgtttccaaggaggtcaatattttgaaagttttataacaagaaaaccactgttaaacatcagggatactcttatgtaaatgttttgacctgaaacttgaaactatatgaaacttggctaatgtcagacagcctgacaataggactagcaaataattagtctagtcttttcctaggctcctgaagaatttgctttggttcctttccaaaatgtctctcagtttttcataggtnnnnnnnnnnnnnnnnnnnnaatatatatgaactcttcaagcctcacacacatgcatatgcatgtgtacacacgcacacacacacacacatacacacatatatatacatatgagcctcatatatataattttgcccaaaaagggagaaagacttaaataagggatgtctaactcctgcctcattcaatgtggtttctgttctgtcatgctgctgacatgaagttagtggttctggcctctttcctgcagggacctaacagaaagtagatgtgcagtcatcattttctcatgcaattcaagtatacgattcacgttgacatgaaatgggaaatgagaactcattaaaacataatgcttactctggtgaaagattcattaaagtaaacacactataagatggtgttattcgctttttcaaagaaaaatggaacagaagcctgaaaacagaagctaagcccttgcaacttttctccctgcctgtatcatcacgtatgcccagtactgcttctctaggcccattaatgcctcccgtggcctgcagttagaactcacattgtccatcactgcctcatgtgctttttgtccattcatgtctcgtccctctgaattggcgtgtgtctttgtgatcaattgtttcaagtattaatactaagatttgcacagtattccataacctatgaaatgatttttaacactacaagcatataaacctcttttggaggtaggtattattagacacattgtttttttgagacggagtctcactcttatcgcccaggctggagtgcaatggcgcgatctcggctcactgcaacctccgcctcaccggttcaagcaattctcccgcctcagcctctctagtagctgggactacaggtgcctgccaccatgcctggctaattttttgtatttttagtagagacggagtttcaccgtgttagccaggatggactcgatctcctgatctcgtgatccgcacgcctcagcctcccaaagtgctgggattacaggagtgagccactgctctgggcctagacacatttaaaaaataagaaaactgaggttttggtcagttgacttggtcaaattcaactaaattccgactgaaatataaaactatgaaattcatactaggtttttgttttatattttttgttttctataacttttctcaaaaattaaattaaattaaattaaattcagaattgtttgaggttttattttctaaaacatattctatcatggaaattttgtttgaaaattcttgtaacaggtgtggtcctaatgtttaaacctaactgtggtgttgttttttaaaaaaacatttatcatgctcttgacatattaattaaaagaaagtgttgtgaatggatagatgagcttataaatgtgcatgtattacacatatttttcttttatcctctaaggaaactccaaataattttctcagatagaaaataaaatctgtagaacccaagagaatataaataagaaaaaataataatgtaagagtgtcatgataagcatagcatatgaactaacatgtatcaatgtgaaattatttaatacttcctctagagaggtagtattatccagatcctcatcatctaacacccaggcaattatagaaccttcctgcctctttagtcttcatactctcatatatatcttccatgctgttgttgagatgatttttctaacagacaacttggtctttccctccttcatatatttcaacagtgttcaaatatctgcaggtaaaagtctaccactaagactcttcgtgacctggccactacctaattatgcacctatggctgccatacactctccctaactttacctacctggatacccttctcattaacggttatgttctggtaactatttgcgattgccctaaatcctccatgcctttgtttatgctatattcttactcactcaacacataaacttaactttgtcacatggatacatcttaaatctttaagattctctcttattccaagtcttccctgatacctactgtggtagatgtaacgtgtcaacccattgcctccttcaatactaaagcgcttctttcttccacttctgggaaatgttgactgacaggttgcagctgaagtcccctttccaggcactgtttgtagttaaagaaaaattagccgggcgtggtagcacatgcctataatcccagctgctcgggacgctgagacaagagaatcacttgaaccccggaggtggaggttgtagtgagccgagattgcgccattacactccagtcagggcgacaagagtgaaacgccatctcaaaaaaaaaaataaaaaaagaaagaaagtaacatcacccaagattacttcttgcaagatacattgtatctaatgactggtcaatataagaatatgaagaccctcttgccccaatttggggcaattctgaagagcccctcagaatccaaaattccacttcagattagttgaagtcttcaccatgacagcatgtgagccctgaatctccctttgctgagttctgcatgcttcactctgccacggatcctgggacctctcccttctcaacctccctacactgatttcccagagaaatgcatcaccctcattcttaggccaatttggatactctgtgctcccattgacccgtagcactctggataactatccaggatccaaatcctgttataagtcattaatgagtgactgttaactatctttaacttgtgctctctctctcccccccccttcctttgagtgtgtgtgtgtgtgtacacgtgtgtgtgtatgtgtgtgtgttctaagcttttaaagtgtagaacccattttggaaaaattcaagatatgtaactaatttagccaaattactgactaagctagctatatttgaggcacacatactatacaccagatgtcttgttttcacaagagaaaactgaggcatagtactttgcacaaggtcacaggcactgataacgatgagtaggagtccgatttgaaatttggtcttataactacccaccatatgggcatcctcaaataaagaagttcatcagttaatttctagaattaaataaacccaaaacacatactctaagatatagtatatgtttattctaaccctacttctctctttaataatttgaatgcctttggacacattacctatctttccagttctcaattttctattcttacaagttaaagtatttgtaaagcaccttgtagctcaaaaattttctacaatagaactacctttacctgtgcatcactatttttattacctttcaattctttgataaaaaattaaatttgatctctctaataaacacttgagagtttattatcagtttaaaaaaacaaatacacaaccaccactgcaacaataaatgctttaaaaatattttaataatagcagatttattgtagggttgaggagatgctatgtccactggaaggagctctggagtcggaatcaggatgtggaggctgagaagaaatctggctctaccacctgggaaactggcatggttgtatttgtcagtgttcagtcaggggagcagagccatgatgagtcttacggaaataaggttaaaacatatgcttgaaatttggcatggcagacaagccagagcttgtgaaaatctaagaaaccaaacacgtgtagccaccaaagtggaaccacaaaaggggaagatctacagaaatttgttgccttgctgtagttccattaaatgaggttgtgcagtcaagcatcttgtggtgggtctggagctgttgccagcatcaggaagacaagctgggtgctaagtgaagaaatacacaatgtagaaactgtcaggcatctctgcccctggacttcaccatatctgatgacgttctcagagtcaggccactgcttcactttcgccttccaaatctcacacaaaattctcttttagccaaccccagcttagaaccttacaatgaaggggattcagggaaatggagtacccagattaaccaagttgatattacttttatgcctcagttttcttatctttcagtgggaataatatcctcgaatcaaaaagagtgtacatatataccttgtatttggtaaacttaaatatcatgctaatacgaaagctgtttagagactgggtacagtggttcacacctgtaattccaccacttagggaggccaaagtgggaggactgcttgaggtcaggagtttgacatcagcctgggcaacatagcgagaactttgtctctattaaaaatttaaaaaacaaacattcacttggcgtggtgttgcacacccattgtcccagctacttaggaggctgaggcagaaggattgcttgagcccaggaggttgaggttgcagtgagctgtgattgcactgctgcattcaagcctggctgacaaaacatgaccctgtctttaaaaaaaaaaaaaagaaaagaaaagagcaaacagactttttaaattaaatttttatcatgcccaagaaatatattattgagtcaataaacaatttttaattatatattctatatcgaaatcaccactattgtctccaacaatgtccttggctggttgatagttgtttatttacttggattcaggatcccatccagcttcactcattgcatttgcagtcatgtctcttgagtcgccttttacctgaaacagtctaccactcatctatcaattacatttttcaagactttgggtcagcttttcccagaacagctctttctgggcttatctgactatttctttctgattagattcagattaaagctttcttgagaagaatactaaataaatgatattgtctatttcccattctatcacatccaaaggcacaaaagattaatttgttccattattgattgggctaagcttaatcacttgttaaggttttgtttttggttttttaatggaatacctattctctccaaaattcttacaaaggatcataatgtatgaaacacgtaaagctgatctattttgaaatggttgtgggaaggtagtataatatttcctcttgctattatctcaaacattagtacagcacagtttaaaaaccattgtgttatattattataaataaaaaagtagaatttaccagttggaaataaatttcactgtactatttttaaatgttaaaagaaaactatataaaaatttttctgccttaatattaaaaggacacaattttagtgaacatattccattataaagtcattttgcaggtaatttttttcagatcttgggaacagtttgttccttacagttcattattttgttgtcttttatgctattaacttaattagtaaatcctctgtcacagatggtatcatgagcctctcttttaagcaatagaaaattagtattagttaagtccgaatgataatgtttaacattttttaatgcacatcttgtcattataatcttactacataatttataatgcacattttgtggatatttatattttattgactttatattatttattgaggataaatgacatcattagattagaactgactgttgatgtctatcataagccttgttctggaaaagattccacatgaagagatgaacagaattttaaaccaaaattgtgaagaaaacaacctgaaaataatttggtcattaaatatctttttgcgcaagtttgtttttggccaagatcttcattgggaagtagtttgatgtaatttgtaaaacactgtatcgggaatccagagacatgaactctagacttggatttgcggttacttttctgaatgaccttggacaatttgcttcacttttctaagtctcagatcctcagaagtaaaatgaggaggtaaggctgaagttctttccagttccccaatccatttttttttttaaatcattaaagtactcccatgccgtgtatgtatttcaaggacaaaacaaattcatgtggattgaaaagaattctctcgagcctcccatgtaaatttaagccctacatttttgtagatattgcaaaacttgtttcattttttttttctttcagtgaaatgtttcttatttctctgatcctctgggctacatagtcctggatggaaccagtagcaaatatgttgaaatactaagaggaaagttatttttttacagcagttctggactgatcaaggtacgaaaaaatatgtaggaaatctcctggcagtttctacttccctcaattcctaacataggttttcaaactcaaggttttaaagagtcttatttgtgttttcaaataatttctccaacttggaaggtgcattacttttatttagactgtgatttttgttgtggttacttcctaaaacagagaagttgttttaatcatcaaaatttatattttaatccccttgactgagatgaattactgaagacaaaaaaggcttcctaggtcttcagaggcacggatgagcacattcttacagtcactttgcaccttctttaggtcttttaagtgttgggaaaatctcttcacttaaaaatgcagttgaatgtcagtctctagagtcttggatatttttcaagctgatgaaaacaaatgcctgcatgctgttaggtctaaggattcccagaggattcctgtcacagaatgggtaatgctaagactcagaccactgctgtcctagaaacttacaggttggcaaaagttgccagaaccagctagcaagcactgcctccaacaaattatctaaggtgatgtcctgtgatccactgctctaggttcccctactgctgttcactatcaaaaagatgatggctccatgaaatatttgttatgcatccatcatgtgctatcctaggataaaatgtccacagagatttcagtacagtcatgtatacgtgtgttcatgcaggtgcatacccatatgtgatggatatggagtggggtcggatggttgcagacagccaaacaggcaattacaatgccacgaacacagtcagttcacttacaatcacaaatatgctgtgactaaagagggctaaccagttttggaaggttgagaaagcttccaaatagtggcctaaagtgacataaatgtggcaaattggtattagttggggaatagttcagagatgggggtagaagagggattagctcagaagtgagactcagcacgtcttgctaggaaactacaagtggttaactgttgcttaagcttagagcgtaagggggtaataatgagcaatcatgatgctaagagaaaggagaaccgctgcttgtggcagacttgggacaggtaagcagccatggcctctgggggcaatattgctctgatacggccttttctcacatcaattttttcacactcaatattttgattactctgtttggtaaatatgagcaacaacaatatgcaagctactgtggatgaaacaaaaccccacagaactcaacctctatttttcaagattttattcactttgcctaattggattttcttgatcctttaagtcttagctcagtccatagagctcttcgtccttgattgggttaggagccccttccatgtcctcccactgtgctctgggcatgtctttatcagagtacacatcacactgggttgtaattgctgttccctattattagactgtaatctctaggaggacaggaacctcttcacaatgcttggcacatgtctcgaaaaaaaagcatttcttaataggtatataaaagacatattgacaaggtttttttgtgcattcaacacaggtgatttttttgtgcgaatccacacagctgactaatacatggcaattcttgatctagataccagaaattcaaagagcaacaagtcaaaaatcctgcctccaaaggtttatggtataaaatgacagttgccactaagatttctaataaagtatcatgtccttaagttccctggattgttgttgcttaaataagatttattttctagaactattaaactctaccttcttttatctttatctcttttatctttaactgcaaatgatatgcaagaatttctatattgcttgttggcaagtaaataaaaaaattaataaaattgtcccacagcatacattgttcatttctcttaactggctacagttttgcttttacctacataactttactaaaattactctcttaaaagttattatagttcttttgaaatcagagtctgccttcattgctttatccagccagccaaccaccatacacttaccgtgttactattattttcctggcactatgccagttgttttatttcttgaatgtgcatataggtaactagggtgcctgtttaaagtacagatttctgagtcgcacctaaagagattcttatcctgggttaagacctagagctctcagtcctatcaagtgcaccaaagtgatgctgatgcagaaataacactttggttacaccaaacagacacaccataccttctcttgtggggctaatagtttaggagaaggaaacaaaacatggaatagttgactcaaaagttttagctgaagtgatttagcatgtctgtttgatttttcttttgttttgttttttgatcaaggaaccatagatctttttttttttttttaatgatgaagccaaggactttttccctagaatgatgaagaaacacaaaattttgtataaatttatgtgtaattcacctttacactcacagtccctgggaaagaacccttggaattaggctatcattggttacttaaaaaaaaatagtggtcaattctactggagttgggaatggatagggttcattggaggagattaaatgggactgggaaaggcttcatagaggaaatccttagagatgtgtgaaatgagtaagcgctcatgaggcaagtatggtagttaatggcaggaggaaggacttgagatcccagccagaggagcaatgtggacacacatgcagagatgagagacagtctgccttatttagaggacagcaagtatttagaggacatcttgtatgcagggctttactgtgctacatataacagagggctagaatccatgacaaagattttcgactctagcttatactgattgtggagacaaataagcacactgatgactttggtcatcagaagaatctgctaatgcatgctggaggcttatttgcagaccttatagcaacacaatgtccaagtacaacaagggaaagtattttctctttgcaagaaacctcagacaatgcatctcaatggttttcaacattttgcttaccctctcctctctctatctaccccaagggaatgctggaaagaaagtttcttattgctctttaaacacaaataaaaaatgagaacaaatctacctcccgagaatttgtttagactgaaaaatcaccaatttcaatcacaagttttacaaggtcctgacttaatttttggtaacaaagcaaaacccataaactctctgagatggccattggcctggtcttttaggcaccacaagagggtcagaccagagagtcactcactggaagctgactctatcagtcacacatgatgccaaggaaatccaaatatgtttaagggactgtttgtgttttaaacaggggtcttggtgtcacgtgattcattttggcactcagttttttttttttttatgtattcttaaaaaagggaaggaatactggaataactatttatcttattttgaactaaaaacataatcactgagcatgtatttctgaaatttgggaaatatttcattgtcacagatctcatatatatacatacatatataatatatattatatatgtatatgatgtacagaatagagagcactctgtcagcactattgaaaggcacacaacaataacagtacgtgggtttgctattttctttggaggaaaaatttatcatgagttttgagcatatgcaagcttcatgtctatcactgcaaaacactaagaactgtattttaccagagttttgaaacaaaaattactgctaacactgttcctaatgtcaagagcttgggaagacctggaaggttgataagctcattttatctaaattctacaagatattaatgtttgtaagtgaaggggagacattaaaaatgtatattatcaaaaacttacatggaaatccagagtacaatttatacaggtgttatacaagctaatatctaaaacaatcatatgagaatcagagattaagtgaaactcaattttctaaagatttttcatcatttggggtgaggttttctgtagctttggaaatttatcttccttaatcatagcacagattcccaggaccattactatctcaaacatttttcatattttttcacacttttgtgtacatcttccattacacatattccaaaatgaatagcatatctacctcaggacatctgtagcttctgaaacaaataagataatgtcttccttcttaacataatggtaaaattattatgcacaaattctggtgattcccaattatccagttccctgttaaaacaaatgacaccaattgtggaaggtttaatgagaaaaagaaagctttcagcaagtagtcatgagaattaaaggctaggttggcatggatgatttttccaggaatttttttttttttttttttaccagtatcaattatgagtaaagaaaggaaaaccaaacaaatatatattggattcattcaacaaaatattatatgatggcaagaaaattgtagggttctcaaaagtctgaaattttaatttattaaaagataaacattttaattgaaggatatttattcagaccatctagagtcaaattaacatagatcttaactacatagtcagtcagcaaagcaactctttggtttcttgtccttcatgtttagtactctgcttcctctatagaaaataagaaaaacttccaaaggatatggggcctcatgggtttgagaaaattgatccttttcatctttaatttctctggcttgttgcctccatgcctgtcctcatgagctgtatctctatgtcattgtttttatcactctcagaacacttacatatgtctatcaaggtcatatgtttatacctgtgtaatttagacttagtcattcccgtaattcatgcctattgaactactgtatattttatggttattgcttaaggaagtttgattactttaatttttttgcaaatagtcaagtacttactttattttgcatgcagcagtctttttaagggctttccgggtatcacctcatttaatcttcacaaaatattggcaggacatagaggtattttacagatgaggcaactgaggatcagaaagaataagagctagattgcaaacccaaacaggtacactacaaactctgtgatgtcatgctgtctttccagacacaagtggtcatgacacagccttaatttgcagaagccaatggcttatttatttctccatttcgtgtgtgtggaggaggaggaaaaaaggaagagttttggttaatggctttatagagggttatttctttcattcgtacttattttgtaccaaattacctgtatctgcttgatctgtatatttttaaaatgtttttagatatctataagtctttatcacagccttaattcttgattagtcacactttacattatcaattcttttagtcttcctactcacatcctcttttctttggaaacttctttcaaacatttcttttctggattatagattattgtcatataactgaatgtctttaatatattcactcactttttcgtaagtgtattaactttgcttcatatatttttctagcattttctcacatattcattgataggctattgcaaataagtaaagaattctgttcatgtatggacaatagagttatagaatatatctccaggatgtgaaaaagtcagtgctaacatacatgctctgacatccctcttggctaatggtgcccagttctttcagtggaaagggggtaggattggagaggttgaatatggcagagacagcccagaagcagcaactagaaatcatagccacatcaggaaactcttgtcagattgagccattgctaccagcctctgaaagagaaccatgaaggtcattttgaatttcttagtaattgtgagaaagataaactagttccatatggtggcagggagagaactcagagccaaaataaaaatctgctcagcttgtcagtacctacgaccttaaagttcagatatctgcgagtctgtctactgtttaaaagggttgaggccaaacttcaatttgtcatacaaacaactcccactgccttggatcatgaaagagacacttggccacctgagtatggtgaagatgcaaaaatgtgaagagagtgagtctcttaagtagagaaaattagtaagaaactgggttcatgagattgggctgcccattttaaagaaaagaaagttctagaatctcttggatgatatataggaatattttgaagcctgttcttccataatagaactcactgttgtcctatattcattaaaaaatgtgatgatttagtctttataattactgaaatttctaaaagtgattgaaaaggagtaacttttatcaaagatgactagagaataatgactaatttcaatggacatcagttttcccatgatatgctaattgaaaaaataaaaatgctgacattctttatagtcatccgtcgaagggactcatttttttttctttattaggagaaaatacatggatgagaataaatgccataattctatgtcgtggctgctttttggtcacatcaaattagattctctggagttttttgttttgttttgtttttcacagcttccttatgtctgtccctaatgtttttttctggaggaacattttgtttttatcttctaacatatcgtctttcatacaggccatgtctacactggctgaacacaagaaataaataaccaggattcccatgctgttattttgggagatgtattctaactaatgtttcacacttccaattcactgtcacggtagtcaggtgcaaagccatcctgtatattgatttttctttgataaactgaaagtctatttggaacaattattagcttcatagagaaagccacagatgatagttaattacacataaggactagatattagccagaaccagtgttaaaaagaatcatccaaatgttctgtttgagcctcaactcaaagaagttttttttttttaaatctaattacagaaatacttggcactaatgagtgactggtccttaatttacctgtatcaaataactagctgtggtcgttggctttgggccaaaaattgggactctgagctagctaaagagctgctaagaaagaatgagcccctgaactgtgcaggagaccttctctggactgcatagtttctcccagagtccttctgggattccacagaagtacagttgtcctcatgtgcaaagtttttaaaatattgtttagaagaaatgatttttatgacatttcatctttatctcccagtgcaagagactgtgtgtctcttccttagaagagcataagccgctcctctgtgacatgctaaggatataaacatggggggatgaatactacttcatgtaaattacaagtgctactaagtatccaacagtgaaacattcattattcctcaatatatcagtcccttctacttgtacatcatttcaaccaatatatgtcactgtttacattgcacatcttgagacttctctctacttctgctttatgttttaatgcttaatctgggcaggaccttaaggaattatgttcacaccttattagaatatttcttttttaaaaaataattttagctgaaacactaaccttaagcatatttttattttgaatttgctttcaaattgttttcagttggctattcatacaatacaaataaattgttcaataaaatgtaaggaataataggaattaagacatggcctttttttcctttattctatctgcataatgccttgctcatgtttttatattctggagtctctgagaaaataagaacaaaaacaaaactggaaagataagaaggatgtgagagactgtatctatgtacacacacacacacacacacacacacacacacacacaaccctacatgtgtattttttaattatttgagttggatgggcaatgaagtgggtacccaggtaggtatgttgagtacctaactaaatgagatgtaaaagctatacttctgaaatgtagaccaagtatattttgatattagagttatttatatttgagtttgcttttgcttgctaccttgagcttaccaaaaattaatcagttagtaaacccatcatccatctagtcaatgaacattgaggcctttctctatctcagagactgttcaagatttcaagattctgatgattcaaagatgagtaagacatagtctatgcctcaaggagctcacagtttattatgggaaacagaaaagtgaaaagacaattaaaatacagcaagtaagtgtcatcatgaagatgctgatttgatgctctttgaggttatacttggaacaaatcttaaaggatggataggagttcagcagctgttcaaacctggagagtaccttctaggaagaggggatggtacttgcaaatgtatggagaaataagagtgttgcttagagggaataagtgagtgggtaaggctggagcactatgtgtacgtgcagaaaataacaagatatgggagggttagggtgggtgagacatgggaaaaagtagacagtaaaggactagacttcaaaggccttgcaaatcacagtaaaaaatttggactttatctttgaattttggaggaacaaccgagcaactttaaccagaatagaggaatgatgagatgcatgtttttgaatgagctgcatggacttcatggggaaggggaagaagaagtgaaactcaaggcagggagactagttgtaagtcttctttgataatccagagaagaactgccaagactagaaactgacctccaagtcttaaatagatctggaaagatgtctctttactgatagcctaacatagcattgataacattcatacggggaaaggtcaggaaagaaatgtggattatattgtaatcctaatacctatacctatatacctatacctataccagcacacatatagagagatacctgaaggcagccttagtcttgtgactattgatgatatattcatacaatattttccaaatgattttagagaaaaaaatgtaatgatatgaaaaagtggtcacaaatttgtatttgaaaataatctcatacagaaacatgtaaagtataattctatttctatttgtattttcacatggagagaggttgtttttgaaggatacctctaaagagggagatgaaatggggctgtgggcagaagctttacttatagtgttcaaaaattttataagaatgtgttcagatacgtatatatttaaaaataaataatattttatatttagaggggagaaacaagtaaaatactaaaaattgttaatatgaaaagagtagttatactcagtgatgagatttgggttgatttttatttcttctttttgcttttcttctcaaatttataatcatgcatttgtattgccttgattacacaaataaataattataaattatgagacttagattgtaaatcttatgtgaaagggtaaaagtataaactatgtattcaagcacatagcagtctcttatttaaaatcaaacatttgtgctgaattccctgcaaagacactatagaaaatcattacatcctggaaagtctgtctttattagtgagcttaaagctactgcggagaaaatggcattgacttaccgtaaaaaggaaggccattacaaatcacagagaaacaaaaaatcagagttaaaattgccattgctcattcaagagcgcctatgggctaaactctcccaggcccagtagagcagatttcacgctaggagagacgtagctacttaattttggaatcattcacttattctctcaattctgattctgtcttcaccaaacaagtaactttctgattataatttggctttctgtgtgaaattctctctaagaagaccatgagactgggtccccaccatattcctacttggactgcaaatggaggcctgacaaaagtctcttgttagttttgccaatgtgtgtctatctttgggaggctgaggacctccaaagaagtgattgaattgaaagttctcaccagctctggaaggtggcgaattcacccaggtaacatgtcccagaactccctttggtgatctgtcatcttactttctcctggtgaaacccacctccacgtgggctggctgcagcctcaaatgtgaattggcactttaaaaaattctacaattttgcatcaccagttacttgtagtctgcctctcagagttttaaaatacaagcttgtatgtgataattcaacattagaagattatttgtactactgtgaaccagaagttccattaattattgaaaccaacaaaaactgactgaggtttacttgtatactttgctctggctcaaaatctctgcagaatatttgtaaaatattgcacaaacatccaataatattgttttttgctaaaaataatatcaaataccacaaacagtaggatatatacatatacctagatgaaaacacaagttaaaatatatctccaaatattaattgatctttattattctatttcataataatgtaatgttttgctcagagccagcctaggttttaggagtgtctcactcatacagagatgtgaatcacccattaactatactgtgggtggacaggattcataaataagacccaggcatacaggtggtgacctatatgaatttgaaggggatattactacatgattctgatgaaaacattgtgctggtatggagaagcagtgttaggtagagttagagagagaggggctagagtcttagccagagaacaccttgagcttcaagctgtcgatacgacaacttcagtttagctactctaagccctatggagccactgaaggacgtgagcaagtttacattagttctaagcactacgttgcccagaaggatatgaaagcagcttgtacgatcagtaggaaatgagcagacatcagacaggtcactacatttgacaactattgtgatttgcccactagttctcggattctaggacaatacttgtcaaaatgttctctttggacagtctgcaaagagaaatctgagatgctagttgaaaacaaacattcctggggttagtaaataggccttttaaacaaaagatcagatgatttgttatatgcacatccattagagggccactgatctaggttaatgcaagttttatataagaaatgtttctagatagtaagagaggttcttcgaagaatgccatattaaacagatgggattttgaatttaattttagggatacctctagaatacaagtccctcaaaagcacagatttttgttttcttttcttatatatcttaagtgcctagatcaataactggtatgtagtttgtgctcagcaaatatttgtccagggaatgcataatgattcaaagcttgagttttagactcataccagctaaattccagcttacatagcttccctaaaccttagtatacaaattggggatattaatgtctggatcacagatttaatataaaaatttaatcaaataaacactggaaatcatttaacatagtgcctggcacagaggaaatccccaatcaatgaaacttcctccttttattgctattaataatgtttagtacatctgcactattagatattaatggattaagggagtgacatgctgaattgacattgtaaaaagcgtttatgtttagaggttaatacctgtattaatacaataaacccaagtttttatgttttctggatcctgcagtatcagagaaccacatgagtttgagcatgcataatgaaataaactttttccttcctttgttcttttggttcagatagcttgggtctcctagaggtttgttggaagggctgagttcaaagaaagaagaaaatgatgaaaaaggcaaacattcaacaagctggtcttctgggttctgttattctgtcgaatggcttatctttcttttttttctttttgacttcaggttgtatttaaaaggtcacactgggacagcaggaaaacagagcagcctgatcttacacggtgctgatttcagcactaaagatgctgataatgacaactgtatgtgcaaatgtgccctcatgttaacaggaggtaagtcctatggggccattctctaagctatgtttcattggtttggggcttaaggtttcttatctatgagaaaggagtatgatcttatggtcaggaaacttaagagcaagtccctagagatcattttgttctgcccacgaatttaccctgcgttcttgtgtaagacattgctagcatatttagaggtttgcgtcctcccccaacatcaagagtgaaaatgtgctaagcttggttctgaatacatttttcagtctcttaagtcccagatattctactttctaaattagtatcttgatatccttagtaaaatgaacaatagtttgggaactcagcatatacagcaattacttcttataaaatacttcgcaattatgtagtaagttaattgatcattttgttgaaatgagataagaaaaataaagaggtgtagttaaaccaaaggtaacacagttcagaccagctataccagagttttgcattacataatattaatcattgcaagatattttagctagtataggagataccattaaatagtatcatatcatagagtaagaaagttaatccttttgtacattttaaatatttttccagccttctgatagccccacagagaaattctcaatttggtgctctcatttctgtaatacttcttcagtgatgtaatgcatcacttaccaatgatgcttcttggcaaaacaaacaaacaacaaaaaacaacaacaataacaacaacaaaaaacccttatccatagtctcagagccttggttaagcaatggcacatacctaaaattaaataatgttagtttgttttaattttatgagttttttatctacttccttttttttttttttttttttttttgaaactgagttttgctcttcttgcctaggctggagtgcagtggtgctgtctcggctcactgcagcctccacctcctgggttcaagcgattctcctgcctcagcctcccgagtagttgggattacaggtgcccaccaccacgcccggctaatttttctatttttagtaaagacggggtttcaccatgttggccaggctggtcttgaactccggacctcaagtgatccgcccaccttgctctcccaaagtgctgggattagaggcatgagccaccatggcacctggctatatctaacttctgttacagcaaatgatgctgatttcctctttaaatgaatgatataaacttgcattttagaatgcattcacaatattctgtatttaacaaataatagatttaaagaaaaaattgttacatattaataagagttataaatggatatggcaaaactgtgaagttgatacatgactgtctgaagtttgggaaacactaagataaaacccaatggcaaatgatatcactcaagaatgttataggctctggcaggaaaggagttgacaacaaacaaaattgtaagagaaattcctatttcagtgtttctcctctcacagttttagtgctgcttctctcttactgtaataatcactaccaccttcaattgttctgatatactttctgtcttattctgttacaaaacatgatttcatattagcaaggaaaaaattgttcaaatctaatattttcctttcccaacactacgttactaccattattaaaacatattacgtgtttctgcacatgttgtactatcttacttgaactccagatccactctgtgagatagcagggagagaaactcatctctatgttgtacatgaggaaaatgaatgacagctagcgtttgccatttcatcccaaacatctagcacagctgactgtgacacatagaaacttattagaaaatgtagtacctgaattagtgaagtagtagtgtacatgaatgagcatagtacatgaattaccatcttttaactcttgaaataactttcaaattttaaaaccaaataaataaatcattaggttgatgttatcttcatccacgaatagagcttggtagagtataggtgaaagttttggatgatgatgattatcatttttttgagaccaagtctcactctgttgcccaggctggagtgcaatggcgcaatctaggctcactgtaacctccgcctccctggttcaagtgattatcttgcctcagcctcctgagtagctgggactacaggtgcgtgccaccatgcctggctaatttttgtatttttagtagagacagggtttcaccatgtcaaccaggctggtctcgaagccctgacctcaggtcatccacccacctcagcctcccaaagtgctgggattacaggcatgagccaccacacccagctggtttgggataaatcttttgtcttcctccctatccccaacccctctattactattatcaccaaatcacagcccattgaccccatccatgccacctatgttgatatcttttcaatatgataccagccccaatattatcaaaactaacctattatgattctgcctctatcatattctatcatattctttctttctttctttttttttttttagacggagtcttgctctgtcacccaggctggagtgcagtgacacgatcttggctcactgcaagctccacttccagggttcttgccattctcctgcctcagcctcccaagttgctgggactgcaggcacctgccaccacgcccggctaattttttgtatttttactagagacagggtttcactgtgttagccaggatggtctgaatctcctgacctcatgatccgaccgcctcggcctcccaaagtgctgggattacaggtgtgagccaccgtgcccggcttcatgttcttttccttaatctttgaactatccttttggcatcatatttaacatcatcaaatattaaaaagtctcctatatgtaattttatgactcctccctcagccctcacccccaaaactagttgctacaaatctaatattttttttttaaatggtacacacaaggtaggtcttgagctttttcctgatagaaaatttttatttttattacttccctgatctcataaatgaaattgtcagcaactttatacaaagacaaagggactttgatttttcagtttcctgcacattttaatattgaaatatgctttattttctccatgtctattttcacagatattttttcttaccaaataaatacaatacatgaaaaaaccaacagtaaaatctttcaaatgtgtccttagaagagtattccaatatgttcatatttctgtcataataatgaaaatatggagtgaagcaaagagaagaatgtacatcttggttttcaatgagaaaacttcactgctcagatttatgattttatttctgctttaaatgattgaacttcgtcatgttctttcatccataattattcttggacccaattcttactcaccaataaacacatatgtttgggagagaatatttccgcttattgcttgggctggaatagtctaagtaaatgtgtttttgtaataaacgccattaccttatcaaatgtccctttgaaagaatccaggtcttgcaaagctatttattatggaaagctaaaatgtggaatttagatagctaagaactggagaacataaggatgaatgtcattgacagtccaggtaactggagtattgcctggaacttaggtcctacttagctactccccaccactactacttattctctgtcaaaatttcccttagagccattttcctcatctaatgatttttcctttccttttttttctttttaaacttagtatttgagcctgttgcctatttaaaataccctctcttaagcagtgagacttcatactctttggagctagtaactcatagctctttgtcatcatcaattaaagctttgttttatcttgtttatttatatatttttcctttgtttcttctaaaagggattaagagtaaaataagatttattgcccactaactatcctagttttcttcaagtacatagaggaattctagctggagaatctggtatcattacccttatcggtaaaagactgaatggcaggaaataggcttaactgaaagcagaaggtatttcagctagacccaaggtaggacttgatctttgttcttcatttcctaacttccttatttcttggctttcttctatcagtttaagggggttaattactattaaacaaatgagcaagacaggctagagcataagtttcattaaaaatttaaaagaaatagttttatctactatttaacattaagaaaatgaaaatgaaatctcattcaatgcatactttttgtatagatttattgtatatggagataaatatgtgaaaaattctgattccaaaattaagacagtgacaaatttttgttactagattgtcacattcaaaacaaacttaccttcagctaaaaaaaaatctttgatactaaattaggagttttcaaagtctgcatttctgaaagtttgcttaagctacagttaactaaaattattaatgttataattaaagaattatttctaaaaatctttcataaactgtaattattaaaggttgccaacaacaaaaacaaatatgttaccgttttacattccttactttagtttcagtataatttccatatttagtacataatataaaggctatgtaaaaatgtgacctaactttctgtagaaagaatctattgaagtagaaactctcatttcttttcccaatgcataaaccatgtcaactggtagacaagactttctaaagctaacgaaggatatttttcagttcagtccttaaataggggataaagccatacacgtaaatttcttagtacatctagaactttccagatgctaacagcagacagttgacaaacgctcactttgcctactatataatcttaaagaagacaaagaaaatgatagaagctagcagttttttcaactggtgtatgaccttgaagtgacaagatctttgggaaaatataattgtcttagcatttttgggaacccaagaaagacctgctaagcatgatcagataactaaaattctctgtttcaaggtaaaaatattgagagaaaagaagatccatatgactaatgtaagattgactatagaaatctacattgcactacttttatttcaacccaatttctatatttagtacataaaacgtaagcctattctacacaaatgtaagttctgtgaatgcagggattttgtgctgtccactactgtatccccagtggctgccatagtgtgtggcagatagcatatgttcaataaatattggtttagtgagtaaatgttagcagagactctgaaaggacatggcaaaattacaaattattctggtgaaaagacataaatgaatgttagtataaacgtgattcttgcatgaacttatatttaaaatgcctaatacatacatgtatttatatgcaccagcatggaacaaagagatgactatcaaagactgaaactaacttaagaataaccaaaccccaaaagactgaactgcagaattataaaaatttgagtgttaggttcctgactgtcaaataaatttgagcttcctaaaatgcaaagtttaagattacattcctattttctcgggcaaagtttcatttcttagaaaaagagcaaagagtatcagaaaatgtcttttataagtttggaaaaaggtgaatcagaaccgatagtcctctcgtgcaaggctacaaccaaagcttaataattgacagtggatgagaaataaccaattaattttgtattgtactcagtaataatatttaaaaacttattgagctctttctaatggatacgtttatattattctaaatgatttatatttaataacatatatgaagcttccaaaaactcttggaaatacagactacaataatacttttggcaagaactgagatacagaaaagttagataatttgccataggtcacagaattttgtcagaagtagaatttaaatgcaggtactcaacctccagaggcctttgttctatctactctttctactgcctccattaaaagggatgacattcaaagagaatgacagagctctattgtaccgtttgcagcatctttttgcaagcatttcctcatttaaacatggttaaaagcaaaatgaagtatgagggagaagagaggaggtaaaagaatacctagaagttttaagtgaatttgatattcctagccaggataaacaacttttcatctttagaacaaaaagaagagaaaggaaaagaaagaaagaagaaaggaaagaaaggaaagaaagaaagagagagagagagagagagaaagaaagaacagtcaaaaacaaacaaacaaacaaacaaacaaaaaagaaacaaaaacaagtccttggcctgaagaggatatattaagagatgacagaaggaatggacttctagcaaggttctttgcctcctgcatgcaagacccatgcagctgcttcttgaggcttgctttgcgtagggccaactttgtccacataaactcaccaagagattttttccattatgatcccattgatggcaccaatcaatttagtttaaactcattcttagttagtgatgaaagatgaaaatcttaatttctgtgcaagctgttttgcatactgctgattagaatgcatgcattgaaaacgaacaaaagaaatctacaaaaacaaatataccttttcattttgctgtacattttaccacagaaaagaagtgttgagaggtgttttgtttagaatcagaagaatttaagagttagatttcctgatgttcaaataaagttgaacttcctgagtacaaagttgagaatcaaattcctattttctgggcaaagtttcatctattagcgataaaatgtgaattttctgcttcaaagataaaagacacaaatgattttaaaaggcctgggatagttattactaaactaaattttaatgagttaagtgtaaatgaattggaaacatgaatctcagatttcttattaaaatatacatgaggttacaggttatgaagaaaaatgcttcgaaagtacatctcagcagttgccaaccttaagacatttgaggctgagcgcggtggctcacgcctgtaatctcagcactttgggaggccgaggtgattcgatcacctgaggtcaggagttcgagaccagcctggccaacatggcaaaaccccacctctactaaaaaaaatacaaaaattagccaggcgtggtagcggatgcctgtagtcctagctactcaggaggctgaggcaggagaatggcttgaacccgagaggcggaggttgcggtgagccaagattgtgccactgcactccagcctgggtgacagagtgagactccatctcaaaaaaaacaaaacaaaacaaaaaaaaaaacagaacaaaacaaaacaaaaaaacatttgagacattttatcagttgtcccaatagcagagggtaacttttttttcaatcctttgcttgcatcattgagttctttcaggcttgaagtgccttccctaaatgaattgctctaggatatttcttatttgttattcccaagcataaacaaaatacaaagtcagtgttttcccaggattgcacagaatatataattcagctattcagaatcttatcagagaggaactgtaaactcaggcatactcttctgtatattcatagaacatcttcatcccatgcagatttaccatatgtactgagtatctatgatcacctgtaaatacaaggaatgcatatgagtaatgaggagtctgctatacttttgcctgcattgaaaaaatgctttaaaccacatattttcaggatttgtgtttaaaagacttggccatgcttaatttttaaaaataaaggtagaaagtggacaaactgtttgaaatatttgatacgaacaaattatttagtttgttttaatgtatatatcaaagaaaacagagaatccttgcctacacagaagtaattacttcttctaccttgaagttaggatattttataataaaactgaaattgtcatgagaaataattgctcttttatttcattttcttccatcttaattcatcatctttattatcagttgctctgagatagatcacagaattcatggcccactagtcttaagataaagagttaattgaacatttcaaactccttgatttgtcatgaaatcaaaatgaaacatttaaaaaaattaggaacttaaatgccaagtttttataacatgaacattgtacagttgtacttatttgggtctaattattttcatatttctctaataaaccccactaagcaaataagaaaatatgttggcactgatgaccttgtctttattattaaattactgtgatgctccacaaggtcttgtctcttttttttctggcctaaacattctgccccattttctagataacttacagctggcactttagtaggattttacaggctgtaatagtgcattatcttatttgattcttataactgtgctgtgaaaatggttggttagctcttagaatctatgtattatgaatgtgaccttaaacagttccttaaactctgtgagcattagtatctttattatggtacttgccacatcacttaaggctgtttgggggataaaatgagaaaatgcatataaataccttcatatgaacgattcaataaatatcaaatactattggtactattgtgtaggatctcttggttatttattgatgaagtaagcatgaaaagtctgggtcttctaacttctgctccggcgctctccaggcttcccattgcccaaaagaaaatgtctaaaggtgtaataaaaacctttatgttttccctcctgtttattttttagccctatattctccaaccctttaacccactggcactccagccaagccaacctgctggcagacactctcccctggtcttccagagtacagactatatagaagctctttctgtccagtgaactcatacccatctttcaggacccagagcagctgttgaatgagtgagctttgtggtccctcagacagttagcacctactgcctctgtgtttccatcaaattttcttcttctcttagtttaacggctatcatctcaatgtgtagcattttgtttgtctcctacacaaaactgtgcatgctttaaagtcagaaattttgtttccaaaaatttctgtcccctatccctatccattggttaatatttgcagaattgattctagactcaattttctcctttttttttttaagctgtcacatatgctcaggatggctttggaagatcgtagagaatgaggactctaaaccatgtttgattaaacatttaacctagcagatctggttcttctggttcgattgtggttcccatctgtagagaatgttttacttgtttgcctgatcatggacaagcaggctggctaaactacaaattgttccataaacattgaacttctcaccaggactgcctattcctccaccttcatttcctgcaagtcatttcttgtttactgtgcaccagttgcactgatgtccctacacatcccaagcttgttttcttcctcatcgcctttgcaggtgctgtattctgcttagcagggtcttttcccatcttcttggggctgtctctctcctccttctggtctcgttaaatatcagcttctttcacaaatgtgaaaagtcaagttattctccttcagagctcctacgtattttcttcatgacattttaagtcataatttatattaggttggtgcaaaagtaattgcgttttttgtcaataacagtcatggcaaaaaccgcagttacttttgcaccaacctaatagttattttatgtgcctgcttacatatattcatctgtttctcccattagaagtgagtttcatgaaggcaaggactatgtctgtcttgagtattgtgtaacaacgtttcacaataattatatattgaatggatacataaagaaaaaaatgaatacaataaggacaggtgttacattttggggtatctatcaaatacagcattttagtaagctaaacaacttcagacaacaaagacttcacaaggagaaccaatcagagagtcaatcagttaacaagcctgcagtgacccgccggtcatttgggaagcaaacttcgttaggtgtcctactaagtacaggagatgggccaatatacaaaccatggctttccattgtttttaggatgatgaacaaaacactgggtgatttgcttcagaccctcttagcttcaggtgactatccccctcgttgattgtgacccagccatactggccttccttcaatgtctccaaaatgccattctactcattgcaaacattaccccactttattccttcaaaaagctacacaagatcaatttacctgactctctcacaggctcttactgtttcttgtctctttcctaagttttcccaaagtttcccaatgagcgtatcctttagcctgtgctctttattgccaggctgttgttgcaacagacgtctgtctttccgcactcctctgggactcctgtgactttctataaaccaaataaacaaaaacacacattttaccccaatgcaacttggaagagaattctatgaatcattgtcagtctcaacaatagagtaagtgtgtttgcttgagagaccatggtgcatatttgaaagactataaaaaagttcattaatgcaatggaaaagtgcttcaagaaggtcacagaaaaggaggagaaaagttaaaaacagaatcaatcaagttgaatttcatcttagagttttattttagtcctttagaaagagtcttttgggcaaataaattcactaatattagaatgctttttataatataaacagcatatttaacagctgtactgatcaaaaattagaagaattaatcttaagaaaaacaaaggtaggattttacttgcagttcctccttcttttccaaacaagaacctttttgtccctcatgttttgactacattaacatttatgttgtttgcatacagttgataaaactgcacggaatataatgtctttccaaattcatcaagacataccttgtggttccccactatgaactggtgattaatgcagcttgttacgcctctagtgtgactttataaacacaagccagctgtactcatcttctaaagttgaaaaatgagaactagcttttctccatttgacttcttctaaagtttctgcaagattgtgctcatgttacagttaaacatcagctgtacagctttctctttctttagctattagtcccttaggtataagtctgtaatcaaagagaggtcaactgtatccaaataaaaaatatgccagaatgtctctggcataaatctctccctaaagattcagtagtgttacttcagcagacaggaaaaaacactatgctttatctaaaaatctaagaacttaatttatttaaaaaataaaactgacttatccagttatccttatagagagctatacaagcatagaatttccatgttactcatcaagttgtttttctttttactaagtttggaaagcacttaaataaccatagacaaaatatggctgtacaggaactgaatggctactattgctgaacactttttctactgttataaactacagagagggtacgttaattaaaagcccttttgagcatcatagtcattgcacagtatccaattaattttagaagcagcttagggccaattattgacaaacatatgcagtagatggagaatatctttctatttagatctcagttgcttgtctaagtttctgcatttcttcactaataattaattgttctattcccaataacagtcttaagatggaatgcctcttatgggtatatgcattttccttattgcatttgtcttaaatgtaaatccatctcttatgtagattgtatcttgaagcccagaggcttcccatcattacaagaagaagtgagttccagtggagtcacactgaaagctgctttccatgagagcattgctgtctgtgatgggtcatacaaatcttaaatcagaagtcatttaaaacagtttcactactgggaatatatttactgatgcctcgtaattgcaaataagcataacaagaacaagcaagtttcccatcatttaatgccattaatttccaaatattccatttacttaaaattgttgcctctccttctctcttctattatgaattattttttcaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttagaacagcattgtcctctgagttggttaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagttttcagaaaaagaaatgaacataatcaagtaaggatgtatgtggtgaaaacttaccacccccatactatggttttcatttactctaaaaactgattgaatgatatataaatatatttatagcctgagtaaagttaaaagaatgtaaaatatatcatcaagttcttaaaataatatacatgcatttaatatttcctttgatattatacaggaaagcaatattttggagtatgttaagttgaagtaaaaccaagtactctggagcagttcattttacagtatctacttgcatgtgtatacatacatgtaacttcattattttaaaaatatttttagaactccaatactcaccctgttatgtcttgctaatttaaattttgctaattaactgaaacatgcttaccagattcacactgttccagtgtctataaaagaaacactttgaagtctataaaaaataaaataattataaatatcattgtacatagcatgtttatatctgcaaaaaacctaatagctaattaatctggaatatgcaacattgtccttaattgatgcaaataacacaaatgctcaaagaaatctactatatcccttaatgaaatacatcattcttcatatatttctccttcagtccattcccttaggcaatttttaatttttaaaaattattatcaggggagaaaaattggcaaaactattatatgtaagggatatatatacaaaaagaaaattaatcatagtcacctgactaagaaattctgactgctagttgccataaataactcaatggaaatattcctatgggataatgtattttaagtgaatttttggggtgcttgaagttactgcattattttatcaagaagtcttctctgcctgtaagtgtccaaggttatgacagtaaacagtttttattaaaacatgagtcactatgggatgagaaaattgaaataaagctactgggcctcctctcataaaagagacagttgttggcaaggtagcaataccagtttcaaacttggtgacttgatccactatgccttaatggtttcctccatttgagaaaataaagctattcacattgttaagaaaaatactttttaaagtttaccatcaagtcttttttatatttatgtgtctgtattctacccctttttgccttacaagtgatatttgcaggtattataccatttttctattcttggtggcttcttcatagcaggtaagcctctccttctaaaaacttctcaactgttttcatttaagggaaagaaaatgagtattttgtccttttgtgttcctacagacactttcttaaaccagtttttggataaagaatactatttccaaactcatattacaaaaacaaaataaaataataaaaaaagaaagcatgatatttactgttttgttgtctgggtttgagaaatgaaatattgtttccaattatttataataaatcagtataaaatgttttatgattgttatgtgtattatgtaatacgtacatgtttatggcaatttaacatgtgtattcttttaattgtttcagaataggataattaggtattcgaattttgtctttaaaattcatgtggtttctatgcaaagttcttcatatcatcacaacattatttgatttaaataaaattgaaagtaatatttgtgcaacttcattttatttttaatacgtattttgccaaatttaaattagagatttatgaagatatagaatcattgacaaaaacctaccaaatgaactaaagcctcaatcttagaacaactttcagtctgggatgaaataagaaagcttagcctcattagaatggtagatcaaagcagtggatctcagtcccatgtccctacaatatgattgtcatgtcttgccaattattacatgccatattatcatgtggcaacggacaatatattctgggaactctgaatgtagaataagaggatgtgtgttaaaaatctgagcttggtatacagggggaaaaggaaggagcgtaaagaagatgctacttgtctcactcacctgacatgccatcagcagtcttatcagtccttgcattcttacctttggccttgattctgctcctattgccattacattgattcaaaccttccttaatttccacctagatgattggaaaagacactctttcatcctgcctctctatgctgttgttcacctcgtaaccataaaagcttattccttctaaagccagacttctgaacatggtttttccctgctcaaaacacttcagtgtttcctcactactccctgaacttaaaataaacaggtcaggttaatctcagcctgcattgccagacagcttcattccacctactcagtattccaatcagaacaaagaagccccatggtcgactacttgcaaaaatgatgcctattcttcccctttctgtattcataccttttgcaatgcgactttgcagcttgttccataaagagataaactctatttccttactccctgaatggctaactctgaccttctgtagccaataaaacacaacagaagtgataactatgtgccagttctgagtctggtcagaaacattctacctttggcatgaaaaaaagtccagcatagcctaatggaggattagagaccacgtggagcaaagcctagtctaccagctgagaccaccctagaccagccagcccacagctgacccatgggtgattccagatacatgagtgatctcaactgagatcaactgagcctggctcagatagcagaactgctcagctaacgtgcattatcatgagaaacaataatgggttgttgttttaaaccactgcattttctttttcagagttttgttaaacatcattattgtagcaatagctacctgatacagaatacagtgctgcagtccccacctacccttctgccagccgtgtgagttttatgcatcctgagctttcaggaccgctatcccaaatgtcccttccttcagctcagatgggcaaaacaatcctctaacaaccctctgggatgcataaaaacattagctgcttcatgaccccttttctgatgccctctattaattgtcaccttctcaatacatacatacttttacagctcaacatattttgcttgggttttataaaaggctgcctcttacttatttttttttaattccccacagtacctaccagaaacttgttatttgttgaatggaattgaattgctttgaaagactaagaaatcacttctacctataaaaaatccaactctcagatttgaccactatgttgagtcatttattttcagactttaaacttaggccattctcctccagaaaaagatgtccgaatttataattttagttatctcagatgtctagtttattatcaacttcgctggaacatatgtattatataaattgagggaaacctacatgcttcttttaaacttaaaactgtaaatatagaaaatgtaccattgaacggtaattactcatttactctttacacatatattattgctggggccaggcacggtggctcacgcctataatcccagcactttgggaggcctaggcaggtggatcatgaggtcaggagttcgagataagcctggccaacatggtgaaaccccagttccactaaagatacaaaaaatta

SEQ ID NO: 16982 - DNA, 51967 bp, Human
  misc_feature (1)...(51967): n = A,T,C or G
atttttaagtgagatacattaaacctcataaaaattagagctaacatttattgaacactctgttgtactgcctcccaagtataacatggtaattaaaacactggaggccaggcacgatggctcacccctgtaatcccagcactttgggagggccaagtgggcagatcacttgacctcaggacttggagaccagcttggccaacatgaggaaaacccgtctctactaaaaatacaaaaattagttgggtgtgatggtgcacgcctgtagtcccagctacttaggagggcaaggcacaagaatcgcttgaacccgggaggtggagtttgcagtgagctgagatcgcaccactgctctccaacctgggcgacagggcgagactccatctcaaaaaaaaccccaaaactaaaaaaaaaaccccaaatgttggaaagttgcgcgaggtataattcagtttagaaattaagaatccaagacaaaaagtctgcctcaggaccacacacaagcacgaagaaaccaagatagttcaagcatggaccttaaaactgcactgtctaaggctgttgtcactggtctcatgtggctatttaaattttaattaaagtgaaataaattttaaaattcagttactaagtcacactaaccatatttcaagtgctcaatggctccatgtagctagtgggtactgtacagacagcacaggataacatttgcatcatggcagaaagttttagtggacctaaccaaaaaaaaaatgcctttaggctcatttcgtgatggcagataaaagcctctggaattctgataagtttctgaagccatgttatagaactggttattgtaattgcgtgaacttcatccaaaactggtgaaagcgtcaggttggggatagtctggtggttgttactttctgtccaacctaatactgaggctctgagaaattctgtggtgaatttctgtagggggacacagcagaaaaggcatagtataggtcagaaaacctgggtcctataatacatagtaataatgacgaccatttactggttgtttcctatgtaccaggcactgtgctaaccacaggcttcatttaatcctcacaatacctgtgtaaggtattattaccaccactttgcatgtgaacaggctgaaattcagaggagtaaggtcacacaactagtaagtaggagagcctggattcaacacctggtatctattcccttgcgctgaacaactccgtgccctcactttcttcatctgtagatctaaaaggattaaattagaacatctcaaaatttctactacttctaaaactctgtgttctaaattaggacattactatctatctccccaagctaatgaaataagcagggttcctgggaggagcttgttacctatttttctccaaaggagatgctttcccctgtctatgcctctgtcctaaaacctttggtttcccactatctaatgtggtttcaactatctatgaggcgctttcgtggcaaggagtgattctctccagtaggcaatcctaagaacgagcgcagtgcttggcgcacagtaaatgctccatggaccatttatgaaattaagtctaagtggacttcaggaaaatgtgaatctgctaaaatgaactactagccagtatactaggtagaaaacccagctgacgaagaaaaccccaagtggagaagcccttgtagggggttggagacaatttctgacccgcagaaacctgcagtggcgctgacgtttacaagtggtggacaaaacgccacttgcaacactggaagaagcggaaaaccccacccactctggaacaacagcgatcagccccgaatatagggtccccttgccgccccgtagcctcctagtcccgcccctctcccaaggcccggcagtggcagcggctgcggctgcgcagtggcgcgggcgtaggcggagcagcgcgcgccgcggtcagctgactgctgggctggcacgtgacttgttctgtgttcgcttgggtagaggaagccgtgaggccggagcttaggtcgggaagggatggatcgctgagccgatagcgtccgctaggctgtctgcctcggtacctgttactgctgctacttcctcgtttgacaccttcctgggtcagtgagcgatggctctccccggatggggagtcctggtcaggccgaagcatgagctccggtcgctgcctgggagggacgcgggtgggtgcgggggcagagaccgtggcgttggagctggagctggctgggtggctgtgtctggtttctcggcgccaattcaccgtcttgggcctaggttccgtctctaaggaagagaaggagggaaaaagagaaagagctctcgtgggtagttaatgacaggcagaaaggagagatacagcggtctgggatctttcttcttgggtaggaatgcacgccgcctgattgattgaggggaatgaagtgataggtccaggtgaggctatggagtggtgtgtgtgaggtcacagctagcgcaagtgccttcactgggtgtgtgttggggggggcgcgggtgtcgggggtcgggggtggtgggatgacagtttaaaggcctaggagcccctaactgcaggcaaggaaccctcacagagtacacaaggtccctctaggaatgagaaagaacaggaatccagagaactcaactattttttagtagaatgggggagggtaggcaaacaaaacagaacaaaacaaaacaaacccctagaaaagaacttggtgagagtcacataaggcatattgaatcacttgagaaacaggagtaagggggaagctagtattcttttcagaggaaaattctggtatgttagggaaaaatcacatgcttcagtgcgagcccagtacttagcgccgctctgggaatggaacgggtgggatgtgaacagtctatccttaggagttagcactaacgttggagagaaaagtctacacacaggacacgttaaaatacgatgcagtttatgtatacttaccaaaaagagaatgcgaagtgctttgaaagtgtggagcaacgacacatgtgtaaactggcactatgggaagatattctggaggaaagaaaacttgagtcttggcaagccctcaggatttgaacaggttgagagaaatggggataattttacaggcagggaaagccacaggatttgaaagcctgaagatgggggtagggaatgcttctggtggagtcagaagtagcttttacagtggattgcactgcggagaagtgggaaagaaagttgggagtcaggtaacgaggacttttgaatggtagtcgtttacttattcatgcaaataatgtgtactgaatacatgctgtatgcaggtacagtgctgatggtagggtttagaaaattgtctttatagagcttacaggcaagcagaggggatggattttaaaaatcaagcaagcgtgaaatgtgctttgaaggaataacagtggtatgaaagagtgtagtaggggcatgtgtattatggaagattttaaaaaggcattgctaagaatatgactttttaaagattaaaacaattttatttatattcttcataccctctcgctctgagagggtatgacttttgacctgagatctgaaaagagactgaaaagggaatgtgaaggtgtgagtgaaaagaacattccaggcctggcagggtggctcgtgactataatcccaacattttgggaggctgaggtgggaggattgcctgaggccaggagttcaggaccagcctgggcaacatagtgagaccaccgtctctaccaaaaataaaaaaataactagctgggagtggtggtgtgtgcttgtagtcctagctgctcgggaggctgaggcgagaggatcatttgagcccagtagttcgaggctgcagtgagctgtgatcatgccactgcactccctcctgggaaacagagctagaccctgtctctgaaaaacgaaaaaggaacatttcaggctgaagcaacagcgtatgtcaaggccctgaaatgtgaagaggaagaaagcttttcagcctttttgaaaggctagcatggctgaaacggggagggagagaggcaggtggagaaagctggggtcacgccaagcagagcttttattctaaaaacagagggaagccagtgaagattacaggcagtggattgagacaggttgtggctttttttttttttttttggtgggggggagataatgtggagggtggcaaaagtgaatgaggggagacccgctcaggggaacattgttgtaatccactgaaggatttgaagacaagataccttctctctccactgaggacttcagaatgtttaactgtattcacttttagagggttcaggacttggggaagggaaagaatgattcgattctatttgtacccttcacagggtagtcgtaactaccctcgaggcagtcctgaagtacatagcagaggctcttttgcaaaaatttgttttggcttttcaaatttatccttttgtaaggtcatctatttcagaatatcttttattgaaatatagttacagggagggatcactttcatatttattttgttctcacagttctttgaaagacagtggatgaaaatgctattcattgtatagatgggaacctggagctagagaaacacgtaaagtgatttggctgagtccggagtaactgccacagttttctgactgctgatgtattcctgctgattacctacacagtactaaccacagtcacatctagagaaaagggcgagttttttgaagtgcacagtagtctttgattcagcatttttttttggggggggggaacttctccctgaagattcagcacttttgatgaactttttctagtagaacagcttcaaaggaattggcagtggtgggctatgtcttatctataatcttggatagagctgttcaatttacagttcatctggaggaaataatgaacaataaggtgaactgaaagtgctcaggttgtcaatcacagttctttggcaaaaagtgagtctcaaattatgctgaagactgagcctcagggttctgtctcagaagtcctggatctttttctcttttggtataccttgtagggactagataaaatctaaagaaacagtactcaggatctaactaaatgctgagagctagatagtgtaattcagcttttaaaacttggcacaaaatactcatttttatttttttggtatattagtcttaggagcctcatgtacattagttttttcaacctaaaaagaaacttcagggcttcaaaaatctgattttgtgattatttccacaactcacgagataataccattggccaactggaatgccaaagtaaacctttgccaaaggtctccatgtagtttacccgtccctaagcagcaagtcttcttttgaacttggttctgcttaggagtactacagttttgactgagtacctcctacttaaaattttgctcttgtacatatttaaatctgtctacaggttacatctttttcactctttgggtgtggaattatatatcatttataaattaattcatgttagatttccatttttcatcaatttttaaagacagacatagtataaacattagcatagtgcccttgggacgcttaggcagtgaaccaaggcagtctaaaatttcctattgacatgagtgattcttggaactagaaatttcaaactatattcttgatgctgaaacaaaattttttatccagcaggacatctacttctaagattataccatgtgcaaatgtactatgcgtttattgagttaaaaaaatgagccaggtaggcagtggaggagaggtgctttggttactatgcatttattgagttaaaaaatgagccaggtaggcagtggaggagaagtgctttggttacatcggggataaaagagtattaactgtatatctaaaatgtggggtgtgtgtgtgtgtgtctgtgtgagtatgtgtgtgtatttgaaaataaaatgctaggtaagtgatgttttatagaaagggatcgatggatcttctaagatattttaaacagactatcaatgaataggaagttgtaaattaaggcgtgttaacaggtggtttaactttaccatgaaaggttttccttttgaatcagcccatagtttagtgtttctatgtgggtgctattggcagtttggaggtctgtttcgcccctacccactaaatgctgattagcgatctccacattgggacaacccaaaatgctcccatacatttccagactcctcctggaggagagaggcaccatttggtgcaaaacatgcatgtggtgtcagtttatttgttggacaaatattaagatgttgaggatacagaggttaaaagtaatattttaataaactgcatataatggaattcaagtaatttaaaatctagtgtttgatgttttaatgtaactcctttagtgtaaaattactgaaactatatcctaatatttctttgaggcacttgtcttttgtaaaactgcatgaataactcaaatagagtccccttaatcccaataaaatgtagtcactaaatgtctttgggcaactaatttcaccagctgttccctcatttgcaagtgggggtggtgataacacatcttgtgagggaattaaatacaaaattgctttagtagatgcaagtgcttatcactgggcacaacatgtggtacatattcagtgatagttgttaccagtaaacagaatctcaagcttacttagggtcatgagttggagaaaactaatcttaaagtctttaagttggtgaatttcaggccaaaatacattgtattggagatatcagcaccttctagcagaatgtggtaccgtggtccagtcactattataaattgccagccatgaagaaaagggaagtcatgttttgggagccatgagtgtagattcagggaatcccctggcatggaaggaattatttgcccactgggtcactgctgagttgcctgtgcagaggaggagtctctagaagctgagaaggttttggtgattacttgcagtaatgggtgtacgacagggccctcctggccatgtctgccaattcagtagctttaccagaagttactagaaattttccaacattgtattatgtattacatccccagcccccactccacaatgtcacagtgtgtttccagtttttgtgataggtatctgtgtgaaagtaaggctttgcttttacagattgctttctaggcaaatgtggaataaaaaaattgtagttgataaaatgagtctaataaagattaaattgcctttcatatttaagtatatttatggcaagaaattatggtagttttaataggattatagagcatttatgggtattgtttccattgaaaacaaaacacggaatatttaagatttatttaagaaaggcggggctgggtgtggtggctcacgcctgtaatcccagcactttgggaagcggaggcaaagggcgggcggatcacttgatgtcaggagttcaagaccagcctggccaacatggtgaaaccctgtctctactgaaaatacaaaaaatagctgggcatggtggctcgtgcctataatcccggctactcaggaggctgaggcagaagaatcgcttaaacccaggaggcagaagttacagtgagccgagatcgcgccaatgcactccagcctgggcaacagagtgagactccgtctccaaaaaaaataaaaaggcatattttctgacagttttaaaatctcatttcgtatgaatcatggacgtattccttgaaaggtaaaatcccccttctagttactgaaaatgtttaaacaagttgtattatgagcaagcccctcccacaatcccaattaagatgcttctgtttcgaaggatagaatttttacattcaaagaggaagcagttatttttactttttatatgtatggtgttagtgatttctagggtaggatgtggcaactttttaactgagtggattgtggtaaatgtttcgcacagatcaattctgttaaaagttgatgtgcacatttggaaggctatgtgatatttcactgatagctgaggtatgccttcttgtgcttcttaaaataagctgctttagtaaacttggtattttcaagtactgaaaaggaagttgttttgcatggagaccaccttctaggcttaatttattgtgaaatttaatttactgtgaaaggtgattgcatttcagagaccacggtttggttttcttgaaagcattgaaatcagttaagtgtcggagcacttagtggagtgcggtactgttttctgtggttgcccctatcttgggtcaatcccataccttccattcacagaagcagtgccagcagatgtcttgttcaggcttataaccaaccccccctcaccttttatgttgtaatagttattgttttattgtctttatatgcaaatcaattgtggtaggaaaataatccatagccttcaaactctcagaagtgggagataaagtaaataaaattaacagtcccatagctttggatctagggttttttttttttctcctttcctcccacttttttcccttccatgttgaaaaataattgttacttttttttttaagcagcacacttattgcagtcagacaaaatagaagtgccttcagaattgactagtgtttcccttgtgcctccctatgttcttcagtgtttttttctgtcttgacatctacatgaagtcttcctcccaccctccctgcacacacacagacctgcctgctcgtaagacctgccaccctctcccacccccaattgtaagctccatgaggacagggtctacattttgtttgttttgtttctcagagtctattacagttttgggaacttaagtacccaaaatattttgtgagatgaataagagctttaattgagaacagttacagtcagatgagatgtgtgacaaaacataaaatagatgtctgcctaatgctgttaatgacatgagtgtaagtagacatgtgggagaagtagtgggattatagtaacaggtttggtgcatggatggacttagttgggaaaatcattttgttaagggaggcttgggttggcttaaactggaagagagaaatttgttttgtgcgaaacgagcaaaggcagggtaggaaagggaaggaggcctgaggtcaagatggataaagagagctcaggaggaatgcgaggataaggcagaaaaactcagacagggatgctagtagtgatgacagtgaagattggcagatttgagttttgtttccaagaaagaagcaggactaggggtgtctgttttggtgagttgttcagccttctgtccatagccttcaagagtattgccatttcttgtaacattaaatatactgtataatcatagaaatgcctgtcttgttacagtggttctgaaatttgggtgaattacctgagggacttaaaataggaaaaaagaatcctgggcctcacctagtataggttcaggtagtgagtataggagcagaagaggatcctggatattgtaatccaatcctctcattttacaagtgaagacatttatgcagacaattatatgcagaactgggattagattccaagtcttcatatcctcagcgcagtgctctggcgattacattgtgcttcctgaaattgacatttgggttttctttgactatgattcccagtgaggtaaaagggccgtttaccaactttgatcacatcttcagaagtagctacaattaaccagctttgcccttctcttttgtatgaactccagggctctttgttatgatgccatttaatggtctctaaacttttcagtgttttcaaatatgaggatactgccctaataaggatgcggtgggacatttttttgtttgtgtttacatgtaataatttattatttaaaaattaggaaaaaaatatacagaaaggatgaaaacaaacattcataatcactcccaagagataattgttgacagtttttttttttataatttaatgtttatacctatgcatatccttattttctttcttaagatcggcatagctaggccaaaggatatgcacattttgtgggttttgataaatattgccaaattgtgttccagaaattgtctatcttttgttctttcttccttccttccttcttttctctctctctctcttctttttttttttcaagaccctctgtcacccaggctggagtgagaggcgtgatcttggctcactgcaacctctgcctcctgggttcaagcgattctcttgcctcagcctcccaagtagctgagattacagatgcgtgccaccgtgtcttgctaatttttgtatttagtagagaaggggtttcaccctgttgcccaggctggtcttgaattcctgacctcaggtgatccacccgcctcagcctcccaaagtgttgggattacaggcatgagccactgcacccagcccatctgttgtttctcatctgcagaattttcttgggctcccatgtgatgtgtaattattttagattattttagaaatagatgatgtagtatatctaagatatattttagatattttattaatgatgacaaattgttacagctgtattcatgctttattttatttaaaaaaaattttttttttttgagatggagtcttgctttgtcgcccaggctggagtgcagtggcacaatctcggctcaccgcaacctctgcctcccgggttcaagtgattctcccacctcagcttcctgagtagctgggactataggcatgcaccaccatgcccagctgatttttgtatttttagtagagacagggttttactatgttggccgtggctggtcttgaactcctgagctcaagtgatccacctgtcttggcctcccaaagtgctgggattaaaggtgtgaagccacttcacctagcctattaatgcttttaaataaattcatgttttacttatcaagatagcacgccatacatttgcaaattaatggcacataagtgaatgttggagacatttattcaagctgcagctgttttttttttttaaacaaaaatgaacatttttccttgttagtacaaaagcaatacatgttcattgtgttccatttttcacaaacacagtagtactccagtcttttagcctagatttggtaaatttttggcatttattgttgtcagtcctgttttctgttaaatgttaaaacatggggctgagagaggctgtgaggttgtggctgaatccctgcatagaaacaatcagaacaattagaaaaaccgaacactcgtgaataatacatacaacaaaaccagatgagacttcagtttttgtctgcgatggagtaactggtaccatatttgctttcccaccataaacaattacaaatctggacaagatatattaaaaaactgcttccagacatcggacaataggcagtacaggagctgagcgaaaggaaatgagctgtgtaattcctcctgctttttcctgtagacactctctgcaccgtgttttaggaagggaacacccgtgcagagcatcttggtcttgctgagtcgaggagactggacttggggaaggtttatctggctggaatttgcaggtgggattgacagagagagggagctaggcagagaaataaacaccagaaacttatggggggggtctctgcaggagatctaacaaagaatgaccagagagctttaaactgaagaattgccagagcttatggtgctgggaggcatttgaattctgaccagatatgggagagagaacttattgaatacctgggacattcaatagaatccccaaaaggttagaccttagtatcagagactaagttagccctagagtaaggccttagatctatcctaacaatgtttgaaaacaagccttgggtggatcaagctgatcctcccctaacttacctgcccaccacaacaaagtacaacactcttaaaaggaagacagcaaagtccagtgatacacagtgcagcatttttacaaatatgctcagtgttttaacagaaaacatgaacataatgaggaaagaaatggaagatattttaaaaatggaacttaaagcagaaaaatacataagaagtgaaatattcactggtgagaagaataacagattagatactccaaagaaaaggtcagcaaactacaagatacagcaagagactgtgttagtcttatttgttgccataaaggaatctgtgagactgggtaatttataaagaaaagaggtttttttggcttacagttctgtaggctgtgcaagcatggcatccggatctcagcttctcatgaggcttcaggaagctcttgagtcatggcagaggggaaggggagcaggagtgtcacatggtgagagaaggagcaagagtcagggggaaggtaacagtcagatctcatgataacttcttactatggggagggcattctctttttaacaatcagatttcaaggtaacgttactacagggagggcaccaagccgtttatgagggatctgccccatgacccagacacctcccaccaggccccagctccaacattggggtttattcaacatgagatctggggaggacagacatccaaactatatcactatccaaagtaaaacacagtgagaaaaacaactgagaaaaatgaatgaaagctcagtgacctgtggagcagtatcaagtggtttaacatacatgtgatcttgtttcaaaagaaggaagtgaaggcaaaaaaaattgaggaaaaataatggctgaaaacatttcaaatttgatgaaaactatgaatggatccaagaaactcaacaaactcgaagcagagtaaatacttgtgaccttgggataggcaggtttttcacatgctacagaaagcatatattgtaaaaaaaaacaaaaaacaaaaaacaaaaaaaacccaaaaactgataaatcggacattggcagaattgcaaacttcttttcaaaagcatcattaagtcaagccacagaatgagagaaaatatgtaaatatgtatatatatttcacaaggaaattgtgtcaagatcatataaaaattttgtgcaactcaataagtgaatccagttttttaaaaactgggcaaaagacttgaatagaaaatatacaaatggcaaataacatgaagagctcctgaacttcattagtccgcatggaaatgcatcatggaaatgcaacataaccctgcaacccactggaatggctaaaaatgaaaaggccaagaacactaagtgttggtggagcatctggaggctgaatactttgctaataggagtataaaatgttatatatctgctttggaaaacagtttgtcagtctcccctctcctcccctccccttcctttttttctttttctttttcttttctttctttcctcactctgctgtccaggctggagtgcagtggcatggctcactgcaacctccaccttttgggttcaagcaattcttgtgcctcagcctcatatgtagctgggattacaggcctgcaccaccgcacctggctaatttttgtaattttagtagagacagggtttcagcatgttggctagactggtttcgaactcctggcctcaagtgatccacctgcctcagcctcccaaagtgttgggattacaggtgtgagccaccacacctggccaatttcttataaaggtaaatatacattgatcattcaacttagaaattctacttttagaattttttatccaagagaaaaatatatcttcacaaaaagctttgtagaggaatgttcatagaatctctattcttagtggtcccaaaccagtagtaacaatccaaatgttcatcaactggtgaatgtatgaacagactatagtagatgtatgtggtagaatactaagtaataaaacagattgaactactaatacatacaacacggacagatatcaaagacttgctgagcaaaagccaggtacaaaagagtatctaatgcatgcttccatttacaaggaaattctagatcaggcaaaactaatctatagtaacagaaagcagaccaacatttgcccagggctggcagtgagatagggattgactggactgagtgtgagggaaggtttggggatgatagaagtgtccttaatcttggttttgacagtgctcacacaggtgtatacatttgtcaaaaactcatcaaactcttacaatgggtgcatttaattctatataaattatattttaataaagttgattttatagaaaaaacgggaagtgagggaagctaaccaactataatccaggtgcttgatgttatctcatttaatcctcacagtaatttttattgaagaatattcagcaaatatcttctgagattctaccatgctggtctctgtgccaggtactgaggataaagtggtgagcaaaaactatcatgatttccacttaccgtcctgggcagtttatttgaaagacagatactagtaaaaagtgctcccccacccccagagaaatactacaaagaaggttctatgagagcatataatacattcatccttaacatataatatatgctgtcatatgatatataatgagacacatactacataatataccttgtataatatataagatgctttatgtgccctggtttctttgtaactactacccctctaatggggtttctctaactactaagtgagttaatacacgtgaagtgttttgacttgtgctagtagataggaagtgcccagtaagtgttggctgctatgaacatttgacagttctaattgtctaatactgcaggggtacacctatactaactcagggaacagtggagtaggactacatattggggaagagatgataagtttgactagaagtgttgggttttagctgcttttgagacattcaggtggaaaatgtcttgtagtcagatgtggatactggttgagtacaactctagatgctgcagagggccctgggctggagacatacatttcagaaagtgtccagcatctagactagaattgcctcaactgtagagatcatcatcaagaaaggtgctatacacacacattcacacacacgcagaaagagaagaaggacatagacctggatctgagccttgagaaactacgatttaatcagggtgcctttttgatcatcatctcctctgtttagcatatgattttgctacatttaggcctgacttccttcgtattcaagataaaataaagggaaataattacgagtaaaaacaagcagtggagaaggtggtgtcaggttcttggcaagttgataacaaatggccactaattttgacaatttgtttccttgcagctgagagaaaaagggaaatatgtttagcaatatggattccattttccgatgaataaagacatacatattcatctgcaaagataaattttgtttgaaactaaacttaaattgttcttaaatttcaaggataatttttttttttttttttgagatgaagtcttggtctgtcacccaggctagggtgcagtggctccatcttggctcactgcaacctttgcctccagggttcaagtgattctcttgcctcagcctcccgagtagctgggattacaggcgcatgccaccatgcctggctaatttttttgtatttttagtaaagacatggttttgtcatgttgggcaggcaggtcttgaactcttgatctcaggtgatctgcctgcctcagcctcccaaagtgctgggattacaggtgtgagccactgtgcctggcctcaaggagaaatttttttacctgacttgtgtaagtgacaagttgagagcggtcatagtttaaaaatggaaaaaacagattttgcaaaatacttatgatgttaactgtcataggaagttgttacattcctccttaggtacttaagtagcttgtctttcctgttaggctctttacttagagttagtttgctttgacgaggggtagaagaactgaggccatggctttgcctgaagtacagataggttctttatcaaaccctcttttttatatttttgactttattcacccttgacataaaagacaaaggcttacttaggaacctgcaactctaccaatttttaatttttactgtaaaataagggttttctggaagactaaaaaacacttttaaaaaacatgattttttttgcgtttatctctaaatcagacgttttgattggttccatcattgttgtatttgaatttgaattttatttattaattcaacaggcatttattaagtccctgctattgccaggaatttagtgtattctggctctcagggtttcacagagaagaagatatgattctagctcttcaggatttctcagtaaggtggagaggaaaatatgttataaaaatgagggagaatacgatgagtgcgtagtaggggcatttataaagtataagtaagcaaaggatatttctcatctgggatacgggggagagtcttgggaggtaggatggggtggggcagcagctaatacaatcatccgcaggaagggcggccgcatggaaaggggaaggtctaggtacattattttattcatactttccaacagctgggtgaaaagatgtgtcgtgttcccactttacagatgaggaaactagtaagggggtagagtcagagttttaactgttgcaggactccaaagtttgtgttccttcctccatgatctggcaggtccatcgaatctctagtatctgatctctagtctcaaagtatactttgaatctcgaattttgtgtgtgtgtcctttcgtttggaggaatcgttgttccttctagaaggtaggatagttttggatgctgggtgatgctactttagaaattgtgatgatcctggacgaagggaacaaggaaaggaagcttggatccctttatcagaattcactggaccaacagggtgccctgagcctggaaccaaacagggtgaaggtgttgaagcttacatgtggatttctcttcaaataggagagcccaggtgcaccagagcacagaacatcttttctcctagtgtgacacaatagagagaacatggtctttagagtcaaacacaactaaatttgaaccccatctgccagtcgtgcagccttgggtaaactactaacctctctgtgtattactgcctatctcatgggttgtagtgagaatggaataaaatgatgtatgagaagtgaaaagcacaacatcagacttagaaggcaccttttccttcctttcctcctcatcttccaacacctaggctctagggaggtctcagttaaaagctagaattatgagcacagtggctcacacttgtaatctcaacactttgggaggctaaggcaggaggattgcttgaggctgggagtttgagaccaacctgaacaacatatcaagactccatctctacaaaaaataaattttttaaaagctaaattagagaacttctatcatatttttagactgtagttttgatcagaatttatcatgacattatttcctttgatcctaataaaagctcagtgaagtagatagggcaggtattatttatagatgagaaatggggtcctctttcctattccttgaaatcctttggaagcctgttagaagaaaagattttctggaactctaagtagtatgatagtgacatctactgtaatagcttgtattattacaatctttgaggaagctgcagtttagataatttagcacaatcatcaggaagaatttaacagttgattttattacctgccattttggggggagaggaggtataaaaatgtatcctttgatatactaacagaaaaccacttgcataaaattattataataaaatctcaatttttccagaaaccacgatcgcttagatctggattacaaaaagaggtttaaagatgctattagattttctaataactgaaaatgttaaagttcgagacagtttgtgctaaaaaagctagattcgctaagtgcgagagtattaactggaagcaaccggcgataggtggtgatgtgatccaggtgttgtgaagaacagagacaggatgacaagaaggcaggatataggtccacgagatttcagcagggatttatttttaaaagcaacttcttgagataggttctggagttagtacaggtgtagcctgaactcccacacttgcaacattatgcagttagattgttggacatattgacccccgaaatacttttttaaatttattttttaaaaataaaaataattaaaaaaaaagagagacagggtctcgctatgttgaccaggctgatcttgaactccagagctcaagtgatcctcctgcctcaggatccaaaaatacttttaaaataaatcccaaactctaaaagcattgtctgcaatgtattatacttggtcataagaagatataaacaaactagtaagcatttctactaggtgtaaaacaaaaaggttgtactttgaggattaatttggtatctagattattctctgaatatccattttaaagttcactaaaattttatttttaataaatttgccatgcaatgttatgttttaacttgtaaattaaatacattctcataaaaattttaaaaatatttagttttgaagtatttcagatatacagaaaaatgttaaatattgccaattatgtcatccatgcagatttagcaagtatgaatattttgctctatttgcctgattttttaaatgaaatcttacctacaaaactaaagctcctttctcctatgcatattttagtattttctgtaagtatatataactctgaacactatatactattatgtgtttttcagttgtggaaatagaaactcttactctgctggcaggaacttaagttggtaggggctttggagaacaatttggcaatacccaaaagagttggcagtggtctgtgtcagttgtctcatgctgcacaacaaactaccccaaacttagtggcttaaaacagtgatttcttatttctcctaattctgtgagttgctggggtagtccctctgcttgttttgcctggactcattgatgcagccgcattcagctgggagattggctgggctggagggctcaaaatggcctcagtcacatgtctggtggttcatgctggttgttggttctctacatgtggccttatcacttgcaatagacttccttatgtggtagtctgagggcagtggtccaagacgcaaggcctcttgaggtctgagccctgaactcgcatagtgtggcttccatgcgttttgttggtcaaaccaagtcacaaggccagctccaccttttgatggaaggagtggcaaagtcacactgcataggagcatggaaagacatctcgcctccatctttgaagacatatcctgtaattcagctattttacttttatctatcccagaaaaaatctttcacagatagagagatatgtacacattgttcacagcagaattgtttataatagcaaaaaagtaaaaacaatttaagtcattccaggaagaagcagataataaattttagtttattcatataatggaataccatatatcaattaaaattaatgatcactggataattctaaaaataggttgaatgaaaaaatcagattggaaaagaatatgatagtataatagccttaaagttcaatatttgaagtttcttgggtaggctaatgaagattttgcttttgcttctgttttgaaatcaaaacttatctttggatggcctcattagagcatggtgcttatgagtagcttccatccttggatggccagttaagctgtgctgttctctgaccagacgggctgtcactaaaaagcttgtgtttagcttgttggccatttgggaaagtgtagctctttcatttgagaaggtgtaggtagagctgataaaggtttaacttcatcagtaatgttagaaaagtccatatacagtacagtttcttttttaaaattttttttctagaatatagtttcttaacattcatttaataccactgtctgcatctgtaccaggtttaacctgcatttcttatctgtaaatgggaagcatgatatttacctcgtagaggtgttgggaagatgaattgagataataatgcatttaaagcagtaccttttatatggtagatcctctataaacagtagttagaaaaattaacaagtatataggatggcatctatgttaagttcactttcaatggtattgtagtgagtaggtagcattgattacctactcataggtactttaagtaggtactttaattaaattttaggactactgtaattatgaaagtccattattaactataatactttacattttaaaggaaatttacatttataaactcttttcacattaattatctgattttgttctcaggacaactttgtaagatagttatattcaatttagagacattgaatattagtttcaggagaggttaaataagcagtgttagcagaaagcttatgttggttctcatgaaggcagattaaaatggaaataatgataccataatactttgatttttatcatttgtgtttatgtgctttacctacctagattctgaatagatttgtctctgtacttttttcccccttctgtgtgtgtgggaaggggaaggaggaggaggaggaaaagagattatagaagagggttaggtgaatcttaatgggactctttggaaagggagaactgcagcctgcctctcagatccaaaaatgttatattaacgccaccctctcagctccctatattttaaaatagccaagcagattggcaagattttttttttttcagatttgtaaatgttcgatggcaactaagtctatgcatcaaagatttgaggagatttctctaggttgactatggattagaattaaccaccaaatttactagccatgtaggatttgctaagccaatgtgacaaatttatttggtgacttctgtttataaatgcattgattcaattaaattctttctccaagataaaagttatgctttttttttctttttttaaatttcctattttggttgtatgctttaaaagtttgagataggttgggtgtggtggatcacttgaggccaggagttcaagaccagcctggctaacatggcaaaaacctgtctctactaaaaatacaaaaattagctgggtgtgatggtgcatggctgtaatcccagctactcaggaggctgaggcacaaaaatcgcttgaacctgggaggcggaggttgcagtgagctgagattatgccactgtactccagcctgggcgacagagtgagacactgtctcaaaaaaaaaaaaaagtttaagataaacctataaatttgtaactctccagctttgttggttgaaggaaactattggtggctggtattttgggtaatctcacttcttggctaactcccgttaaggatgttttataatgaaaaaaagtaggtacttcacatattaggtttttatcacctcactttcctagtatcataaataaatcgttttttcaccatttgtgtagatttatttcgaggtaggtaaatttcactttgcttgagatcctatgccaacattagattagttttgaaacaggttatatgttataacttctcctatgattctgaaacactttagaaacaaatgattttaaatgtgattttttttatttgttttacatttcagaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttaaaggtgaagctgcactgtgcaaaattatatatgagttcatcatccaggggagggccagttctctcttttagtggaaatgagatacccaggttccttccaaagaaaacctcctctccagccattggcatgatttaaaatgtgtcttctttgaaattttagaagtaaactaccaaattgaaataatgtctctctacttaggctttttgtgctcttctaaattgcaatgaaaaatcttatgaaaatgtttgatgtgttacattcacaaatatgattttcagaaattaaaactcttagtaatatatattcttaaatatcatagtgaagtttttgttagtaaatttatattatgctgattcttacattgtaaatgtgttaccatggcacctacttaatcacacttggcaaatctaacccagttatttaatccggttaatctatgtaagattcactcttatcaaagatcagtcatctagcagcctcaaagtaaagcaggtgtccagtaatcagttgatggaacatttgtaaagaatggaaaagatcatgatactgacattttgctggttaactgaatgagggagtcgtaggcagcattcatttaagaaatatttaaaatgactgattcttggtggggcatcatggctcacacctgtaaacctagcactttgggaggctgaggtgggcggatcacttgaggtcaggagtttgagaccagcatggccaacatggtgaaacccagtctctactaaaaatacaaaaattagccaggcatgttggtgggcacctgtaatcccagctacttgggaggctgaggcaagagaatcgcttgaatctaggaggtggaggttgcagtgagccaagatcataccactgcactccagcctgggagacagagtgagactccgtctcaaaaatataaataataaatgcaataaaatgaccgatttttaatatttttggagttacggatacctttgagacaagatgtttcctccaaaacgtactcacttatgcacagttttgcatgcaaatttaattacagaccctctagcgcacatccgtggacctcctacttaagagcctgtgttgtaaactaagacttcaaatgatccagtgtcattgaatagtacaagcacagacctgtctttgaggagtcttcaagtcttaagtggtgcttataaccatgaattaaaggattatcttgtacatataaatagctttgaaatgtctggcaaacatcttttaactgtacttacacattatgaaataaaatagggagaatttaagatttgtgagaactttaggtcaagatgaatcatcttgttttttttttttaaaaaagcatgccacctaaataacaatatattttccttttaggttggcacgttggatgtcttggttggcttgtcagatgaactggctaaactggatgcatttgtagaagggtaatgtacttatatgcatggagtagagcaaaatgggagacactattatcaggcttcatggacactgggtttattatcacatgtatactctgcttattggaatggttttagaaaacgacttttttcccttcgtatatcaattttatgaaggtacaatttacataaaatgcacctgtttgaaatatgaaaatgctgattctctttttactatctttaatgggatatagtttacatgccatgcatttcacctatttcaggtgtacaattcagtgattcttagtgtattcagacttgtgtaaccattgccacaatcagttttaaatatttcatcatcctctattcctgttcccattagcagtcacttaccgtccccaccacccacaaattgttctgccactatagatttgcttggtctggacatttcttgtaaatggaatacaatacgtggtcttttgtgactgtcttcttttgcttagcataatgttttgaagtttatcccagcagttgcatgtatcagtatttcatttctttttattactaatattccactatatatgtatacatatatatcacattaatccgttcatcagttgatgggcgtttattttgtttccactttttggcttataagaataatgctgctgtgcatatttgtgtagaagtttgtgttcttaaatgttttcatttttcttgggtatgtacctaagagtggaatttctgggtcatatggtaactctatgctttgctttttgaggaactgacaaactgtttcccagagtggctgtaccgtgtaatattcccgccggcagtgtatgaagattctcatttctctacatccttgccagcacttgttattatttttattatttgtctttttgattatagccatcccagggggtatgagataatatctttgttttttttgttttttttgagacggagtctcgctctgtcgcccaggctggagtgcagtggcatgatctcgtctcactgcaacctccacctcctgggttcaagcaattctcctccctcagcctcctgagtagctgggattacaggcacccgccaccacgcccagctaatttttttttttttttgtatttttagtagagacggggtttcaccatgttggtcaggctgatctcaaacccctgacctcgtgatccacccaccttggcctcccaaagtgctgggattacaggcgtgagccaccgcgcccggctgataatatctcatttttaaaaatttgtgtttccctgttggctgatgtgatgtgatgtgttgagtatcttttcatgtgtttttttgccatttgtttttcttccttggagaaatgtctattcagatcctttgcccatttttaattggctagcctttttattattgaattgtagaagttctttatacagaatatgcaagagataaatcccctatcagatataacttgcaaatattttctcctgttctgtgagttgtcttcattttctttttttcttcttgagacagagtctcgctctgttgcccaggctggaatgcagtggccagatgttggctcactgcagcctccgcctcctgggttcaaatgattctcctgcctcagcctcccgagtagctgagattacaggtccctgccacaatgcgcagctagtttttgtatttttaatagagatggggtttcaccatgttggacaggctggtctcgaactcctgacatgatgcgcgtgcctcagcctcccaaagtgctgggattacaggcgtgagccaccgcgcctggccatgtcttcgttttcttgattgtatctgtgaagcacaaaagttttaaattttgatgaagtccaatttatttttttcttttgttgcttgtgtttttggcatcatatctaagacaccattgtctaatccagggttgtaatgttttatgtctatgttttcttctaagagatttatagttttagctttcacagtgaggtctttgattcattttgagttaagttttatgtatgttgtgaggtaagggtccaacttgattcttttggatgtgaatatctggttgtcccagcaccatttgttgaaaagactgttttttcccctttgaattgtcctggcacccttactgaaaatcaattgaacataaatatgagggtttatttctggactctcagttctgtttcactgatctatgtttctctcctatgccagtaccacattgtcttgattattgtaactttgtagtaagttttaaaatcagaaagtgtgaattctccaactttttttttttttttttcaagattggccattctgggttctttgtctttttgtatgaattttaggatcacagtgtcaaatttctgcaaataagtcagctggaattttgatgaggatagtgttgaatctatgtatcagttggggagtagtatcatcctaatattattgtctttatccatgaacatcggatgttactccatttatttgaagatggttatgcttttgtcttcaaaattcagttggaagagtttttctaaattgcagtttttattacttttgaaattcaggtacatgtgtatttgagctgaaaatggttataggctctttgataactgcattttgattagttggcagaatcagtctacagttccttcaactctggggatacaaagattttattttagagtttagatacacaggtgtaatttgtaaagtacagaatttggagactctcagaaatgtacatttgattgaagctttaagggaataataggcttggatagaagggaattttttcttgaaatctatccagaagattttctcatttctgctgttaaaatgcttttctgaattgatagaaccacctgaaagcgatgctgtggcaatagagactgaggtcagggttacagagagagagagagatcttttaatataacaccatgtagtgaggaagtaaacagatctaaggatgtattgatgttctttaatattggagtcaagaaggccacttagcagtttcacagtaggttagttaagagatagtaaaagctcagttgggaccagacacttggctcttagaatggaaagagaagatgaaaggaaaagcaacttttaggattataattccatatattcatatagagcaaattattattatgaattattataaatatagtgaaaataattatgatgcactcaaagcactaactgatggaaagaatagtctcttggttccttgcttatacatttttaattaagaaaaaaatgggccgggcatggtggctcacgcctgtaatcccagcactttgggaggccaaggtgggcggatcatgaggtcaggaaattgagaccatcctggctaacacgatgaaaccccgtctctactaaaaatacaaaaaattatccaggtgtggtggcgggcgcctgtagtcccagctactcgggaggctgaggcaggagaatggtgtgaactcgggaggcggagcttgcagtgagctgaggtagcgccactgcactccagcctgggtgacagagcgtgactccgtttcaaaaaaaaaagaaaagaaaaaaatgtaagggaacttttttttttagttgtcatcccctggagtnnnnnnnnnnnnnnnnnnnnttccctgaggtctcatctacctcattacagttacaagttatgacaaccaaagagacactgagaaaggaggtccctgagaatataattattaacatttatttatacccttattagtcaccttgatggctttatagttctttatctttaaattgttaatgggatgtcctgaatataatttaaagtttgctcagattttaaattttatttatttttttttcagagacagggtcttggtgtcacccaggctagagtgcagtggtgcaatcatagctcattgcatcctggaactcctgggctcaagcagtccttttacctcagtttcctgagtagctaggactataggcttgcaccaccacacccagctaatttttttatttttatttttgtggacatggagtcttgctatgttgcccaggctggtctcaaactcttggcctcaagcgatcctcccacctcagcctcccaaaatgctgagatttcaggcatgagtcactgtgcctagccagctcagattttttagggaaggaatctgaaaagtattaaggacaaatgtagttagtttggtgagtagaatttaaagttacctaggcagtgtgtcagctgttcttttcttcattgttcggcaagcacatcttcttcagtcctcctgaatgataagaggaatttaaaaatcatgtcgttgttagactttggtagtattgacagatgatagcttaatgacttaaatgctccaagtgttaaaggccaaatattgtagaatatggtatatgtggtaaatcatagtttgtactttcttaaaaatgtaatcattagagcagatatttttgaggtgacattgtgtacattgacacagatcctcttgtaaataggcatacggagatcttgaagttctgggttatgcaacattacgtttataaatttgacaccaggtgattctacactctgaagtacttctatgggtaaacatgcaacattttagaatgttcgtagcaaatggttctgtttacaagatgcttgccaaattttatgagaatgatttgtcccttttgaaggaatgggtgaattttggagacataggcaagtatatgtataaacctcaagttaaacatgttgaagatttaggacttacatcattatttctgaaattgttctgatttttaggtttgagaccactcagcataggattgtcatttaaatttagctcttctgtcacctttcctggctcatattggctcttgtttaaactgttaacaagccaggcttgtggctcacacctgtaatccctcctgcttgaggggccaaggcaagaggatcgcttgagcccagatgttcaaagctgcaatgcactgtgattgcaccactgcattccaacatgggcagtagagtgagactctctcttaaaaaaaaaaaaaaatgcgcgcgcacacacacacacacacacacacacacacacacattttttttttaaggaaaaaaaaccattacaggaatttcttaatttgtcttccagtttcccctcctagctgttgagcatgtagtcatcagaatacttgtcctgagccctgtttcgactgtgttatgtccctgtctagagtgtggcttcagaggctgtgtatctgcaatctggcatcccactttcctagcctaagctcccctacttctcggcctgctgcttccatcagtctggacttctcaccattctctggatgcctactgcttttccacctcttatcatgactcataatatgccccatggcaacgatatgctttcttcccatgtaatcatccttgtaaaaccatttctgtccttcatcgccctactcatgagcctttgggctttcttgattgggtagctgctagtgatccctttttcctttctctctctctgtctgcaacctggcaatctcagctggcactgacctcagattgctttgtatttagtaatttatatatttttggatctttccaatgagattttaagcaatgtgtgaaggtagtgattttgtcttgtatgattttgaatcccacccagggcctagaggcagacatggaataaggaagagaacgctggactccaaagtcaggacaacatgtttctagtcacagctctgccgttaactggtcttgtgactttgaataagccacttattcttttatacctcagtgtcttataaatgaaagaactgacaaggtcatatgtaggtgacttggtttaggttggtgcaaaagtaatggagtttttgccatttttttcccccctaaagtaatggccagaaccacagttacttttgcaccaacctaatagttttggcattatggcttcctctatagcatagctccttgtaaatagtagatgctcaataaacagttaatgaattaataatgtaggacttagtttttcatcatgactattgcttacgttctcttgcctgtcaggtccctttcttcctaagggaaagcacagtgtcttgcatgtcataggaacatagtgaatgctagttctcagcctcctcctttgttctcagtccttaaattgtctagtttcttggcatataaatatatggctatttacagactctttctcactagcttcccatgacttactttctagactaggagacacattgcatgtagtctccttaaaaccctacagttactctgttgatttttgcatgtaacaaagtcttggtccattttatccttaaaacattataaggtaagatccatttattgtgtattatatggataggtataatgggaacatatagtcaaattcatgtctttatgtaatatgttcattgtatagaatggaatttagatctttttcctgagaatggttgttgatattttttcttccccagagtggttaagaaagtagctcaatacatggctgatgtattggaagatagcaaagacaaagttcaagagaatctgttggctaatggaggtaagctaatgctcatgattgatcattattaactcatacaaagcaaataactaagctacagaaacaaaaagtaatgtaaaaaagtctacagaaaaggacactaaatacaatagaaagccattaaaatacaattattattactgaatttggtgatacttccaggtacatcctgttccctgaaacataatctcatagaagacagtcttacataatatgtaatatagcttataatatgatgccaagtctcctgcaagagcagtattgtaaaggtttgtcttagttctttccaggttctatttattcactcatttacaagtaagtttccaagttgtatatctcagcattgttccagttgaatacctgctgtcttatgtaggtttttgtatttaatagtatgtaactgttaaagctttagaacagaaattattaattttattgcagaatagtgccccctcagtatgattttggcatttctttacttaatacccgtaaaatagcctactgacttctctgtagctagaagccagtatttacatagagtttgctctatgtagtaatgactttagaaagatgattctgaccccattgttgtcatttgtacttgcatttcttgttttcttatgaaatgtcattttagcattttgcttcatttaaaatcagcccatctctagtgatacgtttttataacaggaaataatgagctgggcatggtggctcatgcctgtaatcccagcacattgggaggctgtggcaggaggatctcttgagtgcaggagttcaagacaagcctggacaacatagggagaccctgtctctaaaaaacccaaacaaaaataaagaaaaagaaaaaagttacctggaagtagtggcatatgcctgtagtctcagctagtcaggaggctgaggaggggggattgcttgagcccaggagttcaaggctgcagtgagctacgattgtaccactgtactctagtctgggtgacagagcaagaccctgtctcaaaaaaaaaaggaagaaggatataaccctttataaccttttcctttcattctctacaggatcacctactctaataaggttactatattttaaatccagtgttcctgaaatctcatttcttcttgcaaataatagctgctcaataaatttttaatcagttaaaaatgtagtaacttattcttgctctttgttatcaagtaattctgatctcattgtttgctgtgtctgttaatttgtgttttgagaaacaacgaaggtatgttagatattaataagttaatttgtgttgcctttactgatcttctacgtattttatgaactagggcagtcagtctagtaggtggaatggtggttgaccaagaggggcagtgcatctagatagagttgcttttggaaataccatccgtgttgttgactgactggtattatgtaaggagatattgagaagagaaagatatttttatatgaattacttccgtcagttggcgctgccataattaccatttggtttcaccgttcttgatccctttaggggtgaagtcactttgactactaaacttccaaggaataagttgttgagtatttttttagctctacatgttttattctttccatttgaaagtgaaagggtccatgttttgaaaattgttaaaatgtggactcctggaaacaatcatcacatggttttaacagacaagtttattttcagtttgtttgggtaagttatcaaagaaagaacatacttttatgaaattctacttattgaggagataatttgaagtagtttcttaatctttatgtctcctacatatgaggcatattaggaatatgtacatatttcatttttaaagtaatcaaattagaaggagcatcttaatatgtattaaagtttgagtaaggagaagagattacaaggtagaaattttgattaatccatgttacttaatatagttcacatttaatcaggattcttcagaaatgacatctttgctgatttcctcaatgccaatttcagcattaaaatatatcgctgtgtaaaaaactgaacaattctattgtttttcttcagtaattaatttattcccttatttcagtggacttggttacttatataacaaggttccagtgggacatggccaaatatccaatcaagcagtccctgaaaaatatttctgaaataattgccaaggtaagataatacttgagacaagtaggacacattgatttgtagtggctttgcttattttataatttcactatgaaatactttttaggttttgataaggcaacttaattatatttcacagaagaaatccttacaacttagacattaaaagatgttaaaaagtataacactttaatgtgtagattatctaagttgaatacttagttatgtaattaacttaaatattacatcaacagtgtttaagaaagtgtgaaaattctgtatttatacaaattttaagggtacccaagattgtgtagaataggaaattggagtctattaagatttcttagtcattcaggtaggtgatagtagtcactgaagtatgtttatgtgcatacaatacttgttcaaacattaaactctatggattctctgaccccttcggactatttagttttgatcctctgcctggaaaaattcccgtattcgtgtgccacataattttatgtagtttcagggagtacatggaccttgaagccgatgcatgaacccaccaagttaagagctccttttatattgagaaatccttgaacttgaaaggaaatcctagaacttgagaggaaaaaaaagtctttttccccccaagatctgtttgtggaataaaagtcttaacagtaactataatgagacaaatagacaaggacctgttaattgtttgccagcatttgacctggctggggcaagaagtgtagtttaaattattggacagactttccttggctcccagtaactttagttatgcggtgtgctgtatagttaaatgtaaataaatagactatcaaagattttaactaaagtcatcatgtaatttgatgactatagtttaagaaactattatttacattacttgataatataaagtggtgttcttactatgactgagcctttttttctgtatccttaaggatttgatcatctgcttcctgatgctgttgtagataggaaagcaggcttagagaggtgaagtgacttaccctcgtgctacacagctaataatgctagagctatgttaaagtcagttcttcgaatgttgtttacttcacattttctccccatgtagttagtttagtattcttctgagaaaaacagcttttgtaacatttatgaataaattcaactataattttaatttcatagaaaaatactctgtgtaatagtgatgtttgcagtagtcaaaactcttcatgtaatttagtttactttggaaaatatccttcagtcttgtgaattgaagccttgtaaatagtaatctccaaacccagtggcctagattccatttccatggtttaagaagtaatataattaaaatacatgtggactaaaacattatttttagttgaaaagatttatgtggaaattatatttaaaatgaagtcggctgttttttaaatgacctcctaaagtcgtgcttttaaaataatagaatattcttacactagaaactagtgggtttttttgtagaagttaaagtttagctactttgatagtattagtagaggcagatttaggaaaattttatctatttttcttctttttctttttcaaagggagtaactcagattgataatgacctgaaatctcgagcatctgcatacaataacctgaaaggaaatcttcagaatttggaacgaaagaatgcgtaagcagatcaagtatatttgagtactaagaactggggaagcatactagcatgcaccgaaggagatattgttgggatttagttagtttcagtttatgttgttctgtaatcaaaatggtatttcttttacttcatggagaaaagctcactaaggtaagtttatagaattcagactagtccaaacagatgtgaggctgatttattatacttgttttataaataatacttgtgaactgggtcctggcttattcctttatccatttgatatttcactgaaaaatagtctaaaattaattgttttaaatgaaatcatagtttaactgcatagtaattacctatcacttaactatagaataatccttttatgatgtaatagttattctcttatctgttttcagaatttaggtttttcacttgttaggttttttaaaataggactgaatttttttggttgatccccttgtactatgactacttcaagtgcaactttaagcatgaaagtattcaagttgtgccttcatatcctagagggaaagttggttggatactgtgagtgatacaaacagggcaagacatatttattatgggaaagtgattactggaagacaaatgaggactgatttgaaagagttaattattgggttagctaccaaaattgcctagtatcaaatgatacccaagggagggaagaacactaaaggtattgtgcttagatgacatagtttcataattatatgatggaatagactttaattgatatctaatgagtagatagttttccagtcaagatattatatatgtaggcaagagaagagctgagttataataattaaagcaaacacaaaacactagaggcaaattttggtagaagatatttcgttggttgcaagggtaggatatattcagctaaatggtgacttcttacaaagtaaaaatgttgactaagactaatccctctcaatgtatatatagtatatgtgaaaatgattagcctgctgtttctttacttgtgttacagaagcacataattatcagcctaatgatttgttttaattcctcagaggaagtttgctaactagaagtctagcagaaattgtgaagaaggatgactttgttcttgattcagagtatctcgtcacattactggtagtagttcccaagtaagtctttctattataaaaggttttacttgttaaaatacaagaaaaatgttagtatctagtattgtagtttgaagttttccataaaatccaagcgtaaaaggaatataaccttgccattcattctgtcatcaacatttgctcatgtggcacataaagtagaaattagatcataacctggcaatggagacttcagttataaattgagtttccaaatcaaatttagcagcttggtagaattggctcattcaaacataagtaatgctaaattattgattgtttaaaaaatacagattttagatttctcaaaataggaaggtctttgcgtttttttcctgaaaaaatctttatgactggttaggtttaattaagcactgtaagaagcaaagaatggattagatcagagattagcaatttttttctataaagggctagatagtaagtattgtaggctttgtaaacaatgtgatctttgtcacaactactccactgtggcaactttgtggttatagctgaagtagccatagatgatatgtgaacgaatgaatgtggctgtttcaataaaactttatttacaaaacaggcttggctatgggcatagtttgctaacccctggactagataacctttgaaatctccttaggattaggccttctatgttatttaatatttgatcatagttaatcttaaatgaaatgaaacctttgggtacttgtaggaagacctggactttgtgtgtgtctgtgtagcactattaatggtttcacttttgacttacactgagtcttgctatcagggaatgtttgggggatccaaactcaggtgggagatttgggtctttttcagagtatcattgtgtgaagacttccttgctgtgctctgcatttttatctggttcagagatttggagtactagaaaatgatgcctccatggaatttacagtggctacagtagtatctcaattctgcatttttttcccctttattgcagtatgctagaaaaaattttggatttttctttgcacagggagaaggccttaaatctaaggatttcactccagaaattttattttgtgttctagttacataactcccgtctgctacactgaaacactgattatttataacaaattctgtgtatctgtgcttttatactatgtaggaaaataacttttgcccagatgaaatatttgactcactcaacctttatttaaaacttgggttcaaaaccagaaatttttacagttttctgtaccttgtaattgaaacataggacctaggacatcttacatgatgaattattctctattctggcctatacacactataattctttgttttcaatctcaaacatagttgtctctccccacacccctggaagccagtggcctctagagaaggttgttgcacaatgttttgtggcaacatagtttactgtcacttcatttacttactacctcatggtactctgtgctttccataaatatagttttttttcagtccttcataatggccactgagcaggaatgatagtgattttagcatgaccatttttaaaaaatgaggcacaatacatatgaactatgcagcttgaaaacaatttagaatctatactgtgctttacttcctttccgaacatagttctaggatgtgcctcttttgcaatggttactggaggtagggtggtgatctgtttttcctgcattactcagtgtatttgaaattcattctcagtaggaaacccgaattttttttgttaaatagagttgaagtatacttactatagccagatttcctatttgtctcataattttttctcttcctggatatggcaggaaataggacttgtttttcttttccaatgtgtattgtaccttttctgcaggttaaaccacaacgactggattaagcagtatgaaacactagccgaaatggtagttccaaggtctagcaagtaagtagaagtctttgtaaaaccatttgtttcctagaattccttttagagtttggatgttggcttaggaaatatgtttgctgtcttgcctttgtgataaattaacctcatgagtgagttctatgaactctagttgtaataattttagacctagaagggacttggcacagtctgtttgacaacctcctgtttatagacttagaagtttgaggccagtgaggtattaatagtttgcccaggatcacacatctcatttgtggcagggctagaactagaacctaggtctttggtgtggtactttttctgcctcactgtgctgccttttgaaaattctttattcattattgcatacctactatgtgtctataattcctcattttacttggcaaaggaagtgtaccagaatggctactggactgccgtgttgatctccagatgttcaccatcactttgagcttagattttacctaatttgtgtgttccttttatttaaaaaacaaacctgtttttattaagcactttttaaatttatagatttaacatgcattgtctaatttgaaatttacaacaagtctgtgaagaagtatggacagttatcattcttattctcatggaagaagaagttaaaatgcttaaatagttgcctgaggcatatggctgtgtaaagtgtccaatggcagagttagggctagaactcacatcttttagctccaggtcctgtacccttttaacactattccatgtcatttttctgtgttctgccattgccacaccagatattctttgagaaaatataaatacagtgtatctccaccccaaaggattcttatagatatatatgtgcttcaaggggaggcagcagggtggaagatataggaggcagtaaagaagtggaattagtaaggtcaggcccatgaaatattttcttttccagtttcattgtgtcatgtgggaagtagcttagtatgatggaaagagtcctggacccagggatctgagttctattgctggttctgtcaccagtagagtctgtcactggtagggtccgtcactggtagggttgtgacttcgagttgtccaggttcttggtgttttgaacaaaaaattggacaaaatgcccagcaaagcaaaataagaatgaagcaacaaaagaacgaaagcagggatttattaaaaatgaaagaaagtacactccacagtgtaggagcagacctgagcagtggctcaagggcctggatacagaatcttcttgggtccaaataactcctacaagtttcccattggccacttcatgctcacctcatgtaaatgacgtggtagcctgcagtgagcctcattggttgcagaaagcagccaaccagaggctgaagtgaagttacaaaggtcacactcctgtgcaaatatctgattggttgcagaaggcaactaatcagaggctagggtgaagttacaaagttatacttctatgcgaatgaagactcggcctcccaatcagtctgatttgttgcagacagccaatttcccatctgccatgcaggaaaggtcaaaaggagtagcctctggtccttttgttacttaggcgtggaaagttagggttttcctttcaatttagttctaggaaaccggggtgaaacaaccttaggttccctgcctccagaccctatttcctgcctcagttctgctaccaacttgctgtgtgacctggggtaagtcttttaacttctctgggcctcattttctttgtctgtaaatggagcatagcaccttccttgtatatattatgaagttattttaagacttaatggagtattcaaaatacaagataatgttactgtattttcacaaatgttgatcttttaggaacttaacaacaaacttgtgctcatcatgaatgttttttttttcatttggaggaatatctttccttcataccagctcttcacatggtaaactgaagactacagttgtgtcttgatattggtggctcacttaggctgttgatactgacagatctttagggcattagagccgtagaggttgactctgtgtctaggaggcaggtagaggaggagagtgaggacgtggtgcacacagaatgtcctccagagatggacatacgccaacccagatgtccagggggatggtctgtaggctcattaagtaagctcagatttactctgatagaaagactttaaaaatattccatcagagatttagatctttggacagtcactttagtagtttaaagggcaaatttcaggaagggaacagtttaatgcagtcaagacttgtttgcaagtgacttgtaagtgcacactaatcttccgagagcttccagcctttccttgctcagtgaaaacatcttttctacctatttctcagttcaaagtacatttggaatcactgactcaaaaacttacctgtttaaatttagtcagagagaacatagcactagctcaaatagcaccatcaagagtatgtgcagttcatgtaggggcaaataggcttttttgagtgagcctggaatattgtctgccatttaggaaagatctctatgacctgatgctgaatttttggcttatcatcacaaccagcatttttgagtaattactgtgagctagtctttgttctatgtgctttacacaagttaattaattataggtagtaacacattactttttggtatgataacttgagtgattattgttgggagcagtgaagatgaaagtggaattttgaggtagattgaaaaatattcactttaatattcaatctaatatttttcaatctattcttctaactgtcctcaaacctgaaagaattttaaagttcacaaaatataactatttataaaatattctacaaagattggacggttttgaaatactaccattgctgtgaggctaaatgcagcaatgtgtataaatgccatgccaaggctgtggccaaagaagtggaggctgtgctgctgttctgcttttttttgttgaaacactgttcagaaagaggtgcttttcacttgtcctttcagaattaccactttcctattttttttttttttgtctgcttttgcttgttaaaatagtctgattgagtcagatcactggttaacttttgccttttctctgtcattggaagcaacatcacaaactcatggatgcttcacagaggtttttctttagggatctggagtccccagtgaagcagaggagcctagctaagaagtgcaggaagaatgatactggccactgtccagaagtttctctatgtttcagagtttctgagggagatggtctgttctcctgtcagtaccacttcaaccacacccatggctctagcctcacctgcagttttcggactgctaaatcttcgtctgtagccagccttccccccaaccacatacctggttcctactggaccactccatgtggtatttcctaggtaactgacactatcaccccaatctcagactcaaactctctagttgccctgtagtatatggcagcaacatctgcccagtgatccaaaccgcaagtgtggtagtcagtgattttggaatcttcctttgcccttgcacccccctccccccaccggccccccacctgaaatagtctaatcagttatgtcatttccaccttccatagtatttggttgaaccgttaaaaattgatgttttgtaggtcagaaaatggtcaaatatctacaatttcatagggttaaatctactctccccactcccccaagacccactgccactgctccagctctgactccctcatcccttgcctggaccatggtaattgaccctagctggtctccttttctcctctcatcagtcctccacattgctgctgttttcatctttgtgacatacaaatgtgttgctttcccgtctaaaaccctgcttgtccctccccattttgactgcctgcccccagcacgcacacacacacacacacacccacacaccctcttcttgtaccctatgtcccagccatatatgtatatatatattgtttttctttctttctttttttttttttttgagacacagtctctctcacccaggctggagtgcagaggtgtgatcttggctcaccgcaacctctgcctcccgggttcaagtgagtctccttccccagcttcccaagtagctgggattacaggcatgtgccaccacactcagctgatttttgtatttttagtagaggtgaggtttcactatgtcggccagactggtctcgagctcctgacctctaagtgatctgcctaccttggcctcccaaagtgctgggattacaggcatgagctaccatgctgagccccggttatacttatttctggcaattcctcagatgcaccatgttattccacatctatattcatttgcatatggggttctgtctggaacgttcttctcttttttgtctttctttcaaacttccacctggtatcaccactttggtgaaactcctttgaatcccctcagataaagttactaattccccagtgtatcatgtatattttctattgcagcacttacaactctatattgcagttacttgtgtatgcctgtttcctttactaaacccatacctggagatcaggaaatgctgtcttagttttatactaatatctagcaagtgcttgcattacagagtctcagtacatgttaaatgactacaagtctgttatagtaaggactcgtggtttattttttaaacagttttaagaaatacctttccttaggggaaagagggaaagcaagtggcttttatttgtttttcataataaggtggcatagtaggatttagttataagataagatggaggttttatcttggcttttttcaccatcaggattttgagtaagccataggaatttgctgtgtcccagatctctgcacaatagctaggaacctgcttaataggtaacctgttcattgacacagggccatgtcaagcaccaaatgcttttggaagggtcttcaaaacagcaaagtgttggataagtttaaaagattactatgataacagtaaaacattatttgtggccctgaaatagcctgtcaagttagatttggatttgttttgatctcaagcagttcacacatcactgagtaaatcttggcaaagcagaagatccttaaacggttttttaaatcgagctctgtccacttggtagctgcccttcattgggtttgatggacaccaggagcaagaattaagggtaatcattttgagaagatacagtttaacaggaggttctaaatccagagtacttgagttttctctgcatgtcagcgattacagtgatcagtactcctggaggtgtctgctggtcatacactagggaggtgcccctgctggctggctgacgaggagtagggtagattcagtacttaaagccattctgtgattaacactgtaattgcctcctgaatttacttggctaaacaggtggttcttaggcttcaggaaaaactacacttgctttaaacatttttttaatatagtatctttaaattccccagcattcctccattttgtaaaatttcctttttctgatttcagaagtaccacattgtaaaactgaacattaaaaaacaaagaaaacaaccaacaaaagggcacaaggacccttttggtagtgaggggtatgtttattgtctagattgtggtgatggtttcatgggtatatgcgtatgtccacacttcagattatagacattaaatgcgtacagttttctgtataacgattatatctcagtaaagctgtttaaaaaacactaaacattagaagaactccagtatgtgaaagacagaaaggagaagagattcccctcagtaacattcccctgccccaaggttatcgctgtggaacagctgcctgtgcagccttgtggacctcacataaggacttctatacaggaggcactataggtaaattctgaaagccaaatttggaccatactatcacaagcgataccattcacctttcaaacagtggactttcacccaaggtattacagatttaaatgaccattaaaattacctggcagttgtgtctggaaaggtctttctagtgatgtccatggagctgtgactgaatggaagttctgacctcactgggaccttctaaagcctaaaatggagccatgagatgcatacaggcacttttattcagagattatttagacagttgtgttcatcaggggtttttttttttttttttttttttttgacagggactcactctgtcacccaggctggagtgcagtggtgcaatctcagctcactgtagcctcaacctccccagctccagtgatcctcccacctcagcctcccgagtagctaggactacaggcatgcaccatcacgcctggctagtttttgtattttttgtacagacacagtcttgccatgttgcccaggctggtctcaaagtcctgaactcaagcaatcacccacctcagcctgccaaagtgttgggattacagacataagccactgcacccagcctgtcagtttttgattgagagatgtcatgggagcaaaggaaagatccaaggtttaaggtactggcaatgcagagaggctaggctgggcatcagtggggctgagttggcctggagaaaggaagaaagaattaggcttccagaaaagaagagtgtgcttatcaaggagacactggaaacaaagcagcttggcgctgatgttgattgaaaagtgtggttcttagcgtttggatgctttactggagttaatgtctaattttgttggttagtaagaaataaatgtagagtgttaaggtatcataagcaaaataaatcataaacattcagtatcttcggtgtttgaggcaatccagattgaaaagcattgaggtgatttgggaagggctattataccctacttttctcttccacctgtttctgaattttgcccttaatatgaaagacagcaatacgtataaatctttaaatggactttttttttttccatagtgttctttcagaggaccaagacagttacctgtgtaatgtcaccttgtttaggaaggcagttgatgacttcagacacaaagccagagaaaacaagtaagattattgtttttttgtttatttactttgttagatcagctgtatacaatgtgaacaattttgttttttttcccccaaatttagattcattgttcgtgacttccagtataatgaagaggagatgaaagcagataaagaagaaatgaacaggctttctactgataagaaaaaacaatttgtatgtgtttttaatatttagtattatcagtactaagcagaagaaaaagtggtattgctttcctttgatttaaaagaaagtaaaaatctgctttggttttaagacatttgattttagtttttttttttaattgaataatcagaatgaatttcctctaaagcttaactgttctagagataactattctatttctaagaaagctttcttctaaagcttatgtctatctgagatagaatagagtagatagaatagttatcctaaaatacatacttaaaaagaaattactccacctaaatccatatcagacattaattttaaatgcagtattctggttaacatccttgtaggtgaagggtgattttagttaagtaacgaagttcttttcagtaagacttttcactttcttgaggcagattttttcaatgcctcaatcttttattgaagcaatttgtatttaagctattggagaattggtgtgttctaggtgtaatgggaaacgagtggaattgtgaaaatcaaagatggtgttaactttcttgccatcttcaagtgtgggattactgtgaagactaaaagcttgtttggaaagggaaacataatgagtgaaaatgtgtttctcttaataatgtaagaggaaattaagggaaatattgaaaattatttccaagtactttataagccatatcatctcaactaggaggaaactcattctaaccaagtaatgtcaaaataaccagctttttagggcaaacccaaaatccttttaaaaaatagatattttgacaagattttcacttgttttgctatccttttgcttaaattaattgtttggtacatccaaatgagcctaataatgttatccaaggaagtgttagctgaatcttttaagtatggagagaggaggtatttgaaatccgcttaatcctactaaatatttgaagtttaaaaagaacttaacgctatataatttagaatgtaaagaggttttagatgtctagaccaactcccttttttacagatgggaaaactaagagctagtgctgttaaatgacttgcctacataactgtttatctttgttactaagaagttgtttgtaagttgaatttcattttacatgtattaaatgttttagagtgttgtgtagtaaattcagatctttatattttgattttccaacctaaggcatttctatattttgtaccattttaactacttttattaaaatatatacctttttctgtgttagtgaattggttcaatgcattttagtgtctgttgagatctctctgtagtggcgaaccttttaatctaatttaagataaggtatctgagataatgagaataatagtgaaacatgtagaaagtgaattatgcgacttaattcttctatagattcctaataggtagtcacttaaaaaaatatttggtctatctaattgctatttctaagaccaaatttgtggtaattttttttctttttatagggaccacttgtacggtggctgaaagtgaattttagtgaagcatttattgcatggattcacgtgaaagcattacgggttttcgttgagtctgttttaaggtaaagcaagttaattgccaaacttggaactgaagagttcatagattccttacattggacctctttattataacacagtccagcaataggaaattgatttggagaaatcaaagggccaatcatgagacagagattatcagtatcatcatacagcttataaaatgcatattagtcttgttctttagcaccaggtttagaaaaagagatttatgctgccataccctcaggttctttttcttgtgtaggtacttaaaagtagattaaatattaaccaatatttgtttaaaaggaagatccttcaggtgttttatatgtcattggatacatagtatgctaatgacttattgaaatcatttcatattaacctaaagtattttaatattttgagatatttaaaaaatcatattctggtccaatgtatgggttgctcatattagaaatagttttaaaaaacccaaaacttggccgggtgcagtggctcacgcctgtaatcccagcactttgggaggctgaggcaggcagatcacgaggtccgattgagaccatcctggctaacagggtgaaatcctgtctctactaaaaatataaaaaaattagccaagtgtggtggcacgcgcctgtagtgctggctacttgggagactgaggcagagaatcacttgaacccaggaggtggaggttgcagtgagccgagattgtgccactgcactattgcaccactgcactccagcctgggcaacagagcgagactccgcctgaaaaaacaaaacacaaaacaaacaaaaaaacaccccaaaacttacatgtaaccatgctcactatttttaaattttttcaaattttcaaactatatgtgggtaacctcatgctattaccataaaagtatctgctgaccttacttcttcttatttcctgaggatattcatatattaccttaaaaattgaatggtaagccaggcgtggtggctcatgcctgtagtcccagcactttgggaggccaaggcgggcagatcatgaggtcaagagattgagaccatgctggccaacatggtgaaaccccgtctctactaaaaatagaaaaatcagctgggcatggtggtatgtgcctgtaatcccagctactcaggaggctgaggcaggagaatggcttgaacccaggaggcggagattgcagtgagccaggattgcaccactgcactccagcctggcaacagtaagaatccgtctcaaaagaaaaaaaaaatgaatggtaattgaagtaattcctagtaattggcgtagagatttctagtggacagtggggaccaaaggtttgcgtttctgtttatattgaagttttttgtgtatattagtttcagtttctatatatattagttgaacttgtaaagggagatattctctccccgttaaccatgattaaagagtatgagaatatttgctttgaaaagaaaatctctttacatgtttgcttgtattgcgtactgtatttctgcttttttgtaaggtatggcttgccagtgaacttccaagcaatgctacttcagcccaataagaaaactttgaagaaactgagagaagtattacatgaattgtataaacatctagacagcagtgcagcagctattattgatgtaagtacttattagcccagtagagtaagaattgaagtgaatttcagaaaaaaaatgattgaaagaagatagacagaaaagggagggtaagtatgaaacttaatcattttttattactttgaggttctcaatttgttatgtaaacatagtaatttacattgtttaccctgttttatactaattatatctgtgttttgcttcttggcatttctacaagctagtaattatcttgctgtgtatcagatgtttatagctgcagaaatacagaaaccagtgatactagttatttacaaaaactataaattgcagagaggaagaaaataagcagttattttaattttatttggtagaagcgatagagtcaatagatgagtattttcaaggtaggttcatttttctaaaatggcgtagctgggcgtggtgggacatgttggtagtcccagcaactgaggaggctgaggcgggaggatcacttgagcccaggccttcgagaccaacctgggtaacatagtaagatcccatctgaaaaaagaaaaaaaaaaacagaccaaaaaatgtattatgtgtttatatcttcttttaaacaaaactgttattttttaaacaaaagaagatataaacagagttacttgtgtttttttgttgttgctgtttaaaattgtagtgggccgctgggcgtggtggctcacgcctgtaatcccagcactttgggaggccgaggcggggggatcaccttaagtcaagaagtttgagaccggcctggccaacatggtgaaaccccgtctctactagaaatacaataattagctgggcgtggcagcggtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaattgtagtgggcttttactttatatttctggttttaaatatcttgctgatttttttttttctctttaaaagtttagggtagatggtagcatctcacataggcattaattagaactatgaaaaatcagtttttcttgatagaaggaaatgcgggaaatgacttgctacactttttttctttttctttttttttttttttttttcaaaatggagtttcgctcttttgcccaggctggagtgaagtggcgtgatcttggctcactgcagtctctgcctcctgggttcaggcagttctcctgcctcagcctcctgagtagctgggattatgcctggctaatttttgtatttttagtagagctgcggtttcaccatgttggccaggctggtcttgaactcctgacctcaggtgatccgcccacctcggcctcccaaagtgctaagattacaggcgtgagccaccttgcccccggccaacttgctccactttcatgcaattgtggataaaatgagaggtataattatttgatacataaatgttctagcagtaaattcttataacatgcatttataataagtgttatccttgcttgttttttggctctgttgctcaggctagaatgcagtggcatggttttggctcactgcagcctcaacctctatgctcaagtgatcctcccacctcagccttccaagtagttgggactataggcacgcagtaccactgctggttaatgtttttatttttattttttgtagcgatagagtctcactatgttgcccagactggtcttgaactcctgggctcaaggccttggcctctcaaagtgctgatattacagaataagtattacttataaatcatacttgctttatttttactccatattttgtaagtcttgtatcccatcaactcagtattctaagtccaagatttaaaaagttaatttttacagtatacataaaaaaggttggtgggatcatgctaaatacatatgcagtcagaatgcttgaacctggctttaccactcactgtctgtgtttcctaggagaagtcagtctttcagagattgttttctcatttgcaaaatgggaataatgtctaactcagataaattagccttaagtgcatacatttagcccagagtagatgttcaataaaaaggtaaatgttaatacttgctttctttttttgagttctgtaaatacaaaattgaataattgtctgttttttccataggctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttaccccctttcctaggtgaattctcccacagtggtctgtatctcaacattttctttttaaaggaaaaaatatatatatatagtttctttttattgatcaggtctgtaaatgtgtactaaaaaaatcagagtttatttataaacagaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgagcactgtcaacacccacaggagagaataaaattacctgtgcaaaggtgtattgtggtgtgtgtaacttaagattacagttctgtttgagagttaaatgatgtcatagctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactatgcagctttagtcatttgttttgtctaagtctgtattttatgtgttgtcttcttaagatctataattttggcatttatgtcatttgtgacatagtctgaaaatagagacattgttggcctttaaaatctcagaaatgaatgacttaatttagtgtcctgaaagagcttttaaaagaggattttgtggcaatgtttctcttactacgtactcacaggtttgcaaatgggaaaaaagtttacatttcagtttaggggcatatctaagctatgctattccctttagaaaattagcctccaaaatcttttgtttcaaaatattatattatttcataaataatttcaagcaaatacagacatccacaatgtagaacatgagagaccccctccctcaatttccacctcccaagggaagtttatgtatttttctaggcccttttctatgtctttacatctctgtctcacacacacacacgtatacacacacacagtttatttttaataaaataggattataccacacacatcctgtcacttgcttttttgcttaagagtatatctaagagaatcctttgtgtcagtgaagctggagctacctcattcttttaactggctgcgtggcgttccattgagtgtctgtcatcatgtgtttagccgagtggatggatagtctgcttgtttttagtttttgctcttaacaaacactgctgcagtcagcatccttgcacagatttctttgtatacttgtattagtatttctgtaagatctgagaagtggaatttgtagggtcataggttatgtacacttaagtttttgacactcactgccaagtcatctgtcagaattctaaactaaagacatgtttggagtgtggatttatcttcagtttttctttggacaagaggaagctgtgaaagattttgctatcagaaaattttggttctttgtcttttgcacatgttctttgagtcttagtatctgtaacgtggcgctactctctctatcatgggggggcatgttttgacattaaattgacttttaagaaaaacatgtcactaacctgaagctcagccacacagtgacttttaaggttttatttagactttactgttgttctcatgagagtaggtacagactgcataaggtttagaatcccagcatatgtctgaaacgacgggactttcactgtgatttccaccagagaaattatagcagagtggctgagcatgtgctctgaggccaggccccagctctgctgctgacgagctgtgtggtcctgggcagagtggtctccgagttccagtc

SEQ ID NO: 16983 - DNA, 41741 bp, Human
  misc_feature (1)...(41741): n = A,T,C or G
acgggccacgttccaatcggcttaccttctgtctcctctaaacagacttgcctgattctgggctgccagattttacagaaggaggcccatcttctctgtacctgcccatcggcacgtggagtcatgaatacataccttcctgctccccagtgagtgtcacggtcttcaccgcatgctcctgaagtgctgagcagctgagctgcctgtcttcagctttaatcaggaaacacgcattctgtggactgaggaacaggagaggccgtggcacgcagagtaggggatgccgccctccatgttctggccccaggaaaaactaacctggaggcagaaaaactcaaactgatgaatggataattatccactgaaaattctttaaggggaactggtttatactttttttgaatttgagataacatcaatctatttaaactactttttaattcaaatgatgactttgtccctaatagcttaaaaagcaaaataacgtaccttaaacatgacacatacactcttggaggcttttgtctgtgcatgtgtcggaaactgatgtttgccaagtgataaataaacaggtgccattaggaaaaacagaggttttcacaaatgaaagctccttccctctcccacacccgctcgcatatcctccctgaagacagaggccagaaagtgaggcttgctcttcatggtgcctgccgacctctgcagcgctggacccctgtgggggaatgccaggaggcttaagagacactcccctgccacagacacagtaagggttgtgtccacagaaattcgctttaatgttctctaactaggacttgacggatccatggccaggctgacaactccacacaaacgtgaaggaacctgacaggcaggtgccgacatgaagcaggtgcaggtggctccgggcaaagcagcagctccccagtcaccatccaccccacctggggaagtagcacctcccccatccaaggtccaccccaacccaggagaagcagcagctcccctgtctgccattaaccctgacctgggagaaacaacacatccccagccaccttgcacactgacctgggagaaacagcctctccaccatccacctttcacactggcctgggagaagtggcacctcccccatccactgtccagcccaacttgggagaagcagcccctcccccatgtaccatcaacccccaccttagagcagcagcttcccctttccactgtataccctgacctgggagaagcagcccctccgcatccatcgtccaccctgacctctgagaagcggtgccccccacccccatgcagagtgcaccctgattgcgggtgatgcctgaggtgtgggaggggcgggggttagctgctgccactgcttctcgttctctcgagtccttgctctgtgcctgcacgtcaggttgttcctgtgatggggccacgtgcaagtgtgcaccaaggggacttggccgggtactgtacgtccactgggacacacccttctacgggtattgcacgtccactgggagacgtccttctaggggatcctcactgagcaaatgaagcagaatttgggtaaaaatgaattttcccaaagctgcagtacagcttttcagtcctctaactgcctgagataaatgttggcaacttccttttatattaaatttcatttttgtcacataatacacttgattattgaccataataactttattaatatacagactgattattgatactcaccgatgtatttcatgtgttattgagagtcactcatttggtttagaaagaccaatatcacattgagtaattcgaaacatatttaaggcatagaacttgcatttttttctcttaagcaaaatgaggagttctagccaatcttgctagtgttatttatagcatcttatttcctgagagaagacaggaaaagtgagtccctgccttccctctctccgtctggctcctcccaggcctgtctggcaggggccggggtgcaggaggaggagacggcatccagtacagaggggctggacttggacccctgcagcaggtactcggagcaaatggtgagatcagaagggggatgatgtcattccttcgaaggaatgaattaaacgtgcttcctcgtgtgtctgattgacagccctgcacaggagaagcggcatataaagccgcgctgcccgggagccgctcggccacgtccaccggagcatcctgcactgcagggccggtctctcgctccagcagagcctgcgcctttctgactcggtccggaacactgaaaccagtcatcactgcatctttttggcaaaccaggtacgattatttcttaaactcaatcaattatttaatggtgctctaattttaagaaattagagttctcgaactctaagaagcggagaagaaaaaggagcaatttcgattcttaacttaaggtgggtggtgtatctattaacactaaatggcaagtgtttcttcacgtggtgtttctactgcccgcttgaagagcaaggcacgtggccgctcctcagcttttcctccgtggctgtgctttcaccagccgggcaccccttcctctctgagggttgtggctgctgctatttcaatgtatatacctgcctgggaacccgggtaaacgctttatgttttcagtttccgaagaagaagattccacatgagagtttgttattgaggagagaattagaaacaactcccggaatatctgaaaagtaactggagattagagagagactctgattgttaacatcattattagtagattagagagagactctgatcgttaacattattagtagattaaagagagactctgattgttaacattattagtagattaaagagagactctgattgttaacattattagcagctgaaaagtggttttgaacataactagagagtatttgtggtaagtctatggaaaatcctgtgactgccgggacacacagcgacttttaacagtcttggggcagtttgcatatgaaaagcgagctggcaggttgcctggctaccacttaaggaaggtgggtttggctgcccaggactgggagctgagcacccaggagtctggtgtttaatcagactgctgttggtggtggacggccggtaaacaattagctctctgcaaagctatcttttactttgattgttcatacgaaaagagttttaaaagacctttgcaaattcaaactacattctgctgcagacaggcaccgaaatctttcttttggaaaaacacaagcataaacgtggatgtgtggcgtgcagaggctggggcaggggtgagcggcactggctcatccgtggctccatccatgcatgcccggtgtccctggatgggctgaggccaggtagcctggctgctcatccttcctgtgggatggagcctcactgtcctttgacaatccgcagcaggggatgctttgttagcctcctgctcttgtaagaatctacctcaaggcagagacagtaggatctggtttcgtcaaaggagtttgatttagtttttctaacctgtccttatgaagctgggcatccagaactttcgcatttaccatcctgttcttggctggcctctgcagggccagccccacacagctgtccttaggggactgcgacgtacccggcagtgtgggctgatgaggtggggaggtgggaagagcctgccaaggctgtacctgagctgtgtattctaacaccgttctgtggtgcttactgcatgcaggtactgttctaagctcatggccaagtgttcgctcctgtcattaaaccctcttaagagctccatagaaaggccctatcagcaccaccattattactgcagctgcctcgggcagttagagtagaaagcgccccagacccagaggcacattctgctccggtaacccatgcctgtggctcgctgggctaagtcagcccctggtgaagtttcatttgccgaattcatctctcatgacaacccgatgaggtgggcattttacatgacgctacgtttcattctacggatgaggaaactgagacagagaagttaagtaagtttccctaggttgcacagctggtgctcagcattgctcagcctggtgctgactccggccgcaggccgtgctgcttccggagccaggacagatgaaacaatcaccaaggacccctggggcggcactggggggagcagatggtttggggggggggtcccagcagcagatgggtgggggggtctgcaggtgctgccaagcatttctcttcttctgaggaatgtttctctattcctggaaggtgaggatttccaggttaccaaatgttgtttctggagagggagagtccttggattaacaatgagaagttaacggcctttgatattctaaatatgggaagaattggggtctcagtcttcccttcaacctagagcagggtgtgaccaattgctggaagggacctggggagccctgggaccctcaggctcatgctcgcccggaagaggagaagctgagatccacagggttaatcgcccagccgggctttggaccacatctcctgacttcggggccagcctccactgagctgtgccaacttaaaatccccaagaatggaaaaacaggcctgcaggaaaataaagaggcagggtcaaaatgatggctaagtcaagtgttctgttgttttgtaagtataattcaccaaattaagtttatttgtaacttttttttacagttgatattcattctatttaattaggttatgcataactgttttttgctggatatttacacaaaatgcgttcacagattatttttgtcaggctggatatttttctaaattcaaactttctacatctaagtcctgtctacgagtcgtatgaacagaattactccaggcaagcgctgaacttgcccatcttccatttgctcatctgtaaaatgaggacaattagagcagcacatacctcccaggctattatgaagatgaaataataggaatatttagaacgtgatgtgcagtgcttgccggcaaatgctagctcaacaaatcttatagttagaagaatcctgcttgaagagtaaatttcctccttcgctctcagtttgccacaaatccagttggtgctgagttttatatgcaaactgttattcaatggtcatgtgagtcactgggccagtctcgctcacaggcagggttgcagctgtggactcatcactaacaagggtttcctgtattcccaggagctcagctgcaggaggcaggatggtctggaggctggtcctgctggctctgtgggtgtggcccagcacgcaaggtgagtgtcctcagagcctgtggtctctctctggcttgtgagatatggcttagctgcaaggggagagatgacaaaataaagtgtgtggttggacaatcttacccgtgaggaccttctagctcctttataaatcaaatagtaacttacttctgagccaatatgacatgagataatttatctttggaaaattcaggtgttagagaaaaatgcaattccacctagagttgcacagtttatccttttttctatagaggatgttcacaacactgcaagtatttggtgtttgttgaattctttttgctccactttcttcctcctttaaatattttcccatgtgtttacttttctacagtatgatttttaatgaccacataatatttcatcacagataaagcctgatctttttcaatcaattcccacttagattggtttattttcattagcataaatgatgacacaaaaaatattgacgtggataaatcttaagtagcatttgtgattatatcctttggataggttacaaaattagaattgctgaatcaaagcttttaattcttgccaagtaactctatggaaagtggtccattgcccacttctgtcagcaaccctgtgtattatcctgttctaatttgctaaatattagatgaaaaggaaggctttggctaaactttctgttcagtgtattacttttttttttttttctgggacggagtcctgctctgtcacccaggctggagtgcagtggcgtgatctgggctcactgcaagctctgcctcccgggttcacgccattctcctgcctcagcctcccgagtagctgggactacaagcgcccacaaccatgcctggctaattttttgtatttttagtagagacggggtttcaccacgttagccatgatggtctccgtctcctgacctcatgatccacccacctcggcctcccaaagtgctgggattacaggtgtgagccaccgcgcctggctttgaattatttaaactattatgattttcgtgagatctgatcacttttcttgccaatagcttaggtggtgacttaaaaccatttgtttctgtacttgatactgaccactctttcagatccttacccacagggtgcattaagagttggagaatacatttttacaaaataacaacctgctgacataactggttttaggcagttgatctcaacaagaaagcaacatacgatttagccgctttctgacactctatcaatagcaaggctaaagatccatgtctttcccagtttattcatttatttggttttttcctgagcaatcaactggtagacaggatggctgcttttcagcctcagatctgagatggaagagccagacagagtgacctgggacatgtgccaggatgtcaagcgaggccgggattccctcaccaagaaggtcgggctatgcaaagggccagctgaacggacagggcgctgcctgtctccaccgatttaccttctggcacacgctcctcgaccagccaggggcagaaactgaccccacagacccgcagctgcgttgggcccacactctgagtagcggcactggcacggaggatagtggcttttcatcagaggtggctccaggattcccataaaaaagggagagaagctgcgggatattgggaggcctcgttaatttccttacacgcgaggttctggtttgtcaccctgggtcaggccaacctcgccctcttcccctacgtcacccttctccactgcggttccctttgcagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcagggtacgctctgcagggaggtggccgccgtgagggaggaaagagcttagctgggaactgatctgctaatgcgtctggtgatgcgatgcttgagcaggcagagcctggccttagagaagcacactgcacatcccggcatgtgctcacacacatgcgtgcacacaccacatgcacatgcacacactgcccaccacacgcagccacaggcatgtgcacacatgcacacacaccacacacacacacaaacacacatgctcacaaacacatgaacacacatccaaagacatatacacaaacactgcatatgcactcacactcgcatatgtatatacatcacacatgtacacacaccacgcaacacacacacacagacacgcacacacacacctcaccacatacacatgcatgtgaacacaccctcacatatgcatgcccatgtgcacacaaacaccatacatgggcacgcacatgcagacgcacataaacaccattcatacactcatgtgcacacatgcacaccacacagacatacatgtgaacacacacatgcacacacgtgcacacaccctacgtgggcacccatgcacatacacaaataaacaccatgcatgcactcacattcacagacgtgtgcacataccacacatgcacacacaccacacacatacatgtgaacacactcatgcatgcacatgtgcacacaaccatatgtaagcacttatacatgtgtgcacaaaacaggtgtgcacacaccacccacagccatgcaatgcacgcacaccacacacatgtgaacacacacatacacacgtgcacaaaagtaccatacacagtcacacacatcacatttacatacctacacaaacaccatacatacactcacacatcccccacacataaacacatgaacatcatatagatgcatacacagtaaccacacatgtacacacacatacacatgcacaaatgcacacatactcatacacacgtatacatacacacaaacacctcatgcaaactcatgcatgcacatacatccatcacacatgtgtatacaaacaggcacacgtgcacacacaatgcatgcagagccacaggcagttgtcagcacatacgtactttcacacaggcactcaccctttcacatgcaaacaccacatacaagcgcacacacacacaacgcacgcctttctaaaccacgattaatcagagagggctgccccaggtgtgcttccctaactgcactaattatcgtcagttgagattgaggctggtttgatgatcaaggaatcaaccctattcaaatgtttctagcaatcccagacttttttgatcacaaccaaaaccactcctaaatgtttgctttagtagcgaaatgatgggagagcaaagtagcaggtgcccttttccaagggaaagggctagtgatttatgagggaatggtttcatgtccattttggttaaaatatgtttggaaatgaatcttaaactgcaggtctttagaatcacaatggtgtatggtacattgctccctcccggacgtgtagggccttggaaataagtacatggttaaactcagtaatttgagtaaaaggtctagagatgcatagcttgttgttgagtcaatttctcatgggtgtccaggagttccataccatataggactggcccagccccgtcataactcagctgcggaaggcgctcctgcaggcccagggtctgtgtctctgagaggaccagtgggactctgtgagcctctttgccaaatgcagaaactcgctaatcatgagtgacttgcaaggaacgaatggccttgaacgtccatgggaacatgcccagaacacacagcaggccacacctctccaagggccatctcactcttatttatgaaacatttccttcttctaggtagatttcttacattacacttccatttcttgtgtcatgcttaaaaacaaaatttcaaaagtactatatacagaaaaactgattataaagagattgcaaacctgctacgtagaaggaaatactctcactacttgaagattccaacttgtatttttagaatgtcagttagcttggcatcaaacattggatgtttatctgttgctctatttttctgcttgtgtatacttacagggtttgcttcagaacgtccacctagtgtttgaaaactctgtggaagatattctaagcaagaagggttgccagcaaggccagggaggtaggtgtgttgtgaaaaatgcattttatatactggcttggatggatttctattgtgacatggtgtatgtgtgtgtgtgtatgtgtgtgcattcatgcttgtaaaaatttaagtaaaaatatttgggtaactaccactattgtctttgagtgacttagctggtcaacttagacatgttgatatctgaaaataataaattgattaaacagttaattttaagtagattttaatcatccaaataattttattatagaagacaaaatataaatagctggtgctttaatatgagttgaaatatagacaacttttccagtatattaatgtgtgatgcttgtctgcctaaggaaagtcatagatatttgtcgaacttgacttacagaagttttcttttttttttttttttttgagccagagtctcactctgtcacccaggctggagtgcagtggtgcgatctgggctcactgcaagctctgcctcctgggttcacgccactcttctgcctcagcctcctgagtagctgggactacaggcacccgccaccacacccagctaattttttgtatttttagtagagatggggtttcagcgtgttagccaagatggtctcgatctcctgacctcgtgatctgcccaccttggcctcccaaagtgctgggattacaggtgtgagccaccacgcccggcctagaagttttcttatactgttcatagttgttgactccatcatatgatggaaatctatgctacttaaatcattgacagatgatctcatcttttctgttagttacaattgtgaatcatatttccaagcacactttccaatattttcttgagcatttaattctgaaggtcactatgacaggttcattaaatgccgtacatcatctaatcttcagaatgactacgtgagatgggcactttcactttcttcattttacaaagatgaaggctggcacccaagggagtgctgtgtggctgccatgttgagctccccagtgagcagggagcagggctgctgcctgggtctgtctgacagcctcaaagcggagctcacgtctgccacacggtgtggccgtgtgcacacgaaggccaggccatttcaattccaaattatgacaagcgtaaactgttatgtcatgaatctatacatcaggaatatgtgagatttggtatctttggtgcacaatgactctgtgatcccaccgcctacttcagaaccggggtgcgtagcccactcttcagttacactttgcaggtccgggtccttgtgcacgtcctgtgaggaaggagaacaaggagacatttgatcatcaatgcagggagaagggtgttctaagaccaaccctcattccagctacaactgtcacccccaccacgaccctcactgtgcctgttacctgaggggtgatttgcagcacaggcagagttatcttggctccagcactctgcgtgccagggcctcagcttcatgaggcagtgctcttctgggggttcctggggtgcagttggctgtggggcttttgggtactttttgttgcaataatgttttttcagtctgatatatttatatgtatacgtgtgtgtgtgtgtgtgcgtgcgtgtgtattttcactaatatagaaaaatattgtttttataaacaaaacatatatgcaaatattctttgtatgaaagaaaatatacccttcgcggtgttcctaatcacatgtttgtactataatttcacgtgggttcagttaaactagagctaaggttgtccatggcatgttgagtcagttgtcataatggtcagtgagtaaaactaacctactatgacaaacgtgacttacacctctatgtgagcaaacaccttgtgtgtgtgtgtgtgtgtgtgtgtgtgtgtgttaccagcatacaccctagtaggtgcagcctccttcagcaggtatttcctaggctcacaggtacaagtcaataatccctggaactatcaaaagcaaacctttaaaacttatgggaaactcttagatcttccaaaaaaaaaaaaaaaaaacacagagaaatctagatctgttatctccagatgtgtagaataagtatggatctatatacatatatctaccggaccatatgtggcaatcacccatgagttagtctactcaaaaccaggtggatgccaatgtcccatttggagatctttgccaacacaacaaagacttcttcttcactggttatgtcagacttaaggaaaattggtcttatacaaacagctagttcatgaattggttcttggtaatgacatccccttttccactgtttgttaaaagtgagagtaaccttgtgaagaggctgagccattattattttacaactgagaatactggcagaagcctggagaaatgcaagttagctggaaggttttactaccaggtaaaactacattcctgtcagagccagagcagaagcaaagatatatgcggtcttttgtttaacttttagaggaatgaaaaacaaataccctaggttagttaaagattagtgtgctgggtaaaatccactcagggtggtttctttgtctctattaatgtgttgatattgacctgattgtacatggttatgggcaacatgaatccgaggggaagcttctgagcttagtatgaattgcagcacagtttataaccaagtgattaaaaactcaatcacggaatgcctgacagcgctgtaaaatgtctaagtctttcctcaataatggactgtccgagagaagtcaggcatttcaaagatgggatcttcacccctgagagggagcagggtcctacatgggggtgaggtgagctccggcctagagcctgggccctgactgcaactgcgcaggccccgctgacctgaggactggaccccgcctccgtccctgactcgcctcaggtcaatttgtaaattacatgccatacccacccaggtcccatgatctagggcttcagagggagtggtgggaatgtggaaaggtgggagtggtgggaaggtgggagaggtgggaaggtgggagaggtgggaatgtgggaaggtgggaaggtgggagcggtgggaaggtgggaaggtaggagtggtgggaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggtgggaagatgggaagatgggaaggtgggaaggtgggagcggtgggaaggtgggaaggtgggaaggcgggagtggtgggaaggtgggagtggtgggaaggtgggagtggtgggaaggtgggaagatgggaagatgggaaggtgggaaggtgggagcagtgggaaggtgggaaggtgggagcggtgggaaggtgggaaggtgggagcggtgggaaggtgggaaggtgggaaggtgggagtggtgggaaggtgggaatgtgggaaggtgggaatttgggggaaggtgggaagttaggagcagtgggaaggtgggaaggccaggaggagcaaggcacagtctcaaggggactggctgtttgagcaagaggatagtgaattttctttaaagcagagcaaggagccataagaaagggtgtttggggatgaaaaaaaaaggatgaagagtcgagaggagccgtcagaacatatgggggatgtgttcaagaagcagatttgtggtcggaagctttgcaaagaggggacctgggtctgagtgacatgcgtggccactggtgctcctgcgtttggactgtgcaggcctctcctatgctgatgcgtctccccactcctgagctaatttctgctctgctccttctgtgacatgtggcagcgtgggaaatagccactgtcccctgtccctgctgttcctggtgtcacccagcaccaggccactctgggagccagggcagatggtcctccctgtggtcctggcctctgctgctggcccagtcctccgccttgtgtctcccagcaccaggccgctccgggagccagggcgggtcatcctccctctgttcccagcccctgctgctggccccgtcctctgtgatgctcacggcccttctacgcttgccctcagctgagatcaacgccatcagtgagaacacagagacgctgcgcctgggtccgcatgtcaccaccgagtacgtgggccccagctcggagaggaggcccgaggtgtgcgaacgctcgtgcgaggagctgggaaacatggtccaggagctctcggggctccacgtcctcgtgaaccagctcagcgagaacctcaagagagtggtgggtactcacgcaggggccgcgggggtcatagggcatgggcagctccgccgctggcccatctcagcaggtatcaacattccctggcttggcagtgcctcatgctcgatgtaaaaacccacagttcacaggggaggtgtctgccgggctcctcaggatccttgctcaatattcagcattgttagagggaagttgggtagatcttgggaagtattcccaaggaaaacagtcctgggcacagtctccaaaataaattcttaattttgggaaatttacctccttggtaaatctgtaggtatgagtgtacacacacacacacacatacacacacatacacacacacacacacctgcagaggaaaataattttatttcaaggactgcatgttggcatagctgaagaggcaggacgggaagttcctgtgaggctggcaggagtgaaatgggtttgagcggcacagcgcggccaggaagagagagcgatgcctgcggggctcaggacgggcagctcgcagtttagagaaagggactgaacataatgaggtgctccgggccacggtgccccacaacgtacacatggctaaccagggtgcagtgatgctgactgtcactcgtacccagagggcatgaagtaaatgatgccaggagatggagcccagggcagggagggcggcaggggcaggagtccggggcagggagggcggcgagggcaggagcctggggcagggagggggtcgatggcaggagaccggggcagggagggtggcgagggcaggagcttggctgtatccctgcctgtcgttatggctgctgcctggggacctagttcccaccccagtcccacctggcgtccccagtcgaaggagccccagcgttgctctgcactggtccaggtgtgatgtgagccacgcgatttccgctctccaggaaggcaggtggatggggagccccagaagcccaggcagtgacgaagctgtggctcagaaagccccgtgaggatggaggacaacttccggaacttccacccagggatgagtcaagtcttacttgactttagagctttttaatgaaggaggaactttgtttttcatccacaagcatgatgactaaataggtagtattattgtctacacttaaatgtttcacttgattttccagtcgaatgataaccagtttctctgggagctcattggtggccctcctaagacaaggaacatgtcagcttgctggcaggatggccggttctttgcggaaaatgaaacgtgggtggtggacagctgcaccacgtgtacctgcaaggtgaggccccagaacacggctcttgggggaagaggccaccatcggacacttggcagaacctgactgcctggaaatgccagcgttcagtgctgatgtgtgaaaccggttcagctatgtgaggaaatttcagtgtaagaaacacagaagggccaggaaccgtatttaggacttgaatcaacctctttgtttgcacataaagaaccagagcccagagagggggagcaacctggccagcgtccccagttggttagaaacaggaggaacagagaagccagacatggccctagaccctgcatttaattccatccggttccaacagagcctgaggctcagcagaaacgtttgggggaaatacaagccactgcctgaagtcttacagacagacaatttagcttttaatgttactctatttctgctgacaatggcctcagcattaccttagataacaggagttcctgctgcccgtcttttcttccctccttccaggaagcttggagctctctgttgcatccttgctgctcagtgaagggagaaaggaatggaatggatgcaaagagccatctgggggccctgttcttgttaggctgtcagcactaatgggagaaaaagatgcccttattttcacatctctgtaatgtatggtccgtaggatggaaaacattcagccattctgtcgaccccttctagtctcagcccttgtaccagcgtcccctccttttaaatgagtgttccatgcatgcctttcttcacttgtagaaatttaaaaccatttgccaccaaatcacctgcccgcctgcaacctgcgccagtccatcctttgtggaaggcgaatgctgcccttcctgcctccactgtgagtatcgccagccggcaagcgcatcctgcatttttaggaattccatgcttgtttgtttatttattcattggttggttttggcagagaagagtgaggttcagccccctgagtacaggtgagagaatcagagggccaccccaggccactggtcatccactgaggactgactcatggctagaaaggagtgtggaagccctgggaacgcgggggtgggaaggccagtcctgatgcttctcagacgaggaagctgagcccagtggtcacgcaggtgagcccagagcaggccccgatggagccccagctgagagtcagagaacacacgtagatctgtgactgtgttatggcagcaagtgatcactgtacacacactcctggaaaaaacaatagaaaatcagacaaacaaaaaccaaagactgttatccgaagaatatgttctaagggatagaaatacattctaaggaacagaacctgagatggagaggaaccacgtgtgggcaccctgggggttcctgggccaccctggaaactcagtgcacgttcagagactgagttggccccaacgctgccctcaggtctctgtgctgcctcccacccctgccccgagttcccttcccaagttagctctgctgaccccacccagagctcctgagccatccgtggctccccagtgccgtgccgttggcaaggtgcttcaggtctacaccccaagttgctgctgcactaagatcaggcaacgcttctcccaaactaaactagtcaccatcccccaaacattcccagaatgtccctgtggccccagagctgtgtcatcctcagggcaccttacctctgatgtggacagagaatgaagggactcagagctcacgctctgccactctgtgattttgaataaaatgggatttttctgagtttcaaatttattgcctgtaacatgcagaaaatgtatcccctatacagttagtcttataattaaaaccaacaattcaatatgcgtaaaagtgcctgttaggtattcacaaagtcagaatgctcctggcaaagcataaaaatataatcttgataatcaaagggcccacattagactagaaggagacattttatgttatcaggagcatcatgaccaggaaaagacctccttgaccatttttcttttctttcatttccctgctttctagaacactgagtcatggcgcattcactgggcttctctcctcacgggaatgatttctggcgtcaggttgctctttccccccatttagcggctgtgattacctatgaagaatttctttacagggaatctcctttttattagcttgtttcagtttacttggaaataagtgacctgtaattttcaccaataattgaaatgtttcactacattatgtaaatcagcgaacagaggttaaatggaaatacgttacatttttgtaactttaatgaaacctcatgtagaaaagattcaacactgtctttggcaagctattttataaaatcgattaagagactttcctggacacacatggatttagctcccctcagcaccctaatagtagacccagaaaggcgtttttgctcttctcttgaaaggcagtccctgaactcccgtgcaggtcacaaacttgggtcccacggagccacggcccagccactgggatgtccacctgccccagccaggcagtggcccctcagattcctggatgcatgaactgtggccccacgccagctgccctgtgcccgttctgttctgtggcacgtctgtgaggcagggcctgatgccactgtgtttgcttcctctggcagcggtggacggtgaggagggctggtctccgtgggcagagtggacccagtgctccgtgacgtgtggctctgggacccagcagagaggccggtcctgtgacgtcaccagcaacacctgcttggggccctccatccagacacgggcttgcagtctgagcaagtgtgacacccgcagtgagtgtcgggcaggtgacacccgcgtgcctgtgggggtggggccgcgtttctctcagtcatcgggacctttgcaagggacagagctgccctcacgaggtgctgggcctttgcaaggattctagccaggtgaggctctttctcccagctgatgggaggggttctccttccctctcctcagcagctgtgagatgctcctcagttaataaggcacaccgcttacaggcaaatacccctctaggcggcacagcctgatctctctctgcttcttgtgttagtccggcaggacggcggctggagccactggtcaccttggtcttcatgctctgtgacctgtggagttggcaatatcacacgcatccgtctctgcaactccccagtgccccagatggggggcaagaattgcaaagggagtggccgggagaccaaagcctgccagggcgccccatgcccaagtaagtacggtgaaggcggggccctgggtgggcgggcttgcaggcagctcacagtgagcagccacagctggagccgggatccggggtgtcagggcctgttccagcccagcccagccccagccgagcagcaaagggggctgccatcccgggcctggctcggtaatgaacccatcctttgtgattaattctgctcacctgtgctcagcgcaaacctctctgagatagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagggaggcctggctcgggaagtgcatggatgtgctgagaaaaagagggtgtgcagggattgccttcagctgtgctcacgcctcatgggaactgcctgtgaggacattcggtgtcataccaggcttctgagttgaggccaccctccatggcagagggacagcttggcgaggagctctgagcttctcggtgtaaatggtggtgtggggccgggcacggtggctcatgcctgtaatcccagcactgtgggaggctggggcaggaggattgcttgaggccaggagtttgagagcagcctgggcaacatagcgagaccctctctattaaaaaaattcttttattaaaaagaagaggtggtatgatttgtcttctggaggccaagagatcgcagcaaagccattggaaacactggcttctgagtcactcccggaatccaccattgcagcaggcgtagtggtgcgatcacgctctgacctgtagtcagccaacctggggagaaaccagtttgtggggctgtgtagggaacaccatgtcccacctgctcttccctctcactcagccaactcacgttctccaccccgggtcttgctctgagctccccctggttggctttccccgcagtcgatggccgctggagcccctggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaagaggagctgccccgtgggtgagtgaggggtagaagcgggggcactgaaacccgggcttccattctgatgaaaagcacaaacgctttgggaaactagatgaaaaacacagaaaagaaaaatcaattttagttgcacacgcaaagataactacttttaacatctgtgtttcagtcctcctgtatttctaatgtaaaaacaaaaaagatgccaggtggcgtggcctgtggaatgtgggtagttgtgtggcgtggaatgtggtgtgtgggtaattgtgtggtgtggcctgtggaatgtgggtagttgtgtggcgtggcctgtggaatgtgggcagttgtgtggcatggtatgtggtgtgtgggtagttgtgtggcatggaatgtggagtgtgggtagttgtgtggtgtggaatgtggtgtgtgggtagttgtgtggtgtggcctgtggcatgtgggtagttgtgtggctgggaacatagcatgtagatagttgtgtggtatggaacatggtgtgtgggtagttgcatggtgtggactgtggcatctgggtggttgtgtggtgtggactgtggcatctgggtggttgtgtggtctggaatatgtagttgtgtagtgtgaaacgtggcatgtgagtagctgtgtgttgtgaaacatggtgtgtaggtagttgtgcggtgtggaacatggtgcatgggcagcggtgtggtgtgaaatgtgacacatggtagttgtgtggtctggaacgtggcatgtaggtagtagtgtggtgtgtcaccttgcatgtagttatgtgttgtagaaggtggtgcgtgggcagttgtatggtctggaacatggtacatgggtagttgtgtggtctagaatgtggcatgtaggtagttgtgtggtatagcacctgacgtgtgggcagttgtgtgttgtggaaggtggtgcgtgggcagttgtgtggtctggaatgtggcacatggtagttgtgtggtctggaacatggtgtgtaggtagttgtgtagtgtggaaggtggcgtgtgggtagttgtgtggtctggaacgtggcacataggtagttgtgtggtgtggcacctggggtgtagttgtgtgttgtggaaggtggtgcgtgggcagctgtgtggtctggaacatggcacgtaggtatttgtgtggtgtggaaagtgacgcatgggtagttgtgtggtctggaatgtggtgcataggtagttgtgcagtgtggcacctggggtgtagttgtgtgttgtggaaggtggtgcatgggcagttgtgtggtctggaaggtggcacgtggtagttgtatggtctggaacatggtgtgtgggtagttgtgtagtgtggaaggtggcacgtgggtagttgtgtgatccggaacgtggcgcgtaggtaggtttgtggtgtggcacctgacatgtagttgtgtgttgtggaacctggtgcgtaggcagttgtgtgttgtggaaggtggcgtgtgggtagttgtgtggtgtggcccgtggcgtgtagtcataatgtacacgtgcttctgcaacccgctgcactgtgtccacctgagcaatgcggtcttggagatgatgcctcttgatgatcatccagaatcacaccagagtgttcctgactacacaattcgatgacaaagacatcccagagtgtttgacagcccacagggcgggcttccttctgtgctgcgcagggcgcgtggtgaactctgctccgccttctcccacccagatggctgtttatccaacccctgcttcccgggagcccagtgcagcagcttccccgatgggtcctggtcatgcggctcctgccctgtgggcttcttgggcaatggcacccactgtgaggacctggacgaggtgggtgaccccgccctgggctgtgggcgccctgaggtcgggagcggcctctcatgtctgcttgtccccacagtgtgccctggtccccgacatctgcttctccaccagcaaggtgcctcgctgtgtcaacactcagcctggcttccactgcctgccctgcccgccccgatacagagggaaccagcccgtcggggtcggcctggaagcagccaagacggaaaagcaagtacgcaaggccggccttccttgtgtgttgcgagcggctttggaaaaatcagatgagctcagaaaagcagcaggaggaaggagaggaaggggtggcgtggcccgggagaggcatgggaggggctggcccggggaagctgagcacctgctcggctgggccgctgctctccgcgcggggtgcggggcgtgctcagccgggcctgtgagggtcaggccgccacctctccgctgttagcgcagcccttggtgagctgcagccgaggctcagaaacgatggctgagtcacaaacggagcctcaggaacgaacagcacctcaagtgcgtgtccagaaagcccttcccacttcaggacttgggtccgcttgggaccggacctgctggggcctgcggtgcccgacgccccgcctcgacgcctccggagccatcgtcctgcctgtcgctaaccccgcagcccttctccccgtaggtgtgtgagcccgaaaacccatgcaaggacaagacacacaactgccacaagcacgcggagtgcatctacctgggccacttcagcgaccccatgtacaagtgcgagtgccagacaggctacgcgggcgacgggctcatctgcggggaggactcggacctggacggctggcccaacctcaatctggtctgcgccaccaacgccacctaccactgcatcaaggtgaggcgcggggctcgcagggcacacggggccacggcggtcagccctcctcctggcgccggggacgctacgcggacgggcggcgggggcagcacagggaatttggaaggagggtctctcaggcctcttgcctgatcaccaggttgaatgcatccccctggtcccctctctggaggtccttagtagacacaggcacactctggcgccgcccactgctgggcacagagaacctcgggcacgtcggcccatatttgcaattgcgcgcatcgttaacgcctgaaactgagcagagggaggacgccggctccacgctcggctccaggctgtgcagaggccattgtgtctcaggcaggtctggccaggctatgtcacttggaaagagttaggacatggttttcttcccaaagcccaagcgtgttgcagtataaggagctgctcagctggaagaaggagctccttcggggcccatcccaggctggactgctttcctgtggccgctggaacgaacaccacggcccgggaggctcacaacaacaggaatctgttatctcacagctctggaggcctgaaacacaacgtcaaggtgctagcggggccgtgctccctctgcttctcccagcttctctggctcaggcgtcgctgggcttctggcgctggtggctgcatggccctgacctctggtcggcttcacaccactttctccagtgcctttctctccggaaacttcctctgcctctctttgataagaacacctgtggttgtatttagggcccacccagataatccaggatgagcctcactgttcaatgtccttgacctaattccacttgttaccatacaagatgaaattcacttcagccatatcaggtgacatccccgggcgccaagacactaggacgcggacatccatcgtggggactgccactcagtccaccgcacagggtgccccaaaatgttttagtgcagttttatgccttaagaaggtcagacatggaaatgccacaaactgacacaaaatatcatttgaaaatataaatatattcatttatttaatatttaatcattcttgcaaattttgtgttaattttctctgtcagtcccgcttgattaaagatgccaaatactcactgaaacaaaatatgagtatgttttaaaatcaacgaggcactgatcccaacctatgttacaccccttggctacccagcctacccttcttgaagcccctgatttcagaaggtcagctgcagctgagtccgtgctgctagaagatatcccgattattctttccatcattgtggaattttagatggaaatttaataacttcgaaaatggtatataatttgcaaagttatatgtatatatacacatacacaaaaggatttaaaagtgagacttgacaagggacccctgtgcccgttcccatattaacccgacacacaggtgctggatcctccccattgccaggggcccccgtctgggatccgtgtcctccatgacaagcaacatgctctcctttcttaatctgtaagtgctgaaactctgggctccagcacaagaccccaggttctgtcttctgattcaacgagtgatgtgctttgagccacggggatgacacacccttggggctcttgtactgaaactgaaacggacacgctactctctaccttttcctggatttccaattccctcaagttgttagtgtctgcacagctcagctttaaattatggtataattggactgaaatgaaaggagttttttgcccaattacatgcattacccactcaccgtgaaaagctgagttagcagataatttcaagttctcagccctggtttctgaacatatcacatacatatttgaaagactcttttctttgagattttttgactggtgagggttaaacgtttataagctttggcattttgatttatgagctgaagtctgtgggaaggaaagcaccactaaagcctcttttctctcccatgttctctcagagcaataccttgtcattctcttcttgtttctgcagttgtttggcaacctcactgggattctgggctccgaacacaagtttcttttgtctccctcgtgagtagtggtgacataatttccagggcaggagttgagaagaaattcatgcgcttctggcctcctggctcctctctgagctcccgcttgagatcgaggactgatggggcacgcttccttcctcggcgccatgctggtttcatttcacctgcattcctgaaagaggcgctttcctaaatgtttttccaagtattcttccttctctaattgcaggataactgcccccatctgccaaattctgggcaggaagactttgacaaggacgggattggcgatgcctgtgatgatgacgatgacaatgacggtgtgaccgatgagaaggtaggagcagcttgtgccgcgcacctgccctgggttccaggagcagcgaggtccacaggaggccactttataccaaacagcccttgtcaacgtaactgccattgtcctgcaagcgtttgtgcataggcagttcccaaaggtcactataaagacagtcctttgcaaaagcggattttacctcagtgcatggggctgcccagggtgtgctgccggaaatgttttgaataattttttctattttaactgcaaaaaaatagaagacctcctctccttctgctgaggagccagtgatgggcaaggctgacaccaccatgagtgatagacttgcctttatggcaacatttaaaatattaccatttttctaagaaaattgctgcaaacacaaatggtttaatgtatttgtacacaaaacagctctagcaagaatagatcaagattttactcactgcttttttacatctgactttgatgggagacattgactcactaatccattcatttatttgatatttacatatctctcctcaccatgaagtgtatgatataccatttttgccttagcaatctacaaattttcaacaaaagacagatgcataaataatgataaaatgatttgatatggaaaaagtgtttggcgagggctaactctttttttttttttttttggtcgctcaggcttgagtgcaatggcatgatcttggctcactgcaatctccatcttctgggttcaagcgattctcttgcctcagtctcctgagtaactggcattacaggcgcacaccaccacgcccggctcatttttgtatttttaggagagatggggtttcaccatgttggccaggctggtctcgaactcctgacctcaggtgacccgcctgccttggcctcccaaagtgctgggattaatggtgtgagccactgtgcccgggcctaactggctttttaaagcactgggattaaaggtgtgagccactgcgcccggccctggtcttgaactcctgacctcaggtgatccgcccgcctcagcctcccatagtgctgggattaaaggtgtgagcctccgtgccctgccctgactggctttttgaagtgctgggattacaggtgtgagccacagtgcccagctgtgattaaaggtgtgagccaccgtccagccctaactggcttttgtgtttgtttgatttctatattgattttcatcaaccttgagtacataacttataagtgctaaacggcccgacacacattcctatgatcttcgttaaagtcttccctttcttggttttccaggacaactgccagctcctcttcaatccccgccaggctgactatgacaaggatgaggttggggaccgctgtgacaactgcccttacgtgcacaaccctgcccagatcgacacagacaacaatggagagggtgacgcctgctccgtggacattgatggggacggtgggtgcttctgctccttcccatgcgtgcacttttttttttttttgagatggagtttcactattgttgcccagggcagtagcaccatcttggctcactgcgatctccaccttttgggttcaagtgagtctcctgcttcagcctcctgagtagctgggatcacaggtgcacaccaccacgcctagctaattttgtattttaagtagagacgaggtttcaccatgttggccaggctggtctcaagctcctgacctcaagtgatccgcctgccttggcctcccaaagtgctgggattacaggcgtgagccaccgcgcccggcccaatgcatgcattttaagggtcgcaattggaggcattggcaagtttcatgttttattctgaattttgataagctcctttcatttttacactactataagattaaatgattcattcagttattcccatagggacccatgcttattctgccttgccttttcctgaaggtcaggggacaccagccacaggaccgccctagagaaagctatgcatttggtatcctcctctctctgaccccagccttgcagtcctgggcctcgtgcttcttcatggcatcttttctaatgttcacccttcattcaaaaattccaagaagccatttcatgttttcatcaaactgagcttctaggagttagaataacgtgggtgtattgtggttacctctgccactgatcccggttgctgctttatccggagagttcgctggccttggtaagcgagctctgcaacccagtgccactgtcaccgcatggtcatcccttctcttggggtgcctggagaccaggcgagtgcttctgtagaaccagcaagagctgggggcaggctcgcctccacgctggagctcggccccagctcctccacacttcgcctcgtggggtcctcttcccagcccggcgccagccaccccctttctgagccaccccaacctgctgttctgtctcacagcgggtttctcagtctgatcttttccactgatttctgcctccaccctcctctcgttctctgggaatgtggtgggttgctgtctgagggctcgtggtggccagggggctcctcggctccccatccaggatggcgtctgtgatgtgctggatgcagatctcaagctccagtcccttccatttttattttttaggtgttccttacttcccttctccagacctcacctgaccaaagcaaggcgagcgtctcagctcagttctggctcttcctgtggactcgctgccgtgtaacattttgctctgtcatttgtgacactgtcactgatggtattgtttagttcagtgctagtttatatttttgtaacttcagtatcaatgcaactcatcactttcagatttcttaagataagatatgacatctaaaaaccctgccactctctgccattgtttttttcctactcatgtgcatggatgataaactcctgggaactcaacacatactttccaagtgggtattagggagaaataagcaatttagcaagctcagatttacacggcgacagcacattcaactacccctcctgcaacattacccagaaatctccaaaagttggttctatttcaaatgaaaggtatttgaactgtaatgaaatatgtcatatgttcttctaaaatctaatagtctttatattttactatattcttaggcgtctttttattataattaaatagaagtgtggctgtaagcaatttcgtgtgataggaaaaacaatgtgctttttctaaactcacctgtccttctggtttgtttttgttttcttccccctttaaacacttacagatgtcttcaatgaacgagacaattgtccctacgtctacaacactgaccagagggacacggatggtgacggtgtgggggatcactgtgacaactgccccctggtgcacaaccctgaccaggtgagggcagccgcagacaggcggggttggaggtcctcatcagagggacgcggggacggtggcggtgtgggggatcactgtgacaactgcccctggtgcacaaccctgaccagatgagggcagccatgggcaggcgggtctcaggtcctcatcagtcccctccatggggccttgggagttttccatgagctccacaaagacaggataacatggagttttcaatgatttcaattgaaaacatttattcaactcaaatctcagcactattcttgtatctcagtggccacaggccaaatgaatagacgccttcacctcatcagctggagcgaggttgtgtcttcacagaattctctccccattttcctgatgccaacataggaattggcttcatttccaggtttgcgtttgaaagagacaagggaggacagttatcttgatgcagctcataggatatattatcctatgatgtaaatggtgtaaatggcgcaaatggtgtaaaaaagagacataattacctggtagttcatgcttttccagcgaagaagcacatcttcctttagtgaagtgaattactgtggagaggtggcagagggtggagagattcctggaccgagaggcctggccccagtgcttgtcctgacgtcagggtcagtgtgacctcgggccagccgcccctgcgtggccctggggcttgtgctgcaggacgaggaggccggctctcaggcttgcgtcctgctggttcctctccacctcctcaaactggcagtcctctgctgtttctctcacgccccatcccctagaccgacgtggacaatgaccttgttggggaccagtgtgacaacaacgaggacatagatgacgacggccaccagaacaaccaggacaactgcccctacatctccaacgccaaccaggctgaccatgacagagacggccagggcgacgcctgtgaccctgatgatgacaacgatggcgtccccgatgacagggacaactgccggcttgtgttcaacccagaccaggaggacttggacggtgggtgctctctcagctcatgggcgtggaggaaaatggcttctgagcaacccgccagggcagagatatgtatgcacggagatcatcttaaatctgctgctggaaaaagggcaatgactttgggcctcttaaagctgtgggtccatgcaatatgagtttcttctcccctgacactcaacacattcttggctgtgtgtgtgcccttcaacaggtgtgctgcctcaagtgtgtgtgcacgtcgggaggaggagaaatccctgcctccatataacttccagattgttgacgatctcctagaaagaatgcgggttacgaacgtaggatgaattgggaatttggtgtatggggccaggcaggggacaaggaggatttttttgaaagcaaagccaacaaaagtggcacgagtgtgaagcatgagaggaagagctgctttgctcagcagtgagcatgaataggtggcccatagccacgggggcccaaggaaggagctggatgggctgcagtcctctaagtcagcgtccctgagtaataaacaagggcacagctgtgctctggggcttccggggaggctgtgagaaagtggccctcacttggagtggggcctggctgacacaggctctctttggaagccacgtccttgacagagggagataaggacttgaggggcatctgagacagcatgactcagaagtacgtgggagatgctgggatcagaagggcagctcctgtgttctccccgagcagcatgaagggatggagtgagcacagcaagcctcatctggactccgtgttcgggcatgcaggggcttgctccccatgcagcctttccccagggagggactgggacagagagaagctgataggcagagcagcatttcagcatttcagaatgccctgataccaactatgtgcctgccacgtggtagctggagtatgttcttgaacagaacggaaactagttgaagaatatgatgagatattcaatccaacttgcctttcctccaaaacggcaggccacgtgatagctaattcagtacattgcaatctgcctgtcaggttatcgtcatcgccgtagactgatagactggacacatgtggcaaattcgtggtccccctgtttgcaccaggcccacctcatccccactccccaccatgccacaaccccgctgaaaacttgacaaggacccactaaacagcggaagtccatgtctccctaggaaaaaccattttagtgtgagttccgctttaatgccaaatagactataaaaggcaaggatgactaagaaaagtaataacagacattcagaaaactatccaaacacaaagctggaaatgcaggttgatattacttgacagccattcaggttttatacctgcagcattgagtttggaacacggtgagaaatggctttatgtgaatttgctgtgctggcctttgctgtgtatttatcacaaaaattttgtgaaaagagttgaggttcctgtgaagtcaaatgttttggagattgttgagcacgaatccacaaaacactgcaaagcactcagtcttagatgttctgggaaagatgcactcatgtttctcagacacggaaaagcaaatggcaaaccaccgaccaccgactttgcttctttgtttttgtttttgtttttgcttgttctttgtgcataggtgatggacggggtgatatttgtaaagatgattttgacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggaccccggcatcgctgtaggtgagtctctgagacacggcggtggtgccagcatttctccgggggaggcgcccacagaagatgcagactgcactttaagatcatgcaggtgggatgccatgtggtctttctggaagcccccatccttccatggtctgtgaaactgtctgcctaaataaccttgacaggtacatgcacctgccgctctgaagtctctgaaatttcagtaaaccattttattttatagacttggtctatgaaatgggacctcataatcctctcagaactcttgtaagttggatctaaaagaaataccttcaattccactaatctcatggtaaaagagcccatcgggatgatgaggggagcccgccctgcctgctgggcatccactgtcagatggtcacagggccaagctggggattgcctgaaacctgtttcttttttttttcttttttttctttttttttttgagatggagtcttgctcttgtcccccaggctggagtatagtggtacaatctcagttcactgcaaccttttttccccggttcaagtgattctcctgcctcagcctcctgagtagctgggattacaggtacccaccaccatgcccggctaatttttgcatttttagtagagacaaggtttcaccatattggtcagaccagtctcgaactcttgacctcaggtgatctgcccacctcggcctctcaaagtgctgggattacaggcatgagtcactactcccggccacctgaaaggtgtttctaacgaaaccttatggcgttgcatccaggttttgacgagtttgggtctgtggacttcagtggcacattctacgtaaacactgaccgggacgacgactatgccggcttcgtctttggttaccagtcaagcagccgcttctatgtggtgatgtggaagcaggtgacgcagacctactgggaggaccagcccacgcgggcctatggctactccggcgtgtccctcaaggtggtgaactccaccacggggacgggcgagcacctgaggaacgcgctgtggcacacggggaacacgccggggcaggtgaggttggctggccaggcccacacatctcctctgcaccactgtggctgcagagtgtttcagcaggactagcccagtccagagaccccacttttgtctttattaattttaactccaggcacagttattttaataatcttactttattatagacactgtgcctggggttacaactcaacacagttgataattaccagttaaatacagttgctaatccttttacaaattaaacctcttttaccctcttctggagatagggagtgagcataggacataatgatcaaagatataatatgaaaaaaatattttaaaaattgaagctagggagaattgaatatcaaaacttcaagaattttgcccaacatcccatatcaaggaaagagaagatccagacatgaacccaggaatctgaggatcaggtgcctgggctcttcaatccaggaatctgagggtcaggtgcctaggctctcagccctgagccacactctgtccatgggcttcaatccacagtagagatttggatgataaacacatcagagagatatggagcaccatgagccttaagcatgaacttgcaaagtcatgtttttgcttcctgcttggtgttacagagctgtggttaaggctccgggtgcccatggcactcaagagtgctatgttctctctcaggtgcgaaccttatggcacgaccccaggaacattggctggaaggactacacggcctataggtggcacctgactcacaggcccaagactggctacatcaggtgagggcaggtcagcacagctgcatttcttccaaggggcttcccatcggacggcacatttgaacattaatagacaaataagctcaagtgaattctaactttttgttttactctggattcttcgtcattaactgctttctcttttctatcctgcatctctactaaatattaagtatttttaaaaaatggttgaaaaggagaatatacaatctgctttgttttgggatgataaccatattttctcctaatgaataccccaggcaggggagaacacctgcaattaaaataactgcatctttgcagaattagcatgtgctttattggagactagatttgtacctgatataaatggctgaatttaaaacacggttgtatgaagttttgacacggttagcccaacagaatcttttcccttggcttaacagtatttataattgatttttattcaaacaaaatgtggtcaatttaaaatcaaggtgtttttgttttttcaaagttaataagcaccaagatcaggctggactctgcacagatgccaggagtgtgtgagtccctggcaatagagggcagatctgtgtgggtgaagtgcaggctcgtggcctcgctggaacgtttccctagggggcctcctgtttattcatattgatgccccatcctcctgtcgggggcttggtgtatccagtcctgctcccacgcagcttccacagtggggaggagagccggtgagctcatggttttagcacaaggtgaagtagggagagtccggtgcatcttcccaggaagtgggaagcttcctcctcaccccaccaaaggtagagtctcctctaaagcccttgcctgggtgactgtaagtgaactcacagattgtgacaatagtgtggttgcaagaaggaaggcgtgccctggatcagtgctgcaccaggggtggctggagctccaaaggagaaagccagcaatgccccctggggcactgaagccctgggcggagtatccacagcttgtgtccggagccaaccttccatcactggtgaatgcttcacagagttcatgttgtctttctttcctcttcttctttttaaacaccatttttagagtcttagtgcatgaaggaaaacaggtcatggcagactcaggacctatctatgaccaaacctacgctggcgggcggctgggtctatttgtcttctctcaagaaatggtctatttctcagacctcaagtacgaatgcagaggtgagtgtgagcacttcaggttagtggggaaggcatgtggcacccagaaagggaaaggggtacacagtgcgctcttccacttacaaaagctgtacatcagggcaataaacctaatgcacaataccacacatgagccccctgcacattccaagcagccatttcatttggtcagcttggattgttttgtttttaattgcatttggatgcctctggtagaacactttccaattatttacaggtcccacccatcctcattgtgccatagcctagagtttcctagatttcctccacttccaggctcctgacgccattttagattggtacccttgcattagcaatggcaggcaggcaggaaggaaggaaggaaagaaggaaggaaggagtttctctatagttatctcgctacaggtatatttgaatcaaaatattatagacctggaagataacttgaattccatctgctctaattccatgccttcaaatgcgcattacccttccacagatgcagtaaataaggctcaggatgcttctcaagaatcacacattgaaaatcatgtgtttggctgggggcagtggctcatgcctgtaatcctagccctttgggaggccaaggcgggtggatcccctgaggtcaggagttcgagaccagcctggccaacagggcaaaaccctgttggggttgatttatctgcttgcttctgtggaggttttcttctccttatgttaggatgtctttcaaggcatctcatttcctcccatccatccatatcattcatccacccacccatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccatggcccagttatgctaattgtttattgcttttttttttctttttgtagatatttaaacaagatttgctgcatttccggcaatgccctgtgcatgccatggtccctagacacctcagttcattgtggtccttgtggcttctctctctagcagcacctcctgtcccttgaccttaactctgatggttcttcacctcctgccagcaaccccaaacccaagtgccttcagaggataaatatcaatggaactcagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattagagttgctctacaatgacacacaaatcccgttaaataaattataaacaagggtcaattcaaatttgaagtaatgttttagtaaggagagattagaagacaacaggcatagcaaatgacataagctaccgattaactaatcggaacatgtaaaacagttacaaaaataaacgaactctcctcttgtcctacaatgaaagccctcatgtgcagtagagatgcagtttcatcaaagaacaaacatccttgcaaatgggtgtgacgcggttccagatgtggatttggcaaaacctcatttaagtaaaaggttagcagagcaaagtgcggtgctttagctgctgcttgtgccgttgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctgatttgatgatacatttcattaaggttccagttataaatattttgttaatatttattaagtgactatagaatgcaactccatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaaatatataatgttgccagcgattttagttcaatatttgttactgttatctatctgctgtatatggaattcttttaattcaaacgctgaaaagaatcagcatttagtcttgccaggcacacccaataatcagtcatgtgtaatatgcacaagtttgtttttgtttttgttttttttgttggttggtttgtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacaatccataactttagtcttaatgtacacattgcattttgataaaattaattttgttgtttcctttgaggttgatcgttgtgttgttgttttgctgcactttttacttttttgcgtgtggagctgtattcccgagaccaacgaagcgttgggatacttcattaaatgtagcgactgtcaacagcgtgcaggttttctgtttctgtgttgtggggtcaaccgtacaatggtgtgggagtgacgatgatgtgagtatttagaatgtaccatattttttgtaaattatttatgtttttctaaacaaatttatcgtataggttgatgaaacgtcatgtgttttgccaaagactgtaaatatttatttatgtgttcacatggtcaaaatttcaccactgaaaccctgcacttagctagaacctcatttttaaagattaacaacaggaaaataaattgtaaaaaaggttttctatacatgatctctctcccttttttaaaaagaactagcagggtttctaccgggggggaaaggggtagaaggaattggcattttgcttcctgtcatgtaagtaggcctgtggtgtgatcacgggctatctcctcgcaagtcacaggttaaaatgcaggctgaagggcctggtggagaaggaagccctgcttgacacaggtctctgttctgctgagcctcccagcacggtgtgggatacaaccatttagcaattcatctctcctgcctctgctcattgtcaaacgagggaacagaacttcgtagggaatttggcaaacatgattgaaatgattccgaaaaaggcaacagcacacgggaccctctccctaatacgagctgttcttccctcttgactcattcttctgagtcaggtggagggaagtagcggaccccagaggaagggcccatttccaaccacagcactgcctaaaaatgggccgatcgggctcaccagttggaggaggcaatggcagcagcacagaacgctggggtttctttagcagctccagctgctcttgttgggatttctgaatattatgcaggcagacacagagaagaaaaacagggagagagggagagagggcatccagagagaaaggggaagagagggagggagagagggagagagggcatccagagagaaaggggaagagagggagggagagagggagagagggcatccagagagaaaggggaagagagggagggagagagggagagagggcatccagagagaggggaagagagggagggagagagggagagagggcatccagagagaaaggggaagagagggagggatgggggagagagaaagagacaaagagacagagggaaagagggggagttgggggagggaggaaaaagagagcaagatgaataaaaacaagtatacttggctgaaacacgctggagtgagtcagacagtgaagcaataagatataggaaaggccgtctgaggcaacgggctgtgaactgaaggccctggctttgagttgtgaaatgagtgagttttagttcatcaatatggaggaaaaagctagacctacatgtgtaaaaagaaaagtttagaaacaaaataatgatggcagtgatagtggctggtctatggacagctactggaggaagctcaatgtacattttactcatgaaacaaaaaatacatataatatgttgaataaggatgcttagaagtcaggcattaaaatgagctacatttctcgtgcattcaggttttgctgtcatttatcgaaaagttgaggtttcctgacaatcatgttccctgtcgatggccttagccacatcagaatggttgtctcccaggattaatgtgtggtgcctttgtgagctcacctgggaggaaggtgtccctggacctcgatgactccgtgcgagcacctgccctgtggccctccatctcccttctgcgaatcgctgccagcacaccacgggagctccgcaccttccaccgtggaccgggagggccgtcgttctagacgctgatgctgctgctcacagggaaaggttcggcccaggcccacgctctgagagttgtctgtacaaggctcaaccaactcgccctcagggcaggcacaggccttggtcgtgtggaacgagtcggtgggtgaaataacacatcttcactcccaagtatccaagcgtgggatctgtgattgccgggaggagagaagccttcataccgtgaccaactcactggctgctgcgtgtcccagctataggctacatgggggcagagggctccttccgtcattcctggaggaccaaaatcttaggccagctttgctcagtctgcgtttcacaaagtgatgcttttgaccatggagcaagtggtgcctaggccttgaggaacgcaggtgtggggtgatccaggagctgccactccagctccacggccacagccctgtgggctgccaatgcccaaatgggagggccctgctgagggctat

SEQ ID NO: 16984 - DNA, 8746 bp, Human
tgccacaggcctgcccagtctctaaagacaagacatccaaatcccccaatagaactagttgtcttgtccataaagtgagactaatattgtgggcgctacttatctacttagcaccttggactggtgaggactgtggtgcacaagctaccttacaaatgtaccacactgagtaacatctttaaacctccttgcagctccagggctagccttctcctttgcggagccctcccccacctccggcctcctagagcttcaggccatgttcccctgtcccctgtgaatctcagcatgctacctgaagcatttcacctgaaaaggccacacagggaggaggcgaagcgcagcaggaatgaaatagtcaactgctgtggagttggaaatgttgctgcatcccaccattgactggatggggcctcactcccccaatacaaattattttacgtttgcttctcccaagatcatgtgtaaggccgggcgcggtagctcatgcctgtaatcccagcactttgggaggccgaggcgggtggatcatgaggtcaggaatttgagaccagactgaccaacatggtgaaaccctgtctctactgaaaatacaaaaattagccgggcgttgtggcgggcgcctgtaatcccagctactcaggaggttgaggcaggagaatgaggcaggagaatcacttgaacccaggaggtggaggttgcagtgagccaagatcgtgccattgcactccagcccgggtaacagagggagactctgtcgcaaaaaaaaaaaaaaaaaaaaaaaaatcatgtgtagaagtaaataacacctcttcccagcacctgtggatccatggcattcacacaggtaggcactgacgctgaaatggcctcagatgctaccaattctttctgccgaggcctaaatccaataaacagagatggatggaaacaactatctaataaaagtttcgcatttgtgtgcctggcaacattaagtaaccgtcaggctttcctttagaaattggaattaaatgcgatttagaaactattaacgactttgggcgtatttaataacacatgaaataacccggaggattgaaatgttaggtgaggcgactccggctcatagacgcgcctctccatctggggcgtctggcacttagtggaaccactcaataaacacgtttacccctgcaagcggcacatcagagtccgggggtaattctcggtgtcgtggggccaggacggcgaggggctggaagaggccgccctgtgggagctgggaggctgagataaattcccgtgattgggggctgaaatggcctcccatgccggactgccgtggttctagaactttttcctggaacaggccggcactcccactggagagtcccagctgctgcgcctctggccgcccctcccctctcccgggcacctggcgccggctcccgcgtcctttcaggaattcacgtccgcctggaatttgcacttcaagtctggagcccccaaggaacccctcctgaccctgaacttctatctcagtttcaagcttcctagtcttccccccacacacacacctagctcctcaggcggagagcacccctttcttggccacccgggtatcccccagggggagtacggggctcaaaacacccttctggaaaaacaaaggtggaagcaaatttcaggaagtaaaacttcctgaaataaaataaaatatcgaatgccttgagacccatacattttcaggttttcctaattaaagcaattactttccaccacccctccaacctggaatcaccaacttgattagagaaactgatttttcttttttctttttttttcccaaaagagtacctctgatcattttagcctgcaactaatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacaggtatgagctaatcttgaatgtgaactttttttgattgctagagattgccagcttaggaagtaatgttctacacctgtcatttgatttttctcttgctcaagccttaaaagagctgccaaccgcactgctgtttttcctgaaagacctggaatttcacatggttacttctaactttgccattggcttttaacattttcgtgttaatgttaattttcattttatgttaatgactctgcctatgaaatagtgtttctttattcttgtacaaataaaggtcagtactacaaccaaatttaaaatcttccgaaaagattaaaggtataagcagattcaatacttggcaaaactattaagataatagcaaaaaaaaaaaaaaaacccacattttttacctaaaaaccttttaagtgattggttaaaatagtttggccgggtgcggtggctcacgcctgtaatcctagcactttgggaggcagaggcgggtggatcacctgaggtcaggagaccagcctggccaacatggcaaaaccccgtctctattaaaaatacaaaaattagccaagcatggtggcgggcacctgtaatcccagctactctggaggctgaggcaggagaattgcttgaactggggaggggaggcagtgagccgagatcgcaccattgcactccagcctgggtgaaaaaccgaaactccctctcaaaaataaataaataaatacagtagtttgtaaaatgattcatcggtaacatgggatgcagctattttttaatccttatatgaaaattgtatgcaggggaaaacatgtgaaatagaagataaaagacatatacctacttaaaattaggtacttatgtgaggacagggcctaagaaataataatatatattaaaaagacttggatattggtgactttttttcaacatttttctttgttacatgaattagccattaaaaaaagaaagatggtgctctacaatttcttttcagtgatctgtggtcttgtccttgtgatgagaggacctgggtgttaacttgtaaggttttatttcctttgtttggctaactcatgtctgacttcctcttcctagtgtgatttggatcatggccatttctaaagcctttgaactgggattagttgccggtgagagaccttttgttcttttgatcactctcaatttttatgtggcctaaaatacagactccatgaattgattttgtcgttaagggctgggccatcaggaatttgctcgtccatctcggggatacctggccttcagagatgacagcatttggccccaggaggagcctgcaattcggcctcggtcttcccagcgtgtgccgcccatggggatacagcacagtaagaactgcctgacttcgatgcttctgccctggcccttcatgtgtctcctgagtatctttccaacactctttcacctaaaagggcacctggttctggaactgtgcaggtgctggactgcttttggttttggaagtgagacaaggattgtgtattttacttccctagagtgcagttttcctcccctgagtccacttcacactggggaacccagaaccaccactggcctatgcatgaaaatgacttctctgctcaaaggcacagagtcttactctgatacaacacattggtgttgtattaaccttcgcttacaggaattgcccttgcacttttccatccctacaccctcagtcatctgttcttacctttcaggtaaggagctaaacagaacctgctgcctgaatgggggaacctgcatgctggggtccttttgtgcctgccctccctccttctacggacggaactgtgagcacgatgtgcgcaaagagtaagcaattcagaggggcggggagccgtggagaggagagagaaagggaagtggaaatttcagacccaaggctatcgccttacctgttcattctcaggaactgtgggtctgtgccccatgacacctggctgcccaagaagtgttccctgtgtaaatgctggcacggtcagctccgctgctttcctcaggcatttctacccggctgtggtaagcggaggttctcctctttcttttgccctttgaagttacgtagttgccttggggggtgcttagttagcaggctctccttgtacctcttgtcttgctagagcctggcagccaaagttctgcttataaaagcatcgcagactcctgatgagatagttgccttggcctctttgatatttatttcctcgggaacctggctagtcctgctgcctttcagatagagatgtatttcaagtctatttgacattttatggtctgaacttctattgaggaaaataaacaagtctcggtctcttgttaaaccaagagatgttctctggtgttcctttcctttgggtagggggacccaaaccaggatgggcagctcatttagagcccaccctgacgacaaattctatcagaggcttggccccttgctagtcctttagaaacttccagagtcctaaaagtccctggtaaccccctccccataccttaccatgactggtcacagaacccttaccatgactggtcacagaaccctttcaccttcttgatttttactgatttgaggaatacaatgaaaagaagggcagcacctggagaggaaaagaggcgacagtcctctctccaccctagcctgagccaggtttctagggccccccaaattcagagacctattatagttctgggccttggagatgttagaaatggaaaatattcaagtccaggaagtaaatgaaagcaaacatttcactgagaacaggaaggaattccccaatccagacagggattgtgtctttgccatttgcatcctgggtgtcaggctcaggataggtgtttgataagtgtgggttgggtgattggatgtgtagggaacatgttctcttcctggaacatggggcccaatcagaatctaaccaggttgtgctcattcctgcaagtgaaggcatcaccactgggctaggttccaggtgtgagtgtcctgagaagagcaggttcacagtagcgtatagatatgccacatttgtgggcagcaggatgaactgccagagaggtttgctttaatgaccaagcatccctaccttccagatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaatgtgaactggttatttctaggtggtgaggtgctttatggtggtgggtttttgctcttgatgccctttttgcattttccaaagtaccatggtgaggatgtgttatatcttttccagggtcctaaaagtccctggcaactccctccccataccctaccatgactggtcacagaaccctttcaccttattgatttgtactgatttcatatggaatatggcaactacatctggctcaaaacaaaggaaaccagaagagccaagtcccaggtgagtgctcagttctgtttctagctttgacgtgtgtgttcttctgtgaaggacaaaatttgcttctattatttaggtaccataatttgtgtttttccaaattaattccctgcagatgcaaactgccaaataggtgacattttttacaatgcccaatggaaagaaagtaaaatggaataagcaggaagcagtgaggtgtaccagaaagcacaaaatcaggaggtagacaggctgaatttggaaggtggtctggccacttactgacagtgggacccagcttcctaatctgaatctggattagtgcctacatcacagtattagaactaagtgacataaaatagttaaatagttaaaacatttatacaaaatagattctcaataaatgtcacattttcttctctttttacctgcatatttaccgcagagggtttaaaaacatttttggggccagaaatagaatttatttttttctgagacagggtttcatgcttccgccaggctggactgcagtggtgcattcagagcagtcttgactgcagccttgactgcctgagctcaagcactcctgccacctcagtctcccaagtagctgggaccacaggagcacaccaccacacccagctaattttgcttattttttacagagatgggttcttgatttaagccacgtcatctgtgcttatgcttttctttatatcaacttatttttattgtggtaaaatatacataacatttaccattttaatcatttgtaagttcagtagcatttaagtacatttgcattgttgtgcaacagtcaccaccatctatttccaaaactttttcatcatcccaagctgaaactctacctattaaacattaactacccctttgcccttccccaggccctcggtaaccacacttactttgtctctgaatttgactgttctggatacctccagtagggggagttatacgctatttgtctttttgtgtcacatcgtgtcttcaaggttcatccatgttgtagcatgtgtcaaacttttttttttttttttttgagacagggtctcgctctgtcgcccaggctggagtgcagtggcgccatctctgctcactgcaagctccgcctcccgggttcacgccattctcctgcctcagcctcccaagtagctgggactacaggcgcccgccaccatgcccggctaactttttggggttttgttgttgttgctgttgttgttttagtagagacgggatttcaccgtgttggctaggatggtctcgatctcctgaccttgtgatccgcccacctcggcctcccaaagtgctgggattacaggcgtgagccaccatgcccagccaatgggtgctgttttaaaggcctgacatcagagaatggtttacttatcagagctcagcctccaccatggaatattacatcacctttaaaaaatcatctttagaaaggatttttaatgctctggagaaatacttaagatactatgtcaggtgttaaagggagaagacagtatggtctcaactagaattcttaaaaggtaagaaacataaaaacattaaagcggtcagttctgaataggataattatgggtaatttaacaaaaaattttttaaacaacaatagcatgttaaataaaagaaaattagaggccaggcatggtggctcacgcctgtaatcccagcactttgggaaaaggccgaggtggatggatcacttgaggtcaggagttttgagaccagc

SEQ ID NO: 16985 - DNA, 8351 bp, Human
  misc_feature (1)...(8351): n = A,T,C or G
caaagaaggggagaaggatttcaattccaatcccatgacccttccttttcctggcagtggcctgcaggaaggctcttgacagcacgacagtcgcggctcatgagtcggagatctactgcaaggtgtgctatgggcgcagatatggccccaaagggatcgggtatggacaaggcgctggctgtctcagcacagacacgggcgagcatctcggcctgcagttccaacagtgagttactgccctgctcccccttgcctgttaaagtctccaattatcaggacagttcatttcgttcccatagcaacgttttctggaagtgggagaatggactctattgttgacttgccaacaataggaatactcagtctgaccaagtttgaacaatgtgtcatctctccaaagactctctttaaattatttgccattctaaagggcaattacttttacaccatggctcttggtttgcatgtcaagagaaaacccaggatgtacagatgttccattgtttgacctttgcaaaactgcatggagtctcctttcttccccgttgagagtttctgtgtaaatcacacaaatatggcagggcagcaatggccattctttgtgtgcctgtcatgaaaagatttcttcccttggattgtaagatgacaaacgtccacatggcagggggagtgtgtctgcaaggatgggctgtgcctcagagtaaacaatcaatcatgatttttctgggggttccctggctgcctgttgccaatacagtgctagagttcccgccacattatcctagggaagctgggacatcactctggccacctccatccaccagtctggtcccctgggtccactttcttgataaccacattgacctccagcccagaattgaggaaagtctgatggccactggcctgacactactctctggccagctggcctccaggctgagctctgcactgcgactggccagaaaggcccagcccaaccaaggaagtgtcccatggagggcctcccccagagagcacttcagccatctgaggaatcagctgatcccttcaaaagagagtaagccacaggagagcatggaaacgtggagagatgtgtgattagtcatcttagagagaagacttctttttgttagtttgtcttattactcaatctcaaatggagactcttgttaaggaagaaaacataccactgcattctctgcctcacattgactgaagttcacttttcaacattagggcttcctagtgatgctgcacaaagagtaacaaggtctgaagacctaggatttcctcctagttccatcattcatgagctgcctggccttgggcagtcacgctctgatcctcactctcctccaaccagccctgcctaccttatagggttgtggtacagctcaagtgatataatatacaagcaaacaccaaaagataccaacacatgagaggctattattatgtctctattttggacattgttctcctgggacaggtgacccttggaggcaggacgacagcctggcttgtgataaggaatgcatcagctcatggactgtggttcatcaggaactgattagcacccattgtcaaaatcccaccttgctctgtaattttcacaactctctttagaaaggaaagaagtggccttgcaaatggtccagaaaaacacaaataagcacagtagtaataacaacacaacaacaacaataacacaagctaacataactagaacatttgctaagtgcttcacaacaaaaaggaaagctctaaacccattttagcaaacatttattagcccttactacatgccaggcgggcactgttctaagtgctttacaaatgtcgcctcatttaaccctctcaacaacgctatgagaaagacaccatcattatccccattttccagatgaggagtctgagacacacggaagtgaggtcactttctcaaggccacacagctcttctactctttgccaagggaaatctacgtttcattcattcgtctatttccaacaggtccccaaagccggcacgctcagttaccaccagcaacccttccaaattcactgcgaagtttggagagtccgagaagtgccctcgatgtggcaagtcagtctatgctgctgagaaggttatgggaggtggcaaggtaagaccttctgtatgagccagacagaatttgctcatctccaccaggccatttgggaggaatgagagaaaaattgggagctgcaagcagctgtcattctctctagctcccagaacaactttagaaaccacacatcctcagccactttcccaggctggggctgtctgtcatctagcattgccctttgaaagctggaactggtgcagtttgaagcagcaagcattattctactagatggaaggcacccagctgaaagttctgggatacaaagcaaaagcccgtctaccctccagtgtccacaatccccccaaaagatgtcagccccagaccaaccactgcctaactcaacctgttgctaccaccatgaccaatggatatagcagatgcctcacagtagagagaagcatcctcacttacgaacttcctggctctcaggaaagtcatcagatgtccgagacactcatgcatatgtgctctgcaagttccagtttcaggcccaaagcctgggtactcaccaaaggagtcagacctgaggaaagagaaaaattatgtttataccacatggtgggaggaagggccgtggggagcatctaacttcaaacacaagggcaggctccaccctaaaactggccatttgaagacataggagaagccctgggctgtacctggtagacacgcagatgtgcaggaggatggagatctagaacatcgaaattatgcaactctgcctcagaattacacagaggaattaaaccagagagttaaaacaaggttgaattccctgaacaattgcctgatttctttattttttttccttctgtaactttatactcaacataaacatcacccagtgcccccagcccaagtccttctctgaccagtttgttccttggatctttttggcctggggaagccctttcccgtttagtctattctgaaggaaaacatatgcaaatcaccatgacaaatccattttcaggcttctgagaagtgctggctaaggccatagcatctcattttctccaaacccctggagaaattatggggcccattaggtaagcaaatggttaagacgtgtcactcctctggatgctgctggtcagggacttgaaatggaaacagaatgtgttgcctacctcattaaatatgcaacttttctgtgcccctcagccttggcacaagacctgtttccgctgtgccatctgtgggaagagtctggagtccacaaatgtcactgacaaagatggggaactttattgcaaaggtgagtgattctggagactttcttgaaatatgttttccctaaaagggcccttgggagaggaaattacgttcatgcctggaggtcttcccgtgtcttccaggaggtatggctgctcagcctgggcagcgttgggttctcaggagcaaaaccacctaaggggagggaatctcccacctgacccagctctggtcctctccactggagcacctggcagagaccagatgctttcagatgctcagtggttcgggaagttaggcacctgggggagagaggaagggaagaggaggaaacagtgccctgcctctggtcttggaagaggcctcaggccaggacaactaacaccacacccccttccaaaaatcgaaacaccatctgttcacctgagtggcagagggggtgactggaggagggtgaactcagtttggcctcactggagtttatcatgacatgtctatctccctcctgcctaccccgcactaacagttctgttgtcgatgttgcacgttacttagtgatcacagggacagatctggttttcctcctggtccttgcagctctgaccctcgctgcctccataatcccttggtcttgtggagaaatagtagaggcttagctccttcttgacactatcaaaggaaggaatgcactagggccaaggcaatgcgtcctccacccctgagcctaggcctattctgttgctcagtggagtttcatcacttaatgatggtgtctcaagaatctccaaaggagtatgttggaatgaagtgagaggagcaatggaaagggagttaagagagaagactttataagtcataactgtactttgctgtattagtctgttctcatgctgctaataaagacatactcaagactgggtaatttataaagaaaaagaggtttaatggactcacagttccacatggctggggaggcctcgcaatcatggcagaagtcaaaggaggagcaaagtcacaccttacatagcagcaagcaagagagcaagtgcaggagaactgccctttataaaaccatcagatctcgtgaggcttactatcacgagaacagcacgcccagtgattcaattatctcccgctgggtccctcccacaacatgtggggattatgtgagctaatcaagatgagatttaggtggggatacagccaaaccatatcagctgccaaagcttttcctgtgatgacacaggatgggaactagctcactatctgacagatgattgccgtctcctggcagtagaagacctacggggtcctcagccttcatagctcataatgccctaaaatattgccgaagtcagtagggaaattaacatgtaaatgaataattgcattgcaaagtgaaaaaaaaagtctatagtagagaaacattcacaatgcagtcacctaaaaagaggagaggaaccagcttggggtaatggggaaagcttctcacaagacaggcttcctactgaggcttgatgggtgaatgtgggtttgggaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtaatggggaaaagtttctcacaaagcagggctctttttaagctttgatgggttaatgtgggtttggggagggggcgctttcccagaaagaggggatcctttttttaaaaaaacacttttaaggttggaccatcatggttcattccaggtacggcaaagtggttctgtgtgcctggaatgtaggaagggaggcagagggcgggaggcaacaggggacgaggttgggcaggcaatcctcaaatgagaaaatatctgcaaacacatttagtaaagtggcaagaagtgtaaacaatttttattaacagatctaagataagtattgttaaatttattttaaaaagttagctcatgcataaacctttttattatttttattcttgagacggagtcttgctctgtcatccaagctggagtgcagtggtgtgatcttggctcactgcaacttcagcctcccgggctcaagcaattctcctgcctcagcctccccagtagctgggatcagaagtacatgccaccatgcccagctaatttcttgtatttttagtagagacagggtttctctatgttggccaggctggtctcaaactcccgacctcaggtgatctgcctgcctcagcctcccaaagtgctgggattacaggcatgagccaccgtgcctggcgaacttatgcataaatctatcaaaaggatgtctctaataattaaaaggactgtgctcagacagaaagccctgaaaaaaatggcactaaccaatgcattgtctctcccttcatcctcttctcattcacagtttgctatgccaaaaattttggccccacgggtattgggtttggaggccttacacaacaagtggaaaagaaagaatgaagaggtgcgccgtttctcagattttttgcgagcctaaaacacttgccaagtaatcctgcacagatcgatacctttccccaaatagcctctcctttgtagtcgtacattatgtgtttctcctcagaagtgatcaggtctttactgaatgttagaagaggcctttggaagaaaattatgtaaagtttaatctataacaaatgctttattatttataatgcttggaatgggagaggcaataaataaatgttttagtgctatcttgtatggctctagatcttttctttgagatagaaattttcaaaaacataaagctagttcaaaaaacgagttgcagagcatataataaatttggatgtcaactgagaaaggagtgagaaggaagaaacaatgcgcaaaggaaagcagtctttcagaatctgtcagccaagtgtctttctagttactgctaatggagaagaaaacagggggtctgggagaaaatagagaacatgatagcaaaatctaaaaggaaaatcaaaactaataaaattgctgaagagttgatccctttgtcctatcgtggggctttgtaatgttacacatctcgtgaaaactcagaaatgacaataaagcgtggcatttgcctctgtattataaatgacatgaggatgattttcttttattctaggacaattccctggggtttagcaattttcttaagacttctacgtcaaatttgccagccttgcaaatgaaatgcagccaattagaaatgtctttctctgcctcttcagcaagtttcagcagctcaagcacttcttgggcttctgcttttaacaaccacagcacttcccccagcactgtgcaattctgaattatctggaatacatgaaacaagtgaaaatctagtgataagaactataaaatacttggctaaaccatgggtttctccaccctccaagtcccctgggaaaggctttctttgaaatgagcatctattcagtgctgtttatgtagtgtcttggacaaggccctacatgagctttaaaagcagtacacgatcttggcactatgcatgggatttccaggtttgctgaggggtaacacatatttgagaaatgaccacaggacaatgcaacctcctcctcctctgctgcatttcacagtgactcgccccaccgtccagctacccaggaaatctgaagctaaaaactttagccatccttagctttgctctcttcctcacctgaccttgcctcacttctcaagtctcctggattctgactccaaatgtctctagaatacatcccctccatccctctttttaggatgtgtaatagtctgttagggttgccataagaaagtaccacaggctgagtgacttaatagaaacgtatcgtctcacatttctggaggctgaagtctgagatcaaggtgtcagcagtgttagtttcttctgacaccactctcattggcttggagatgggtgtcttctccctttgtcttcacatggtttttgctctgtgggtgtctgtggtctaatctccacttcttggaaggacaccagtcatattggattagggaccacctgaatgacctcactgtaacttaattacctttttcaaggcccttatctacacatgcagccatcacattctgaggtactgggggttaggacttcaacaaataaattttgcagagacacagttcagcccataacagtgtatcacataaagactttcacaaattggccttggccttaccccttcaacttagctttagacaatctcttccagacaagttccagctacactcaaagactcggagctttccaaacatgcccagaaccctcaccccatcatgtctttgctaatgctgttccttctgcctagaattcctggaagatgggaacctccccccatctctacccactaatccaacttcttagcctggtgaactcctattaagcaagtcacaggtcaaatgccatctcctctggaaattgttcctgaactacctgggcagaattaatctacctctgtactcccatagccggtatgtaattagcatagtacttatgtcatcgtattgaaattttgaattcctatttgcctccttgtaagaatgtgacatgtcaagccattcacagtgcttgacacatagaagacacctaataaacatttgttgagtgaatgaaataggggagagtataggccaggctaaatgcaaattctgctagaatctaaaagtttattacatagtggactgaatgagtt

SEQ ID NO: 16986 - DNA, 6959 bp, Human
aggtggctcatgcctgtaatcccagcagtttgagaggccaaggccggtgggtcacctgaggtcaggagttcgaaaccagcctgaccaacacggtgaaaccccgtctctaccaaaaatacaaaaactagccaggcgtggtggcatgcacctgtcatcccagctactcaggaggctgaggccagagaatcgcttgaacctgggaggtggaggttgcagtgagccgagatcgcgccattgcactccagcctgggcaataacagtgaaactccagctcaaaaaaaaaaaaaaaaagaataagtttttaaaggttggggtgcttggaggatgaaataaagtagaagggatggcaggtttccttggcacactccttgggccttaagaaagtgtaaagaataagaaaaatacaacaaaaggaaaacaacaaatatcaatgtatccaccactcagcttaataaagaaaatataataaacacaggtgaagccttttttgtgctccccttcttccccaccacttacctcagagataatcactatactgaattaggagtttgccatttcctcaaattttaattgagtcctgcatttttgacaaacatctggacgtctctatatgggtatttcactcagtatggttaaaagcaaattcaagctgggcttagtggctcacacctgtaatcccagcgctttgggaggccgaggtgggtggatcacttgaccccaagtgtttgagagcaacctgggcaacacggcaaaaacccatctctacaaaaaatacaaaacttaccaggcgtgctggcgcatgtctgtagtcccagctacttggaaggctgaggtgggcagatcacctgaacccaggaggtggaggctgcagtgagctgtgattgtgtcactgcactcagcctgggagacagagtgagactctgtcaaaaaaaaaaaaaaaggcaaattcaagtgatccatttatgtaaacagaaaaatgcactatataaatgtatctatctagaattcagggatcggtgaaacaaaagacatcgcatcggcaggtctgtttgcaacttctgggatacaccaggtgttagcggtgatgacttctggatgcttggactgtggatttttaaaatggttttatctgctcatctgtatttctaaattttcaacaatggaacatagattattgtattattattataataccccaaacctatcttcctctcagccctctttccacgagctcttaccctaaatgtctctttttctgtcagtggcattgtgcgtcttccttagtgcatcacctctgatcttcctgtagaattttttttttttttgagatagagtcttgctttgtcacccaggctggagcgcagtggcctgatcttggcttactgcaaactccgcctcctgggttcaagcacgtctccctgcctcagcctcctgagtagctgggatcataggtgcctgccaccatgcctgactaatttttgtatttttagtagagacggggtttcaccatgttggccaggctgttctggaactcctgacctcaagtgatccacctgcctcggcctcccaaagtgctgggattacaggagagcgccacggcgcccagcttacaccagactactttttaaaatgtttttgtaaagtcagggtttcgccatgttgcccaggctgattttgaactcctgggctcaagcaatccttttgccttttgactcccaaagtcctgggattacaggtgtgaacccctgcagctggcctcaatgttaagatcttaaggggcacagcacagaccttgtcttgtctatctccctggcacctctcacagagtacagcttattaacagatgttccagaaactgttactgaacattcggcttgatgctgtgggcttgtctgcatcttgcaactgtcacctggctgagaaatttcttctataaataagcagtttctgtttcagatgtgatatgccctgatatttacaccctgtctcttaccccatccaagactcaaacttagaaacttgaattagatgtggtattcaaatccttagctgccgcgaagacacagacagcccccgtaagaacccacgaagcaggcgaagttcattgttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagtaagtaatattgcttgaacgattattcattggtgtgaactattctgtctatatggactgcttattcagagaatcaacataatgggcatgatggtgagttttcttgaatcaaaaagagaaaggaagcaaggcagtgattttaatgtttatggaaacaaagtaattatttggaactgaacttgatatgattcagcactattagcaacatagattttttttaaaaatcagctcttctaattaagtgatatttagaatttaaaagtcaatgttcattaattaaggtgattgaatggaaataatccatacttgattattttgctatcaaaacaatccataattcattattttagcaaaataatcaagtatgacagccgggtgcggtggatggctcacacctgtaatcccagcactttgggaggccgaggtgggtgaatcacctgaggtcggcagtttgaggccagcctggccaacctggtgaaaccctgtctctactaaaaatacaaaaaattagctgggcatggtggcacaggtctgtaatcccagctactcgggaggctgaggcaggagaatcgtttgaacttgggaggtggaggttgcagtgagccgagatcgcgccactgcactctagcctgggcaacagagcaagactttgtctcaaaataaataaataaataataacaataaagtatgtgaatattatgttatcagctcattatctgtctgatgttcttttcataaaggtgtgaccaattcagtgaaaggaacgaatgcgattctctggacctgtttgggactgagcttaataatttctttggcagttttcgtgctaatgtttttgctaaggaagataagctctgaaccattaaaggacgagtttaaaaacacaggttggtttgatggtgaatctttgaaatctatttccaggggatggctattgtgagtttcagttccttttctttttttagcgttgactatttcacttcgttacagccctttcgaatgtgttagaacattgttacattaaatgaacttggtagaggtgagccatcttcattctgattttgacaccttggcagattttctacaatgtcagtcttctccaggattcttccactgttaattactctattgaaagtactaaggctttcttgggaaacatcagtctctttgactaaagttagcacatcgattaaatgccacattatcagaaactcctagccaggtctgctactgtcaggaaaagcatatttgtcaagatctatggtcatgtttttatacaaatataggtgttctttgcttgagtgaacattttactactgaaaaatgttagaaatgaataaccagttgctcctgaattatttgaggaatcatctaaaaaataattatttttaagcaatagagaaccagtcccagaaaaatgaatgttctacttaagtgcctcttaagataaaaatacttctgcagcacctttgctcatgattggattcccaagcatgtacagccactgccctatttctgtatgcatttatttatttatttatttatttatttatttatttagagatggagtctcgctctgtggcccaggctggagtgcagtggcgtgatctcaactcactgcagcctctgcctcttgggttcaaacaattctcccatctcagcctcctgagtaactgggactataggtatgtgccatcacctccgactaatttttgtactttttggtagagacagggtttcatcatgttggccaggatggtctcaagctcctgaccacaagtgatctgcccgcctcagcttcccaaagtgctgggattacaggcgtgagccacagggcccagcacatactcattcttttttactgaaaagatctgtttcaagctgggtgtggtggcatggagctgtagtcccgactgctctgtaggctaacgtgggaggattgcttgagcccaggagtttgaatgcagcctgggcaacacagtaagaccccacctctaaaaaatgaaaaaatctctctcacattgctttgagtcccgatgtgtactgctaagactctcatgaccacattctctgtgaagtttgggttaatgtttccgtttctacataattaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaactcttttttttcctgacatctaagtttttattaacgtgagtttttaaaaacaagcatgtataccagtgtggggggtgagggtgggagagaaaggtgggagggggaaagaattctaacctattgataataaagctccagttttggccaggcgcggtggctcatgcctgtaatcccagcactttgaaaggccgaggcgggcagattacctgaggtcaggaatttgagaccagcctggccaacatggtgaaaccctgtctttactaaaaatacaaaaattagctgggcatggtggtaggcacctgtaatcccagctactcaggaggctgaggcaggagaatcgcttgaacctgggaggtggaggttgcaatgagctgagatagcatccctgcactccagcctgggcaagagggtgagactccgtctcaaaacaaaacaacacaaacaaacaaaaagacctccagcttcatcttctgctggattttatagtgccccaaagatatgtggtccttaaaaattgtataccacttattcaggagtcttgttcctgaaagggttgttcttgttacagccctagtctgggctgtaatcagcttcttaaggtccacaatggtgttatctgtgtagcatttaacacagaccttctccacactatccactctccactgaggttgttgcaaacaacctcaatcatcctagctgatgctcatcaccttgaacatgctgacatgacaatcttctcactagagacctctaaacgcttgacttactgaaaaaaacagcattctgtagatctcagtaaccaatttctttttcttttcttttttttttttttgaaacggagtcctgctctgttgcccaggctggagtgcagtggcatgatcacagctcactacaacctccacctctcaggttcaagcgattctcttgcctcagcctcccgagtagctgggattacaggcacgtggcaccatgccctgctgatttttgtatttttagtagagatggggtttcactgtgttggtcaggctggtcttgaactcctgacctcaggtgattcacctgccttggcctcccaaagtgttgggattaccggtgtgagctatcgcgcccggccccagtcatacgcttctatggttagggcgcttctctccgatatacatacatacagatttcaggaaggatcggatgtttctcttgatttttgaattttatttatttattttttgagacagtctcgctctgtcgttgacacgggagtgcagtggtgcgatctcagctcactgcaacctctgcctcccgggttcaagcaattctctgcctcagccacccgagtagctgggattacaggtgcccgccactgcgcctggctaatttttgtatttttagtagagacagggtttcaccatcttcgccagactggtcttgaactcctgacctcgtgatccacctgtcttggcctcccaatgtgctgggattacaggcgtgagccactgtgcctggccttttctctttattgttaaaggaaagctaacttatgtacttctgcaaacaggagaagcctagaatcaaccagacgaattcagtgtgcagtgcacaggtggttcttggccttgtgagcttccagcttaatgaaagcatcaggcattactataattacacaagtaaatgtgtaatcgcaaactgtgataacggtgcacgacatactgttttcagcccaaaatgtgagtggtgctataataatcatatctaacccttatatagtcttactaacgtgccagggactgttctaagtgcttcacctgtactagctcattttatttttttgagacggggtcttgctctgttgcccaggctggactgcactggcatcatcttggctcactgcaacctctacctcctgggttcaagagtctcctacctcagcctcccaagtagctgggattacaggtgcccgccaccacacccggcctatactaactcattttaagcacacaaaaactcctgggtatggccgggt

SEQ ID NO: 16987 - DNA, 19819 bp, Human
gaggcggaggttgcagtgagccgagatcgtgccactgcactctagcctgggtgacaaagcaagactccgtcttaaaaaacaaaacaaaacaaaacaaaaaaaagaatagcttgctcactaagggcagttaaaaataggcttcccaccagggccatccatggctcatgcttgtaatcccagcaatttgggaggtagaggtaggattccttgagtcccaggagttcaagaccaggctgggcaacacagtgagactcctatctctatttgttgaaaaacagtaaaaaggtttttttttttttttttttttttgagacggagtttcactcttgttgcccaggctggagtgcaatgacatgatctcacctcactgcaacctccacctcccgggttcaagcgattctcctgcttcagcctcccgagtagctgagattacaggcatgagaagccaggcccccggctaattttgcatttttagtagagacggggtttctccatgttggtcaggctggtctcgaactcccgacctcaggtgatccacccgcctcagcctcccaaagtgctgagattacaggcgtgagccaacgcgcccagccgaaagtttttttttttttaagtagaaacatagtaagccttccagagacttttttttggtcaagtggtctgggatctctccttagagaaactgcctaacaggttgcttcaaggattggagagcgtgtatgcaaaactgctcggcatccaccgggtgctggcaacatctaataacaatatttcccaataataacagtaactattgttactagtaggaataagtcaaattaggaggcgcgatttaggcggaacctggaaggcggtgggcaggatccaggacattccaaggcaggcgtgggcttcctgagccaggagccaaccctccaggagccaggggagggcctggggccggaaggtgcggcgtgcgagcggaggacggaagctcgccgccagggtccccgtccctgccccaagtcgtcaccccctcttggggagcgcaccctggcggaggggcaagtcccacacgggctttgttatgaatgggaagctgcagccttcagcccgcggagggaacagtgcgggtctgggggaatagcaggggacccggcagcaaccagcagacctccccgcagcgctggcagcctgcgcccgggggccgctgccgttcaggcccgcctccaccctcccctccctgccggggcccccggcttcctagggcggccccagcatccgaggcgccctttgccgtcccgtcgccgggtccaagattcccaggatccggagtcccggccgtgcggccagctaagcaaggcgggagggaggaagctggccggcctccgaagtcagccccgagttacatgtgggaagcggtggctgtgacgcaagtttccagggggccctgggctcggctcgaagggagcacaccggagaggctccgctccgtgcagctgcaatggtgaaaaagcagaagccccaagcgcgaaccccaggccgccttccttgctgccgctgcacgcccgacccagccgcgccccctcctccctgcgggccggccgagcgcgcggaccctgctctgggccagtcgctgctggactccgggctgcacgggctgggctccctgcgcggtggctggcctttttttttttttttttgcaacgcttgccaacctgtcagctgatggacctcatcacccatagtggcgcatgtagctcggccgcagctcgctccattcacgccgcgccccgcaagcccgcccgcggcccccggccccctgcgccccgcgagaggcctgcagaccccggttgcagccggtccccgggggcccgcgcccctctcgccccggcctcgcgccgcccggggggcgctgcaaatagtcctttgtttacatgcaattccttactccgcggaaggaggccgggggagtgctgagttttcaccagctgtttcccgccttgaaacagacatctgatcagctgcaaacacacacacacacacacacacacacacacacacacacacacacatacacacgcccggggaggcaggccggagagacctccctcccgcccctcccgcccgcctccctcccctcgccgccgccgccgccgccagcatctgggaccggccgattctgcacctccgtccggcgctgccctttgattcggatttccatcttgcattctccggctgatcgcgggacctggctcgtgcagaggaggggggccgatcgctatggagtatttcatggtgcccactcagaaggtgccctctttgcaacatttcaggaaaacagagaaagaagtgataggagggctctgtaggtgtgtactcctcctccccccacccccttcctaccactgcagcccccggccagcccgcccgggcgggcgcgcgtgtgcgcacgcatggcccgcgccgccgaccccgctagcctttcttagctgccgggacggctgcagccccacacgccgggtccgcgccgccccgggaccctccttccttggagcatgggggccccaagcggccccggccacttttgtccgctgcaggcgggcgagtcgcgacgtttgtaaattgcaaacagacccacgtggttctgcagcagtcccggccatgcttggtgctggtggccttcccccccgcgcttcctctttccccctcctgcggcggcttccttcctctccttccttcctcgggatctgaggtcgtccccatccaagggggtctgggggcccggggcgcgcgtgggggtgtagctagggcggctacaatgcagccatgccgcggctcccggcgcggggtgggggcggggagccgggcactgtgcgtgtttgcagagcggggctgcagcggggtcgggggcgtgctcgcgtgtgggtgttgggggtgggcggaccccgaggggcccgcgcggccggtaggggcgccgcggcccggggcacgttggctgccgctcgctcgcccgcccgcgcccgggcgctgtttactagcgaggcctggacgtgactctgcagccctcttggagtaggcggacctctgcgcgcggcctcgcgggagctgtagttctccgtgtcctgctggtgcagcattgtgggatttgtaggcgctcctgggccacgctttccctgcacaaagctcggcccccgcgggcacgatgggcaaggcaggccaggtgggcaggccatttggggaagggacacctgaggccgcccctagcctcgcagggcagcttcccgccgcacgtgggtttcctctgcaaactttcccatccaacgcccctcccccctgccgtaaaccgaaagcgtcgggtcccccagccgggtgggtggcccgaggtccgcaggcctccccagaagccactttgcaagctttggtcctaggttgctctaaacccaaagggtgatggactcaaggaccacacacagccaaaccaccccgcacacttcttaaaatgcacatgcctggaactctgatcgctggggcccggacatctgcattttgaacgaccccctgggcgtggtgtgggggaggtgggcgttctacggcgtgcgcaagtttgggacctgtggcccctttcctgccgcgctgctccaggagcgaaatggctccccagggctggagccacgtgctctgccgcccgaggcagtctgggcggggattgagggaggaggagcccgccggtgtggcacaggctggtggacgctagcgcctgcagaatccggcctggagggaaggttgctgcacacgtgtagacactcctgcccaaccctctgccccgggggtccccaccttaaggctactctgaagttcccagtcaatacctagacttgggccagttgatgggtttggcagctggcagggatgccccgagggctggcccttgcacgaggcccacctggagggcccagtaataataagtaaaaaaaattcttgagctctttttatgttctggggactcactttgctagaattttctcactgagttgtcataatctttctatgagtcaaaagtgtcttttgattccgcttaaagaggcggacacagagactggagaagggaccactacagcaggtggtggaactggaacttgaacccttgtcctggggttgctgctgctgcagggctgggctgggcagcgcggaggtgcagttgagccgctgtgcctactggagaagacattctgggcctgatcctgggcagggttggggggccctctggctgccatgcctgggccttgggtgagtcctctcagggccccctgagattctggcttcaatttatccctgccccaagcgttcctttggagcataccagcagtcccccagggtagctggatcttggtaggccaaggacttgaaggtgtagggccttcgtccagggttggacatggcaacgtccattgcaagacagttgtcagctgtgcattaggcatggagttgggggtccctggatttgtttaccttcagtaggggttgcagggtgaggtgggaagccagtctgggatcaaatgtgttcattaggcaggaccttctggccagatgcatttgcttctcagggtcatctcaggctggtgggctttgctccatccctcagtgaccagcagggatctccctgtctttctgtctcccaggcctgccagaggggattgtagggcacggtgctgcacacacaagctgcaggttttggacctgtcgcctaatggttctcagtctctgggaaacagagcacctgtgagaaaattagctatgggtatggcaagtgcctggtagctgtaaaaatgacactcagtctttttttttttgagacggagtctcactctgtcacccagaatggagtgcaatcttggctcactgcaacctccgcctcctagattcaaccgactttcctgcctcagcctcccaagtagctgggattacaggcatgtgtcagcatgcctggctaatttttttatttttagtagagatggggtttcaccatagtggttggccaggctggtctcgaacccctgacctcaggtgatctgcccaccttggcctcccaaagtactaggattacaggcatgagcaactgcgcccagccactgagtcttaaaagcaggtatatgggcaggtatatggtagtctccatccatatcttgtgttttgtttgtttgtttgtttgttttgagatggactctcactctgtcgcacaggctggagtgcagtggcgcaatctcggctcactgcaacttctgcctccggggttcaagcaattttcctgcctcagcctcctaagtaactgggactacaggcccgctccaccatggccggctaatttttgtatttttagtacagacggggtttcaccattttggccaggatggtctcgatctcctgatcttatgatctgcccgcctcgtcctcccaaagtgctgtgatttcagacgtgagccaccgtgcccggactctccatctgtatcttttttttttttttttttttttttgaggcagagtctcgctctgtcgcccaggctggagtgcagtggtgcaatctcggctcactgcaagctcggcctcccgggttcacgccattctcctgcctcagcctcccgagtagctgggactacaggcgcccaccaccacgcccggctaattttttgtattttaattagagacaggctttcactgtgttagccaggatggtctcgatctcctgacctcgtgatctgcccacctcggcctcccaaagtgttgggattacaggcgtgagccaccgcgcctggcctctgtctgtatcataaagctcctaggcctggctcggtggctcaagcctgtaatcccagtgctttggaaggccaaggggaaaaaatcatttgagcccaggagttcgagaccagcctgggcaacatagcaagaccccacctctacaaaaaataaaaaaattagcccggcatggtggcatgtgcctgtagtctcagctccttgggaggctgaggcaggaggatggcttgagcctgggaattggagattgcagtgagctatgatcatagcactgcactctagcctgggtaacagagaccctgtctcttaaaaaaaacagtaagactgggtgcagtggctcactcttgtaaccctagcactttgggagaccaaggcgggaggatcacttgagcccaggagttcgagaccagcctcagcaacatgacgaaaccctgtttctactaaaaatacaaaaaactagccgggtgtgaatggtgtgcacttatactcccagttgcttgggaggctgaggaaggaggacgacctgggcccaagaagttgaggctacagtaagccgagatcatgccattgcactccagcttgggtgacgggagtgagaccctgcctctaaataaataaataaaaataaattaaaaaaataataaaacttaaaaagctcccataagaaggagttcaagaaaattgaaggctttggagtgtttattgggtccctgatttatttatgaagcaacaacattctgccgggactgaggatacagccacgaacaggatgtgactcctgtcctcagcagctcacagccttgtggtcttaaaaggtcttgtagaccccctaagagtttcatgggttgtcctggacacctgggtgcaaactaactcttgggcctcgacctcccgagtagctgggattacagacacgtcccacaacacccggctaatttttgtatttttagtagagagggggtttcaccatcttggcctggctggtctgaaacttctgacctcaggtgatctgcccaccttagcctcccaaagtgctgggattacaggcatgagccaccgtgcctggcctttcttgatctcttttaaacttcaccatgaccctgtgaagtgaagcagtgtttccatattttacagacggaggaaaccgaggcttggtgttgcacagctagtaagtggcaaggctggactttttcacttgagcccagtgcagggttcccactgatgggctggaggagctttggggaagggagggaggcagggatgtttctgatggcaacagcctgggcatggtgtgttctgggaccgaggggaagggcagcagactggccaggtcagagtacagagtatgggtgagtagtgtagaagcagcggggatggagcatggatgagaacctcgggctgattaggttagagaaggatgagtgccttagtgcttttttgggtttgggagaatcccgtgtggactttcccacgttgactgtgtagatgttaagtgaccctgaggtatgtgagtgacttcagggcagtgtgaaatgaaagttctcagtggccggtttgaggctggagctgggcaggcaggtgtagagggattgggggtacttgactttggcctgggcaggagggataggtacctggcagggttctagacttgaagggcatgccctatgcctccaagtgtctggttgggacgccagcgtcagtctcagcagattctgtgggtgctgtggtggtaggtgtggcggctcttgccttagcatccaaggctggtgcccaaattttgttccttggccattggctgctcagtgaccttattcctaaatctagggcagcccctgtttggacccaggaggctggcttgcaagaagcaagagagccttggtgtggctgggcatggtggctcatgcctataatcccagcactttgggaggccgaggcggatggatcatttgaggtcaacagttcgagaccagcctgaccaacatggtgaaaccccatctctactaaaaatacaaaaattagccgggcgtggtggtgggtccctgtaatcccagctactcgggaggctgaggcatgagaattgcttgaactcgggaggtagaaattgcagtgagctgagattgtgctactgcactctagcctgggcaacagagcgagactccatctcaaccccccctccgccccccataattagccaggcttggtggatcacgcctgtaatcccagttatttgggaggctgaggcatgaaaatcgcttgaacccgggaggtagagattgcagtgagccaagattgtgccactgcactccagcctgggcaatagagcgagactcagtcaaaagaaaaaagagaacctcggtgttggtggacttgggtcacctttgattttcacctggaggagtctgaagtggccagagagaggatagtggacctttactgtgtgtgtaggacgtttacagaccttaaccgtaaatgcaaaaccccagaaagagctatcagaaactttcaggcatttgcagaaaaatccactttattcagtgcagtatcacctggaaatttcaatcaaccatccttcatcaacaggaacccctggttggtcagccatcagaagccctggttggtcagcattccaccaataagaattcctggttagcggcactccaccaatcacaacccctggttagctcctattccaccaatcagaagccttggttagaatgcattctattaaaggactctgtcggcgggtacttccagggcaatttaggtgagttatatttgagggtcttggtggcagattcaggtcccacgaggaactgtaccttttggggggaaatttgctttcttggatttaagaaagtgcttaacctaagttaagcactaggttagccagcagctggtttctgagccaggagactgggctgatggctttggagaggaaggaggcaggatggagcattggagaagctgggccggcagattctgatgcagaggaggaggcgacacaggcccctgatcccagccccagctcctcttccttgtgagaacttccggctggggttttcgggactggggtctggtggtctcctttggtctcccagttagtgggctgccttgcggggaagggacggaagaggctgagggtcagctcccaagagcagaggagttggtgggacttgggccgggaggtgcagaagggtgcatctggctgcaccctgccctgcccagctgctgggtgtgaccttgggcaagtcacctcacttgtgggcttgtgttcagaggggcaggggtgatggctgagcttgcagtcacacacccgcttctgataagtggcgggctgtgtgaactagcagtcagtagaggcgcttcagtgggttggcatctgcaggttgctgttgtgccaggtctggctacttgaccttgggatcatcaccttccttcccacgaccctgcattgcttgctcactgtaatctcggccaccccactgggttttgtgagaatcaggcagggaaaaatgtcaacgaggtctgtgaataataaaaagagttacacgattacagcgatttccgaatgcctggtcctttttttttttttttttttttttttttgagacaaggtctcactctgttgcccaggctggagtacagtgacatgatcacagctcactgcagcctcaacctcctgggcttattacatcctcccaccttagcctcctcagttgctggaacaatagggacactccaccatgcctggctgattaattttttctagtgatggggtctcactatgttgcccaggctggtcttgaactctggggctcaagcgatcctcctactttggcctcccaaagtgctaggattataggtgtgagccactgtgcccggcctagtcttctcttttacagggataactgtcacctgccagttggggcatctggctctgtgggccggtcagagctcattctgccctatggcctgacacctgctctggggtcagggttcacgcccagcgcttgctgcagctggaccctacccaaacctctgtgcccccctctttacatgggagtcttcaggccacctgactcaggaacattgtgacaattcagtgagaaaattctcgccaaaaacttaaaaaaaaaaatgtatccctctgttgtggaccctccaggagggccagctctcaggtggcccaaggctggacttggtgctcccttttcaccccctagtcagctctggcttttgggcattgccaggagggacccaggggctgggtgggcaggggtctctccccacatctctcctgagggggatggtgatgcctcaagattgcacttaccttgtgttgtggcttcctatggacatctcttcccacctcttacctccaaagagccccagctttaagccacccactgcagagcagtcctggtccccttggcctgctggcctctcagacatggtatggtctgagtttgtgccaggcctgggagcctggactccgccctaaggctgggccacacacagccgtgcagcaggcctgctccagtccccctatcacctccacttcagggcaggggaaccgggagaagtgagagcactgacatccagctgaccgaccctaaaaccatcccctctctgccctgcaccctaaagtctcatggaaagtggggggcccgggccccttttgcagtgctgacatttcaagaccctgtaagagacttgtaccctgggtgcaggccctgggcctttgggtcctgatggaggagggggcttggcttgatgaggacggaaggaggctgatttgcatccagacttccggcgttggacacctctctattgggagaggaagccgaggccggggaaggggcagcgatgcgtccagggtcccacagggagccaaggctggacagatgggcaggctgggtggggccaggaaggccacggctgtttccagctgttgcagatgtgctgcctccggggtccgtgcaaactcctttccgcctgcaggctggcgaaggggccagggcacacagcaggggagttagacttggcagccccttgaccccagactgccttcatcaatggagcaggagctgcccagaacccttttcctgttctcccacattcaggggcatgagcccccttggcccagtcctggaacagggcaccccgggagggcccctcaggaagaggccggggctgcggcttcgggtggggccggcagcctctgctgagagcccagcatctggaagccatcaggccaggggcggggggagttgcaggggaggtccagggagggggacatgcctcctccaggccacacacaagcccaaccctcgggagcgtggccttgggcccacaaccgctgcctctgcaccctggcccgcagccccgccccctggcgcacacgccccgccctcgtccgaagccacgcccccagccagcagccacgccctcttcccccaggctgccttctcaccgcactggccactgctcctgcaagggtcagcagcgctccccacagcatggtgggagcctcgcttctccggcgcagggtgggtctatctcttggagtgggtgggctgtggggagccgtgtccccaggggttgttggcttggtgtctttttggggagtgagtggtacttgtcttctgtgaagtcttagcctagcggggctggggcttgtggtgggaggcgtggccgtgagggtaggaagggagtggggacgtcttcctcagtcctggggtggcaaagcctgagacgctgaagaggcgctccaggtgcctagcaaatcactcagaagtgttccaggagcggggacagcgtccctgaatgtcgtctgcatcccgcgtgcatcagaatcacaccacgcacgtttctgggccccaccgggcctgctagtcagacgctggggccagcacccgtcgtctgcatagtttctaagctcttggatgttttgatgctcagacacactgggaattctgttccggaggagagactgctccctgtgaggaaagccagggaggggatgggtttttgttgttgttgttgagacaaggtcttgctctgttgcccagactgaagtgcagtggcgtgatcatagctcactgcagcctccaactcctgggctcaagcgatcctcccacttcagcctcctgagtagctgggactacaggcatgcaccaccacacctggctaattttatttttttgtagagacagggtctcactacgttgcctaggctgatctcaaactcttaggctcaatgatccttggccttgacctcccaaagaactgggattactgtgcctggcccggggtgggttctgagcggactatcttacccgcagccagctgattcagtccgccccggtgtcccagagagcacccctccatcactctctgggggtggcctggcatcttttgcagcaggggagggatgcagtttccactggggccctctggagatgaatgatgaagagggcgccttggccgagcctgtccctgtcctctctggcagccttgccaacattccactaacccccgagactcagcgggaccaggagcggcggattcggcgggagatcgccaacagcaacgagcggagacgcatgcagagcatcaacgcgggattccagtccctcaagaccctcatcccccacacagacggagagaagctcagcaaggtgggtgagagcagggagggcttcctggaggagccggcaggttcccgctgggagaggaaagtgagctctggtaaacactgccagcctgactctcggcttttccacgccctcaggcagccattctccagcagacagccgagtacatcttctccctggagcaggagaagaccaggctcttgcagcagaacacacagctcaagcgcttcatccaggtgcgccctgtccttcatggctccctctccctggcatgggcatgccttggacccagccatgggcctgggactcaggtgtggctgcaggccccttcttgcccactgacaagtacttccaggcactttttttcctgccccggcctcagtttccccatcggtcaagtgcggtggagtgggctctggaaggagccaggtgactgttatgtaaagcagcccattctcctggcatttggctggtttgttggacttgcagaaggggctccctaatgaagattcacctgtgttgggcagctttggggggctgcgatggaaccccaatctccgtggtggtaccgaggtgtcaggcacactgaccgactccttggggtccccaggagctgagcggctcgtcccccaagcgacggcgggcagaggacaaggacgaaggcataggctccccggacatctgggaggacgagaaggcggaggacctgcggcgggagatgattgagctgcggcagcagctggacaaggagcgctcggtgcgcatgatgctggaggagcaggtgaggcagcgccctctgctgggcacggcgcgcggtgcagagggcgtggagcctggggtcgcgcctcttgctctgcggccctcggtggagccctatttacaggagcacctactgcggtgccaggcctaggagtggggagcaagccagacacgtctctgcccttgggggccaccgtctgcgttggggtgggggagattagccaaaggatctcaaaaatgtaaccatgctgtgggaggccgaggcgggtggatcacctgaggtcagcagatcgataccatcctggctaacacggtgaaaccccgtctctactaaaaatacaaaaaaaaaaaaaattagccgggcgtggtggtgggtgcctgtagtccccgctgtttgggaggctgaggcaggagaatggcgtgaacctgggaggcagagcttgcagtgagccgagatcgtgccactgcactccagtctgggagacagagcgagactccatctcaaaaaaaaaaaaatgtaaccgtgatgggctgggtatggtggctcacacctataatcccagcactttgcggggctgaggtgggaggatcgcttgagcccaggagtttgagatcagcctgggaagcatagtgagactctgtctctaccaaaaaagatacaaaaattagccaggtgtggtggggtgtgcctgtagtcccggttactcaggaggctgagctgggaggattgcttgagcccaggaggtggaggctgcagtgagccatgattgtgccactacactgcagcctgagtgacagaaggagaccatggctcaaaaaaaccaaaaaacaaaaacaaaaaaccatattgaaggccaggctggagctgtggcatcaggaggggtttttcaagggacgccccacggcttctccatggaagtgggaagttgagtctcatagttaaccaaaggacagagaaaggtgttcccggcagagggaatagcataggcaaagactcgggcaggagggagcatggtccagtggaggccgaggtgggaggcgagaggagccgggggctgaagggctctggaaaggcttctggcctctgttgaggggggcccgccctgtgctagggttttcagcaggagtgaatgagctgctgtgagactgacagggcagggtgtgctcccggccttggccctgagcccaggttgtcctgcctccaggtgcgctcgctggaggcccacatgtacccggaaaagctcaaggtgattgcgcagcaggtgcagctgcagcagcagcaggaacaggtgaggctgctgcaccaggagaagctggagcgggaacagcagcagctgcggacccaggtgagcaggaggcgcccgggagtgggctctggggaccgggaaggggacaggtgatcttgaatggcggaagcctctccctaggccacgtcctctctgcttcttaatataaaggggcagaggcagttatacattggccagctctgcatgaaagggaggtggatgggccaagagaagccttgagagaaaggctgagggcctctgtcttgcagcttctgccccctccggcccccacccaccaccccacggtgatcgtgccagcaccgcctcctcctccctcccaccacatcaatgtcgtcaccatgggcccctcctcggtcatcaactctgtttccacatcccggcaaaatctggacaccatcgtgcaggtacctgagcttgagaaaggggcagcttgtgggggtcatactccgggaacaggctctttaggggagactggaaaagaggggcagaagcggaggaagatggtgcttgtgtgggaaggggtggagggctggaagccttggggggccccgtccctggatctgcaagtggagaatgtgagggccagagatcggggcagggcctaccacgccagtaggaggagttggccaggaagactgtcccttccctcaatatggggtttccggagagggtcctttgctcccagagccccctggttacagagttcctgcatccagctcttgggttggtccggaacattgtctcagctccatctcctaggacctggatggagatacaggtggcagggctggtgatagttgggcctcctacagaggaggaagctttgtgggtcaagcctgaagttacagttgcattcacccttgaacagggccccttgaggagcccaagatcagaaatcagtaaataataaataaataaccaaaaaagccaaaacaggaaaaaaaatccatcaatctcctcgaattttaattgctcataaactttgcaaattgtgtaatacaattaataacaaacgcctttaataagttaataggcaagctttaaaatacataaacatatggccgggtgtggtggctcacacctgcaatcccagcactttgggaggccaaagtgggtggatcacttgaggtcaggagttcgagaccagcctggccaacatggtgaaaaccccatctctattaaaaatacaaaaattagcctgacgtggtggtgcacgcctgtaatcccagctattcgggaggctgaggcaggagaatcgcttgaacatgggaggtggaagttgcagtgagctgagattgcaccactgaactccagcctgggtgacacggtgagactctttctcaaaaaacaaacaaacaaaaacatatgaaaggtccatattatttctttttttttctttttttttgagatagagtttcgctcttattgcccaggctggagtgcaatggtgctatctcagctcatcgcaacctcctcctcccaggttcaagtgattctcctgcctcagcctcccaagtagctgggattataggcatgtgccaccacgcctggcaaattttgtatttttagtaggcttctggcctctgttgaggggctggtctcgaactcctgacgtcaggtgatcctcccgtcttggcctcccaaagtgttgggattacaggcgtgagccactgcgcctggctgatacatataatataatttctaagcagcactgggactgtcatcttcccagaatggatttttcaacttaacagaggggttttgaaagtttgttcctgggtcaggcgtggtggcttatgcctgtaatcccgggacttttggaggttgaggcaggaagattgcctgaggtcaggagttcgagatcagcttgggcaacatagcaagaaccccctcgtctctaccaaaaatacagaagttagctggggatggtggcgcacccctgtggttccagctactagggagggagcagtaggaggatcgctggagcccaggagtctgactgcagtaagctatgatcatgccactgcactctagcctgggtgatatagcgagagcttgtctccaaaaaaaaagtaaaaggagtttgtttttcctgtactctagcgggcctcccctgctgctttgccaggcttttttctgggctatgtgttttgggggtgacagtggctggctgagagcccccactgtctcctggctggccatgtatccccggccgagccttctcagtggttcgtccctgtccaggcaatccagcacatcgagggcacccaggaaaagcaggagctggaggaggagcagcggcgagctgtcatcgtgaagcctgtccgcagctgcccggaggcccccacctctgacaccgcctccgactccgaggcctcagacagtgacgccatggaccagagccgggaggagccgtcgggggacggggagcttccctgactacccccccagccctcctctcccttctgggggctggagggagccggggcagccacagggagagacatgggcgaatgagtgagaaatttttacaaaattacgatgtcatttgggtctcttttatgacctctttttcaatactgtaaatcgacctttgaacgaagccactcaacccgaggtcccggggctggggtgtcgcagagcgtgtgggagcatcggcaccccagggcggggcctcggccccgggggctggaggaagctgacacggagatgcctggcctctctctgccaaaaagcattttttcctttaaatatgttttttaagaacagggaaaattaaacaaaaccccaggttatttcttccctgcccagagccagcctgggattgtcagccttcaatcccctttccttcctctttttgggttttcttctttctcctttaagcacttacatggttgggggtaagactaggctggggcattctgggggcccggaggtctccgttgcttcttggttggggtttgctgctgctgtgcccccctcccccttccccatctcggcactagaattcgccactctcccaccccccagcccccacctctgcctccaggtctcatcttccaccccaaaaatgtctgtctctctctttttgttttgtttgttgttggttttttatttctttttggtttgctttctgtttttgttttgtttttcttttttttctttctttttttttttttttacaattttgaggtcttcgtgttcaaggagaagctattatattttgttaagaaagtggggagaaaaaaaccaagaggccaccgtgcctttgtaaagaaacaaaataaagtttgtactttgttttttagattctgagtctcctgggtgtgggctggcctgaagaccagggcagggctaccccatctagagtaggggggctccttgggccccccaaagcggactgggtgtgtgtgagcacagttactccctcagcttgtgtgtggtgttgcgatgaaaaattggggtcctcagtttccctgggatgaccctgggtattctgtaaagatggaagatggtgttgaggctggggagtggctctttggtgggcggcaaggagagaaggacaaccaagccaccgattccgaaaacctgggaaaggacacaggtgttcaggggccctgcttggtccctacgctttggttaatccctaggttttgccacttcctgggcttctgtaacttctctgagcctcatcctctcctcccctaggaggggaaccccaccccctccaaccgcacccccccagcacccccctgcccccccgtggtgtggtgtttaagtgctaagatcctggaattggtctgccagaggtcagttccccctctgacaaaccgcttcctctgagcctcaatttcttcttctaaaaattggcgataataacggcacaaggacattgcatcctattggggattggcatggtcctttatttcgagacagagtctctgtctcccagtctggagtgcagtggcgtgatctcggctcactgcatcctctatctcctgggttcaagcaatcttcttgcctcagcctctcaagtagctgggactacgggagtgcaccaccatgcccagctaatttttgtatttttagtagagacagggtttcaccatgttgaccaggctggtcttgaactcctgacctcaagtgatccgcctacctcggcctcccaaagttctgggattaaagggatgagccaccatgcctggctatttttaaatttttattattattttttggtgtgagatggggtcctgctctgtcgcccaggctgcagtgcagtgttttgatcacagttcactgcatccttgacctcctggtctcaagtgatcctcccacctcagcctccctagtagctaggactacaggcctgtaccacaaagcctggctaatttttttttttttttttttttttgagatggagtcttgctgtgtcacccaggctggaatgcaatggcacgatcttggctcactggaacctctgcctcacaggttcaagcgattctcctgcctcaacctcctgagtagctgggactacaggcacccaccatcatgcccagctaatttttgtattgttagtagagatggggtttcaccatgttggccaggctggtcttgaactcctgacctcaggtgatccacccaccttggcctcccaaagtcctgggattacaggtgtgagccaccgtgcctggcctgggcccggctgacttttttatattttattgtagaggcagggttttgccatgttgcccaggctaggccatggtcctttaaatccttcactcttccgtgaccagagatcgatttacaccgtggtcccctcctatgcctcatgctcacagtgctgggtgcttggggactgaggccagagcagaaggcagaatcacagctcaccccacgatgacagtggacacgaactcttcacagaaaggcaggagtctgcaggttttcttggaattttacagtgaacaattcaatggcacttcatacattcacagtgttacacagcctacctggttccaaaacatgtccgtcactccaaaatgactccatgaagcagtcactccttccccctcctcccagtctccagcaaccacctgctttctggttttaatatcttttttaaaaaattaaagtagttggctgggcgtggtggctcacacctgtaatcccagcactttgggaggccgaggcgggtggatcacatgaggtcaggagttcaagaccagcctggccaacatggtgaaaccccaactctactaaaatacaaaaattaggctgggcacagtagtggttcacgcctgtaat

SEQ ID NO: 16988 - DNA, 89210 bp, Human
atataccaggcacttggcatacagatatggtcaaatggagtgggaaacctaccacccaaccaaacaaaaaaaaacgcatgttaaccaacaaataaataattataaatagttatcagaactgagcaggaagtaaagagggtgctgaaaaagaacaacaggaaccactctgaggaggcctctaagaggaggtgacttcagcagggatgggaaagatgagccactcagtttaggggcaagctctgggcagacaccaggaagctcctgcagctagagtgcagggagggagggaagatccctagatctggcccagaaggctgcggcaaggggccgatttcaatttaattctggggtaagcactgaggatttaggtagagaagtgtctgttctagtatttgccttaggatcacgatggctgtagtgtgggaaatgaaacctctccaggatcgcctgggaactggtatagggagtcccgggccatgcgggggcgccaaggagtcaggcctggtgtccctgcagccgcgcggatccacttgcagatgggtccctctacgaataacgagcctactagggcacgtgcttttactgctgcactgaggacgtgaaatgcgcgcaggcacaacgagactttcttctttttcgctctttcagagggcccgggctcccatctacgctttgctggttacgttggcatgttgggcatttccccctctctgcctcagtctcccgacctgtcaaagaggacggtgggccagccatgggtgacacgcccgtgcgcctctccaatagtgcacctcgggcaagccgggcggcgggcacagcctggacggtgccggcctcgagaggcacaaagggctggctttccaccggggaaactgaggcagtggagcgaggagcggcgtcctcgaaagtcctcgcaaactcccagcgcctgtgttgggcccatgcaggctacccaggccgcccgtctccgagcggaggaccccgcccagcgctgccaggggcggggccgggctgaggacccgaggctggaagggaggtcggagcacccaattcggtccaggactcgcagggggcggcagtggcggcagcgaagtcccgtgcagtcccagtgctagagcgtgggacggacttgtggggcacccctcggtgttctccagccaggcctgggggcaggaggcccagccacgctgccgggtgcaggcctgcccctgggcgcccgcccgcgcgccgtccccgcccctcggccgccccctccgccccggcgcgggctcgggacgtgcagagccggcgagcgagcagcagggactgcgcctggcgcactcacttccgcgtcccgccgccctccggcccgcgcgcgccgatccgccgccgccatcggacaatgggccgccagccccagctgccgtgaacttcctgccgctgctcggccgcccgtgcgtcccggacggcgttcctgccaggcgccggccgggatcgcagctccggggaagcagcggaggacccagcgcctggaacgtacctgcgcctcagccgccgcgcgtttgctccggcccgactcgcggcctcggcgccctcccggccgattcagcttcacccggcccagtcggctgctgccttgctgtgagtttccgtgtttggttgcctaaggaggatgtgattttacttttttgctgttttctttttccttttataatttgaagaggagaaaagaactccgctgagcaggcccgggacggcgaagtgccaccagctaccccaacaaggacgtctccaggggaaagggagttggaagcaaacttggtccagctggcgttgaggtctcaacttcggctggactcttaaatcctggggtcatgcccttcacgctaggcaggtggaagtctttagttgtactgggccggacttgagccccgacccttcgccagcatctccccggtgccctctacacacacacacacacacacacacacacacacacacacacgcggcacctgggctaggcccggacacctgtctgcagcatggataagtatgacgacctgggcctggaggccagtaaattcatcgaggacctgaacatgtatgaggcctctaaggatgggctcttccgagtggacaagggtgcaggcaacaaccccgagtttgaggaaactcgcagggtgttcgccaccaagatggccaaaatccacctccagcagcagcagcagcagctcctgcaggaggagactctgcccagggggagtagaggccctgtcaatggagggggccgcctgggcccacaggcccgttgggaagttgtgggcagcaagctgactgtggatggtgctgccaagcctcctcttgctgcctcgacaggggcacctggggcagtcaccaccctcgctgctgggcagcccccgtacccaccgcaggagcagagatccaggccatacctgcatggcacgaggcatggcagccaggactgtggttccagggagagcctggcgacttctgagatgtctgctttccaccagccaggcccctgtgaggatccttcctgcctcactcatggagactattatgacaacctctccttggcaagcccaaagtggggtgacaaaccaggagtgtcccccagcatcggcctgagtgtagggagtgggtggcctagctccccggggagtgacccaccactgcccaaaccctgcggggaccatcccctaaatcaccgacagctctccctgagctccagcaggtcttctgagggtagcctcggtggtcagaatagtggcattggtggccgcagcagcgagaagccaacaggcctttggtccactgcctcctcccagcgggtgagccctggcctgccttccccaaacttggagaacggagcaccagctgtggggcctgttcagcccaggactccttctgtgtcagcacccttggccctgagctgccccaggcaaggaggtcttccaagatcaaactcggggctggggggtgaggtttcaggtgtgatgtccaaacccaatgtggacccccaaccctggttccaggatgggcccaaatcttacctttccagttctgccccgtcatcctcgccagctggcctggacggttcacagcagggtgcggtccctgggctggggccgaagcctggctgcacagaccttggcactggtcccaagctcagccccaccagtcttgtccatccagtgatgtccaccctgcctgagttatcttgtaaagagggtcccctgggctggtcttctgatggtagcctgggatctgtgctcctggacagccccagctcccctagggtaaggctgccctgccagcccctcgtcccaggtcctgagctgagaccctctgctgctgagttgaaattagaagccctcacccaacgtctggagcgagagatggatgctcacccgaaggctgattactttggtgagtgagaggctggtggagttgcctatggtggggcgatggggttcttgagattggggaacatgccccctaccagggatgctgtgggctgtagttacctctctttgagtggcctgtttttttatttttttgttttgggcttcctctttcagctgctttttctgattcagaaacttgaaagcatcctggggcagaaagcggaccttgcagctggggttacccatgtgtgaagggtgcagcagggtgggattgctcatgactgctctcagaaaagagaaatgctgtgactttggatttcaagggttttgggtgtgactttagagcctcttgcagtgacaggctcatataggacttcagtgggaccagctttctcaggggcagctacccctgagcgttcagtctgtagttggttgggcagatctggttgatctggctgtttgagggaccagtgattgaggcaggggctcttgactgccgtgtgtgtgtgtctgtgtgtgtgtctgtgtgtagatgggtacttatgtgcagttgaggcaggtcaaacactaccatgaaagacttgtagagcagtggatcttttttttttttttttgagatggagtctcgttctgtagcccaggctagagtgcagtggcacaatctcggctcactgcaacctccgcctcccgggttcaagcaattctcctgcctcagcctcttgagtagctgggactacaggcacgtgccaccacacctggctaatttttttttttttaagtagagacagggtttcactgcgctagccaggatgttctcaatctcctgacctcgtgatccgcccgccttggcctcccaaagtgctgggattacaggcgtgagccaccgcgcctggccagagcagtggttcttaagtgtagtccctggatcagcagcatccctttgcctggaaactgattagaaatggaaattcttgggccccacccaagacctactgaatcagaaactgtgggatgggacccagccagccgtgatcctgctgtgtggtgagatttgagccctgccgcaccatgtgcctcctaacccagcctacacccaggtaacagccaacagccaggttgcaccacagccgtggcacaaactatgatggaaaatgtgtcttcctggttttactcaaacttgcatgttttgttttattctcttttttaaaaccacaaactcttggagactgctagcttcaactttttttctttgcacgaggtttagtggtagttgtatctttctgttgagtaatgattagttgtctcataagagagctaactagaaagacagcctattcgcagagaatcggaggggtttttctttttcagtttttaactttggataattgacccccgtgttccccatagcctgagtcctgctggggtagcagctctgcctagtggagggcagggacagggaaggccctgggagaggaagacagctggcttactgctgtcagtctacgcttattctccgtgaacgagcaagtgtcccaaggtcctttgagggaccagggtctgaggcactgggctgctggatgtgtgcagcttatggtagcattgtgttttgcttctcatgagaaccttgtgggagccagttctcaccccatactcagcaggctgaggtcagggtagctgtttatggcttactttttttaaatttatttttatttatttatttgtttatttatttatttattttgagacaaggtcttgccttgttgcccaggctggagtgcagtgcaccctagacctcccggactcaaggcatcttcctacctcagcctcctgagtagctaggactacttaagaggaagcaggggaggaaggggacgtggaggtggggggtcctctctaggttgcccaggctgttcttctgggctcaagtgatcttcctgcctcagcctcccaaagtgctgggattacaggtgtgagccactgtgcccggcctactggtttattttttaaagcacatggcaccatcttactgtgaactatcttttctcctcagcacattcccacatttgggagtaatagttagctggaaatactgtgggtcttttaatttaaacttttgtttagttgtaaatttcaagctcattggacaacacaaacagcagttttatcttgagatgcaagtttatgctgtgcatcagagcaacggtattagctgacgctactcatccattcagcatatattaaaatttattgagcacctatcttgaggccatgctctattccaggtcttggggatacatagtgaacaggacagacaggaacctctgcctccctggagcagacaatgtagtagaaggaggcagggagtgaatgaagtaaataagcaagtactagggagagaatcaaggtagagaaagggaatggagccctggggctgggggtggcagagagatttccagttttaaattgggtgatcagggaatgtcccacctagaagatgcatttgagcaaaggcaggcaggagactggaccatgtgttttcccagggaaatggtgttcttggcagagcagacagcaagcacagagtccctgtaggcctggtctgtgctgggcactgtactgaacacttgatgctgactattgaattgactggtcacagcatccttggaagctggttctgccattatgcccattttactgatgagaaaacggaagctcagggagattaaattacttactggcggtgtcacaggtcatattgggtactgctgggacttgaacctgacagttcagttcagcctcagggcccatgtgtctaaccagcattgccaaacagtctcccaagcagagatttggaagcctattttatttatttatttttatggtttttttttaattgagatgaaattcacataatgtaaaattaaccattttgaagtgaacaattcagtggtgtttaatattaatacattcacaacgttgtacaatgaacacctccgtccagttccaaaatgttttcgtcaacccaaaaggaaaccccatacccataaagcaattgctccctgtttccccctatcccctcccagctcctggcaacaaccaatgtgcattctgtccctatggcatttacctattctggaatttcatttagaaacggaatcgtgtattttattcattttttgtataaacttcacagataagcaagcacgcacagtgaaaatcgagcctctttccctggtctgtctagtcaagtgttctgggtgtaataagcatgtgtgtgtttctgccagccccagtggtggcatgctgttccactgcacagcgtcttggcagtggctctacatcagcatgtgttcagctggctatacgtggctgctgtgcaatgtgcctaggtcacctaaggtcacctaagcagccctcactgatgggcctttggaatgtacccacctacaaggggcaggcgtagctgcaagatgagctcccaggagtgggactgtggggctgcgtggtttgtgtcctttaggtgtggcttggttgcttcctgcagagctcatgccagggctgagctgccagctatgtaggagagggtttgctccacacctgctttggtggcagagcttccatctgctcttctgcgacctaccttggggcagaggaggaagtctttcggtctgaagattggcagtcattgcctggccctgtgtggggaccatgaagagaccacatgctcctccagaccactcctcccttgtcggtagcctgaggaggctggacagctgaggggctccctcccacagatactttttcctcccctacatctggtattacttgaaagattttgtctacccaacacgctacatttgttaaataatggttagattctacttccaaacagaagaatgtttaatggtgcagggcgcttggcagtgagagtcagagtgacacaactccccatgagaggtgatgtcactcaggccaaaagcaaagcaaagtagatgtttgggttagcttgggccccttcctaggttgaactgaaggtgtccctttgggcatttgactttgtgggaagagcttgtgaatccctgttgccacctttgtaagcccttagagtctcaagatgcccagtttccagttactgattaacttggcacgggaactctcctggcactttccatggctggtctttgtgggtttagtaaaataggatcctacagaggcgtgtctctttccctactctgctgggcctacttcctcctccagccatcctccccaccccctgtccccgttgcctctttgtgtctctctgtccatgttgttgggtttttggtcttctaggcgttgctcctggcctacaccacctagtgcagtgtggcttctgttttagcaccactgctgacactgcagaggtggggtgcagagggcaccgtgcctttgttagttgtgccccaccgtctcctccatgtgatccacctatcttcctcacactggtcctcttctccctttctaaggaaaaaggacacaagccgggtgtggtggctcacacctgtgatcccagcgactcaagagactgaggcaggagaattgcttgagcccaggagtttaagaccagcctgggcaacatagtgagaccccatctctacaaaaaacacaaaaattagccaggcatggtggtgcacacctgtagtcccagctacttgggaggctgaggtgggaagattgcttgagcccaggaggctgaggctgcagtgagatatgatcatgccactgcactccagcctgggtgacagagggagaccctgtctcaaaacaaaaacaaaaacaaaaaaccccacaaataaaccacttgtcataggctgggtttcctgggaagctgactgagacagagttgaccatacaagggcttattaaaaggtgcttttggggtccccacctgtggaagatggagaaggaatcaggagtgggtagaggagagctgagctgctgggacctgaccccgcagggagcctgggagctggaaaagtcctttagggtcatcctagttggcctgacatggcctggccttcacactccctcatggatcagctgttggctgtgggctgcccaggaagatggtgactttgggcgaggcagctctgtgcagctgggatagtctcttcaggggctgacaggagggcaacctgcctgccgcaccccagcagctgtgccctcccctgtcctcgccttcatcgaagggcctttgcagcatccccacagtgcccccttcctgggggcaggtaggagcgggtgacttgggcattatggttctagtagtagctaccgtgtgtcaagtgccagtggtgtgccgggcactggagttcagtgctttgtgggccttgttggcatttaacctgcacacttagttttgatgtaggcaccattctctgtttacagttgagaaaccgaggccagagaggttaagtgacttgctcaagaccatatgggtacaagtagtggtgctcccataccagtcgggattttgcttctgctctgaccacttgcatggtgggactaggtggtctctcacgtctgagtggatgccttctattgcccctccagattcattctccacccacgtactgtagggagcttttgtgggctccttgcgttttccatgccttcttcccccatatttcaggctgtggacttttttattttttttttgagacagagtctcgctctgtcgcccaggatggagtgcagtggcgcgatcttggctcactgcaagctccgcctcccaggttcaagccattctcctgcctcagcctcccgggtagctgggactgcaggcgcccgccaccacgcccagctaattttttatatatatgtttttagtagagatggggtttcactgtgttagccaggatggtctcgatctcctgaccttgtgatccaccctccttggcctcccaaagtgctgggattataggcgtgagccactgcgcccggcctgggctgtggacttttgtgtcccctggacctgaagcccctgtgctcaccctccctgctgtgggtgggcctggggatctgtcacggctaaagctaaccaggagagagccacattctgctcgctgttaggaccagaggggtgggaaaggcaagaataagcaggttccagggtctcctgtacccaggaagtggatggacaggcctgctcctcaccagcatggagaaaggaagggttggcattgtgtttggtttttctgtctttggtggatgtcctttcagcagtatcctaacccagaaaactgcagtgacagaccccccttagcctgggatcctgaaagcaggtgtgactcctcctgagaatggccctgccctgaccggggccagggagcctgtcttacttgattttactttcctggcaatgcacagggttaaacgagcagtccaagcaaggaacatgtggatgtcctatctatgtacctacatgtcctatttgcatgactacagatgccctatctgcatgtctacatgactacagatgcccttccatctgacagtctgttgcacactgagctgctcctcgttttcatgactttttttttttttttttaaattgagacggaggctcactccgtcacccaggctggagtgcagtggtgcgatcttggctcactgcggccaccgcctccccgggttcaagcgattctcctgcctcagcctcctggatagctgggattacaggcgcgcaccaccatgcccggctaatttttgtattttcagtagagacagggtttcgccatgttggccaggctggtcttgagctcctgacctcaggtgatctgcccgccttggcctcccaaagtgctgggattacaggcgtgagccactgcacctggcccttcatgactttttaattactgtttatcagactttattagcaatagatgcttgaaatatggtgcttaattccagcctagattaaaaaatcgagcatttttcacataaaaggaaacaacatgggctagtcttgtaataaagcagcccctccagaattccagaacagaggtctgtctgtgttccccagaggcactggctaaccagcctcctcccatatcaggcatttcattaaacccaaaccaactgctgaagtggaagaaagtgacagaagctcaacagctgtgtgcctctgtctgagtgactggcatgactagatatgatgacgtggggactgccaccagaatgccttttggagatgtgccataatttgaaccagccgaatccaggtttccattgacatggaagtaaatttctgactctgctggtaacatttgtcagtgacattcaagattccaatctctctggccctgcagatgcacacccagggatatggggatgcccaatcctttagacatcgggcagtctctgtgcattcttttaaaaaattgaggcagagtctcaccatattgcttaggctggttttgaactcccagcttcaagtgatctcccacctcagcctcccaaagtgctgggattacagtcgtgagccactgtgcccagcccatgcatttttttaatggaccaggcaatcttcctaagtcaggaagacatgtattcttaaccttttattgatgtacgatgtacacatatcatagatgttcacaaagtgaacccatctgtgtagccaacacccagatcaaggcagaacatgaccatcacccaggacgctccttgtgcccctgtacagtcaccaccaagtgtccaaggatcagctgtctgatttctgatagcaaaaatgggcttttaaacaaacatgggatttgatgtaacttttaaaaacttggaaaatgtaaaaacacattatggcatgtttggggatggatgaatggagatcgtgtggctgacctgggtgaagcttgggctggagacagcaaggagttggtgccgtctgcccagggccacctccactgtatgtcctcctgggctggaagctcgccctgtaacagcggtgactcctgtgtggtcagtggtcaaggactggataccgtctcggtcctctgtgttctctgaagggatgtgactacatcatgtgcctcagccccgtccctgcatgccatctctctccacagcacttctcttcagagttttccaggggcagaggtgaggaagctctcaaacttcatttagataggttcatctttttgctcaatcagcaggtcaatgatgcatacgtgtcaggtcacactgtgttctcagcactgggttgagtgctgtggggaaggacagccagtgcgatggattcacactcctctcactgtgaccttggagaccctcgctctggcccacccctcctgtgcctcaccttgctccttcttccccgtcatcccagccttgttttctctgagcctgttgaggtccttgccttggtggctcccaacggatgttcttctggccagtgctgtgctgccaatgccaccaatcccttccaagcaggctgatctgctgggagctgtagccctggcgcgtcccgacatggattcccacagcgtctgcctgtcccgtcatgctttctctctggagtcctccctccttggtatggtatgtttctgctctgttcttttgtgaccaggaaagaatgtcttgtttcttccatccagccctcctgctctttccattaacagtccagaacatgaaacggttattttgacatgatcattcttgccaggggtcttaaaaagttatgtttctttacatctgttgatttgtgactgtcacataggagacagaactgtgcaagaaagacacatatttgggagtcaggaaaccaggtcttctgggcctgataccaccagcagctcagggtgtgatgttgggcaagtccctctagctctattgagccaagatgacctctcagggtccttcccggcccaaagtcctgtgacagtggcattaggtataactagatgcctgggtttcagctaaccatgtaacagggactgggcagcattattgttggcagtggcagagagcctggaaaggcagaggccaagcggcctggcatcccagcccctttccagacctttacggaattaaaaaacaatttttatttttagttatggttacatttgcaattgtaagtggtaatcacttttactttagatattctggaaaatacatacaattaaagaagaaacatgaatcactcatgtaccttccattcttagaataatcagtgttaagactgtctgcagaaagtatccagtacaaagtagtggctgagcccactggtgatacagaatgtatcaggcactgtgattcttggatctctggccaaatgtagaatcatttactgagctaaaggccaatttgcttggaagagtgcatctaattaaagtgagattagaaaggacgaaaggtgtcctttaggaaataaccacacatggcaagccactggtatgatgatgatcaccaaccctgcaggccttttgaggcgctcattccaattaaacttgtcatccttagtgcagggggcagctgggagctctggtttgtggcgttcactgtccttgtttgtaccggcatgacccagtcctctccgtgggctcctgtggcgccctgggtgttgttgggtctcaggcctgatcatttgtcataggacagtgggctcaggcccagcagtgtctgggccagtctcccttctttgtcccagtgccccacatgctgtgggctccgtggatgcctgttgaaggagcggagggacttccattaggccgtgaaggtggaataagggatttttagctggggttatggctctgagacagttttactaaaattggtctagcagtttctctgccagacacttttctaagcacttcttatgctttactcacctgtattacgttgttcaatcctcccaacaaccctactttattaaccccatttcacagatggagaaactgagctacacagaagttaagtggcccgcctagtacttttatgaagtatctttgctgagtctggctgctgagttggagattttgaccactgtgttgtgatgcctcttagctcttggaagtttctcctttctaacaaagaagaaacttcaggggctactgtggctagggtaggtcaaggctgaggtctttttgtactctggtggagccagggccattccaggagcagcaaagaaggcagagtgtggaggcatgcctgagctgactggaggagttgggtcccactcttgcaacgagaggctgtctccagctttctcttctgtccaggagcgtgtgcctgcacaagtgcctccctgcagggcagtggacagagccccagaggctcggaggcacatgggctgccttgtgttcctctgaagaggtgtgggttagggcaagtggaccatgtcctcaggggtgctcgtgtgatatccccaagtgctgcaggcataggtaggggtgtgccagcccatacttcccttgggcgtgagcaagatgccttgtctgggggtcaggagcaaccccaggctgtgtgcagaggtgcttgaaccaaattttgttttgttttgtcttttgtttttgaggcagagtctcgctctgttgcccaggctggagtgcagtggcaatatctcagctcactgcaaccttgcttcccagtttcaagcaattctcgtgcctcagcttcccaagtacctgggattacaggcacactccaccttggccggctaatttctgtatttttagtggagacggggtttcaccatgctggccaggcaggtctcgaactcctgacctcaagtgatccacccgccttggcctctcaaagtgctgggattacaggtgtgagccaccatgcctggcctataaccaaattttggatgacactgtccttagagtccatccagcaaactgaacagaaaccttgtcctaaaacaaaacaggtcaccgaaatttccaaggcgtggcaacgcagggtagcacttgccagcgaatatttatatccactccagtttttgttttccatttttccccttacagggaaaccagctggacacagggtctcggggtcacactggaaggcaggagactttctgcttgagtgtttcaaagggagttcttgggatccacagccaggttatttttaagttttgagagccatgagtttaaacttggccaagttccttcctcatctttcttgttgtctgactgtcgctgtgtccccggggagtgaggatgggttactcccggttactgaaagctggtggggagcatctcaggggtctctacctccctccccacaaacatgttttgtagcacacaaaaagttctggaagcctgccatgatgctgtcattccagggagggagtttgcatttagcatgagtcctccctgcagctagttctggaaggatagtgactgaggtacttagaggacctagtggataaggcacccctctttagcaggcaggctccaagtcagggggtgagcacatattccagcaggcccgagctggccagcatgtgacggccatttcaggtggtaaagcaggagcagatttgctttttgtgcccgaaaccccttctgacaataacagcggcttccctgttcccctgcacctccctgtcagccgagttgatggatttcctttcagcagggtggaaccaagttatggccacgtttgctcgcgtgatggtcagggctggccctgaggttttgcatctgccaaaatgtcgcctgttccctcccctcctgctacctcagtttgcattccttcctgatgatgcagtgaggtagtaaatttagaaagaaatggaattgggggcagctcagctgctggccatggctaggttccagggcatttgctgacagttatctttacattaaatgtgggcagcaaggattgcattgcaggcctgattgtgctgctttctggctgtaagcttgacttttctgcttcacttttctgtcctcagtttcttcatattatggagactggaggtcctgtgctgcttataatcctgtgtcctttcccttgctttgagcctcagagccagttttagattcagggttgttggctgggagaagactcttggctctgagggtgacagtggtttagggagaacttgcttcggacaccttgtgtgtatgggcgggggcatcgcaggcatgtacattggttgaacttggaagctttccctcatttgcttgcagagaagcccactgacggagtgaagaagcctgagttggggagggtgtgaaaaacgtgtacaatgacaaagtttgtttagaagcaagagaggccctgtctctaagaagtaaggagaatgacgctgggcacgtggctcacacctataatcccaacacttttggaggccgaggcgggcggatcacttgaggtcaagagtttgagaccagcctggctaacacagtaaaaccctgtctgtactaaaaatacaaaaattagctgggtgtggtggcgcatgcctgtagtcccagctactcgggaggctgaggcaggagaatcgcttgaacctgggaggcggaggttgcagtgagccaagattgtgtcattgcactccagcctgggcaacagagcgagactcggtatcaaaaaaaaaaaaaaaaaaaagaaggagaatgaagaaataaaaccaaacactgaattagtgataaggttcaaaatagaaaccgaaagacctggtctgtagaagttactcatgagatatttgttgaatgaatgaatcatggtatgtatttataatattacccaatcagaataaaaaagggaaatattttggtgacagtgctactgtttgctcagcagtagtggctaagaaacagtggatgctacataggtattttctccataacttgtgcctggtagtagctgtgccaattttcaccagaccttgattacctgttagagttttgaagggagagcttatctggtgaggacttgggtgacgttgcttgtgggaggagggccaagcacggaatggaagttgaatgttagaagtgctagacctccagattcagtaaacttggagaatccctgtcccttgtggtaaacttgagacttgactacattttgcggttaagggaatttcagtcggtcagcatataacctgggggagcttcatgatgttctcttcttttttctttttaattcataggtgtgatcatagtacactacagcctcaagctcttgggctcaagcagtcctcttgcctcagcctcccaggtagctgggatacaggcatgtgccaccgcgcctggctctgaatggttccttggtttccttggtgggtggagctccagattcctgaagctggagttgtgggcatgaaccccaagtgggtcactggctttcctgcggggttccacagccctcacttacccctgccccagacctatctttgcattaccacatccagaaaaagtagttccaagccaggataactcattcattcagcagctattattgagtacctactatgtgcaagagactgaattaggactactagggcttccttttgtcacaaacaggtattgcttagttcctcctgctgtatctgagctccttggtagtggggtttttgtctgttttgttcactgttgtatccccagggcccaaggcactgcctggcacacagcaggtacccagtggaaacttactgaatgaggctgggtgcggtggcccatgcctgtaatcccagcactttgggaggccgaggtgggcagatcacaaggtcaggagatcgagaccagcctgaccaacatggtgaaaccccatctctactaaaactacaaaaattagctaggcatgatggcgcgcgcctgtaatcccagctactcgggaggctgaggcagaagaatcacttgaacccgggaggcgagtgagccgagattgtgccactgcattccagcctgggcaacagagcaaggctctgtctcaagaaaaaaaagacttctcgaatgaatatgtgtacactctggccagatgtggggagcagatactccctgacttcctcctgagtgtcagtgcctttagctgggacacacattctggcatcaatccataccctacactgacgtggtagggaggcaggggcactgggctgctgtccacatccctcaccctgaccagagttactcagatgagcgctctcatgtgggtaggagatgcctttggtagctgaggactagaggggccagaaagggttgggatacatgctttatctggatagaaacttatagagttccagggactagctcaccaaaggcctgcgcaggtttggcagggagcagggagacatgctggcaggcatgcatggtggctttgatttgaggagctgttggtgggaatgaaaagcctaataagcacgtgggctttggatctgccaccccccagctctgccaacagctgtgagaccttgggcgggttgttcagcagccctgtacctcagtttccccatcagtaaaatgtgcatatggttgtgaggactgaattagctagtatctgatctaagttgtccagtacgggagactggccacgtgcaactgtgaagtacttcaaaaggtggcttttctgaactgagatgtgcttttgaagcacatctggattttgaagacttggtatggagaaaagagtggcttattaatatttttcatattgattctatgttgaaatgagacttttggatatattggcctaagtaaaacattaaaattagtttcacctatttttacttcctaagtatggatacttgaaaatgtaaaatcgcacgtggcttgcatatttttctgctgggcagggctgtgccttacaaagcacttagaacaggctgtaacacatggtcgtttgctgtatacattctcttgctttgtcattttctcaaaagcatggaagcgtctttaccttgtcccatctgaaagccaagcccaatcgatttgttcagaaccacaaatgcttaaacaaaaagatcatcatttgttcaagggaggctgatttcatgattgccaaccaccaagtgagcccactgaggccaaatgcctgatgcaagggatggcaggctgctcccacgcagccttagaacgaatccgttcccacttgaagcaggggggctctggggtccgaagctgctgtgtgcacagggcttgatggagcaggtggtcattgcagctgagccaactttccagcgccttaaaaaatacactcagtttagcaagtacaggcagaaagcccaaagagatggcccatccccttgagggaggtagagaagtgaacgatggtgtttcctgtcccaagaggtgggaggaaggctgtttgggatttggctcatcaggggccacaggctactgggatgcctatgtcctatccctctgtgtaggctatggagccctttcctgggtatgggcctcccaataagcctgtggccaatgcaggggcaggctgggaggtggctttccaggcagcttgcaaaggcctgtttgtctgaggcttgtcctgacatcactgaggctttgcttgcaggtggcagggacttacacagaggctctttgttggccagccacagaggtcagttagaagccatgaatggactggagctggcagcccctcctctacccatagcacacagctgccacctctctgggttgcccatgcctgacggtgggtgtgtgaggtgtggggagaggcatctctgcccaaatttgtagccagagagcagaggaagtgaagttggtgggaggcggtgaggaaggcagggagaaagaaaggaggtggtgttgaggaagctagcatggcttctgcccagctctgtcatggtttgcaggtgcgcgctctctctctctctctctctctctctctctttaaagacaaattctcactctgtacccaggttagagttcagtggcaccatcttagctcactgtagccttggcttcctgggctcaagcaatcctcccatcccagccccccgaataactggaaacacaggtatgcacaaccatgcctggctaatttgttaatttttgtagaggcagggtctcgctgtcttgcccaggctggtcttgaactcctgggctcaagtgatcctcccacctcggcctcccaaagtgctaggataacaggtgtgagccactgtgccaggccttttgcaggctatttgatgtctgcattggatacttggggtcaggctcaatgcctggaagtcatttagtgtcattctgctgtgctctattactttaagcattcacaagcctttccacactctcacttcttgataggaggagtgtctaggaattgttttcaaaatgctgtatttgcatacagagaaatgtgtagttcagtgagttttgacagatgcatgcacctgtgtgacccacattcctatcaagatatagaatagttccatccccagaaagttccctcatgcttctttccagttagtgctcacctccaggcaactacaattctgattttttaaaatcatttattagttttgcccattctaagatgtaatataaatggattcatatagtatttatatacagttgatcttcattatccacagattctgtatttgtgaatcagcttacttgctaaaatttatttgtaaccccaaaattaatactcacagttcttttgtgatcattcacagatataacagagtgctgaaaagtttgagtcccctgacgcctatcttcccagctgaagtcgaacaaggcaacgctccgccttcttgtttcaggtcatgcagtaaacaggtgtccttttcatggtctatttagtgccatggtttttgcatttttgtggtttttgttgatgattttgctgtttcaaatggcccccaggcacagtgctggagtgctttctagtgttcctaagagcaagagggctgtgatgtgctttacaacgagaatatgtatgagagaagctttgttcaggcacgagctacagggctgttggctgagggttcgatgttaatgaatcaacaatatatactaaggaaggtgtctctaaatagaaacacacataaaacaaggtcatatattcatcagttgatgaaagtgttgtggtcagaagttttcagaaacctaaccctgtatttctgccagaagcagtggttcagtattgactgattcagtattcttgccaaataatgagaatcaactatagtactcctttgtccagcttatttcactcagataatatctgtgaaattcagctatgctgttgcattatcaactgggctttttgcattatcaattgtgcttttgttttactgctgagtaatattacattgtatggatacaccacaagatttgtttttccatttccctgttgaggttttttttttttttttcatttttggctattatgaataagtctgttaggattgtttttgtgtaagactttgggttttttttttgtttgtttttttcttttgtaaatatgggatctcgctatgttgtccaggttggttttgaactcctggcttcaagtgattctcctgccttggcctcctaaagtgctggaattataggcatgagccactgcaccttatatgtacaagtctttgtatagacacaggctttcgtttctcttgggtaaatacctaggagtagaattgctggatcatggagtaggtgtatgtataacttttttagcaactgccaaaaacttttccaaagtggccgtgccacttagcattcccacagcagtgtgaaagttcctctgattctccagctgtttttagaatttcttgggggccctgctttacttgttgctttctaagccacctgttctctgagctggcaacgcttggctgataccctcccaatttcctctgttaaaatattatcttcacaagatattttattcctttcttgatagtgatgggctgtgagcccatcactattttactttgcttctttgctctcttaagagtttgatttaaaaaacatttttttgtttttgcttttaccagttttctctagtacagaaatcctcttaggctgggcacagtggctcatgcttgtcatcccagcactttgggaggccgaggcgggtggatcacgaggtcaggagatcgagaccatcctggctaacatggtgaaacccagcctctacaacaaatataaaaaattagccgggcgtggtggcgggcacctgtagttaaaaaaaaaaaaaaaaaaggaaatcctctgcccgggtgctgtggttcacgcactttgtaatcccagcactttgggagctgaggcagggggattgcttgagcttagagattcaagaccagcctgggcaacatggtgaaactttgtctctacgaaaaatacaaaaattagctgggcgtggtggtgcgtgcctatagttccaggtaccggggaggctgaggtgggaggatcatatgagcccaggaggtcaaagctgcagtgagccatgatcacaccactgcattccagcctgggcaacagaatgaggccctgtctcaaaaaaagtgataataataataaaataaaaaataaattcctgggtgttttttttttttttttgccattttttaaaccttaaacacagctaactgtagaaaagtcagaaagtatagaaaaaaattggaaaggtcacccatcatcctactctagggataatcactgttaggatagacttttttttcttttacacatagatatttaattttaaagaatttgagtgaactaaaattaactttgttgtagatttggggactttagtgaaagttgggccaatagaggatgtcggggagcagaacttcccctcttctctcttggggtcctggtggggtctgaaaactaaattgacataggtaaatagaagagcatacacatttaataaaagttctatgtgacacgggagccctcataaacaaatgaagacccaaagcagtggcaaaacatacatgtgtttatatgaggttgaacaaagagaggcatttgtgggaaagtaaccaaattatgtggggaggctaaaggaaagtaagccttattttaacaaggtctgtttgtacagaattttctctgctgttactctccattgaagagtgtttgttttctcatggtacagggagggcaccttttattttattttgtattttatttgtatggatttaggggggagaagtgcacttttgttacatggatctattgcctactggtgaaatctgggttttagtgtaaccatcaactgaacagtgtaaattgttcccactaagtaatttctggctgggcagtaatcccagcactttgggaggctgaggggagtggggatatcttgagcctgggaagttgaggctgcctgggccacatggcaaaaccccatctctactaaaaatgcgaaaaattagccgggcaaggtggtgcgtgcctgtggttccagctactttggaggctgaggtgggaggactgcctgagactgggaagttgaggctgcagtgatccatagtcacgcctgtgtactccaacctgggtgggttgacaacttgtctcaaaaaaaaaaaaaagtaatttctcatccctcactccccacccaccctcttccccttcccttctaagcctccaatgtctgtcattccgcactgtatgtccatagggagggggtaccttttacatgggagttttcgtctcctgaagatgaagatgcccttcttgcatctgctgtttttcaagtgtctttagtttgatataatactatgtcaaagtggcatattttggggcggcatcttcagccagccttcaggggcctctagggattaaaaatagagttcagaagccagcatatgaaacattttccctttctgctacttgttggcaatgctgcttccctctggtttaagaaactttctgggagacttgtgtcaccccagtttctgcctttatttttcgcaggaatggctgggttctattttgatatgagtaattttggaatcagaattgagaactgggcccccttcctcctgaccccaacagggatctcttgccagctgcccccaacagggatctcttgccagcatcttcctgacaaacctctgttccttgctgtctcactctctcgagggacagctggacaagtgtcaatgagttgagattgttagaaggtttttcttctccagccagcagccttcccaaagacctgacctacttagcaggcagatggatcctgtaaaaacaaaaccgggtcacatccctcctgggcttggaaagaatccttcagtgcccccgaccccttcttcctcacccacagaattggagccaaagtcctgaaagtagccttggaggtcctgccttccccaccctgagtccctgctgtgtgctgcacccgggtcccctcctggctgtgagcccatcactattccagtttctttccactgcacaaggtagttgttcaggcccctccctgaaagatgtgttggttcttcaagattcacaagcaaatcatgcctgtgtgtgcattgcagatagctcacttacattagatttgatatgagaaagtctttttttttttttttgagacggaatcttgctttgtctcccaggctggagtgtggtggcgcaatcttggctcactgcagcctctgtctcccgggctcaagtgattcaagctgaggttacaggtgtgcgccaccatgcccagctaatttttgtatttttagtagagacggggtttcaccatgttggctaggctggtctcgaactcctgacctcgtgatccacccgccttggcctcccaaagtgctgggattacaggtgtgagccaccgtgcctggcctatttttttttttttttttgagacagagtctagctctgtcgcccaggctggagtgcagtggcaccatctcagctcactgcagcctctgcctctcaggttcaagcagttctcctgcctcggcctccctagtagctgggactacaggtgtgtgccaccccacctggctaatttattttattattatttgtatttttagtagagatggggtttcaccatgttggccaggctggtctcaaactcctgacctcaggtgatctactcacctcggcctcccaaagtgctgggattacaggtgtgagccactgcaccagtccaagatagtcttaaaaagcaatgtttttgtcttttctaagaaagggccctgatggtttgccctgcgttacactcccaggcaggcacagaaccgatgttaaactctccattttatcacatgaaccctgcccagtgccctacccattcctcccacgccaggctcatgactgcatgtcaagcacagttgtgccaggtgtctacctgctccatttctcctcctcccagcagccctgcaaagtgcccgccaattttctctcctgttttgaagatgggaaaactaaagcagagagccacaaggtcactcacctggtaagctgcagaactgaacaaagtgtgcttgtgaaactttctgtttgttctaaggagacaactgtgggtgggtggactctgctggaggctgtcccttgcctggctggcagcaaccaagccttctgcttctgacttgctggggagcgggaggacgggaagggctgtcggtggggaaattggagagaatacaaaacctcccctcagctttaataggctctaccaacagttttcactttgcctcttttccttctctggtatagccttcctcctctttggtgaatgcagattcagagcatctctaaaatctactctgtgttacttctgaggagaattcgggattttattttttctggaaaaatgaaaggattttcattctggttcccttctggttccgtgtggtggggcacctcactgcctgaggtcactgacctctgagcccttcttgccactccagtcatctctgccccacatggacacactcagccgcctgctggagtttgtgttttccgtggttggagggaggcaggagggcagttgaaagcgtgctgagtggggagatgggagcagggagctgtgagaaggagagaagctaaggtcagattgcgtgcgtcattcattcattccttcactcacttggtagatgtttattgagcgcctgctgtgagcttggcacctgctcaggtcaaaagggtggctgagtcctcaagggccctgctgtcctatggggacagttccaatacagtgtggtcattacccagtggaggagtagggaggggcgtggggcagggaaggagagagctcagtccggagagtctgggaggcctggggaagaactcaggaggttttgtgaagtgcagtgtgtggaatgtgggtgtctgtgaggagagtggttttatctttttatgaattcactgtgctaaggcctggaagaaaacacctttcctagaaagggagggaaggaaatgaacttttatggggcacctctgtgccaggagcagaggtaagagcttacatgatctcacttaatcctcaccgctaccctgtgagatgcatttattgtcacagcccatttggtgggtgaagaagccacaacgatgcccgaggtcagatctgaacccagtgcttataccaaaacccactgtttacagttccactgcaggagggaggctgtggacgtggggaggaaggtcttgccgctgggacccaccaggactgcagggtggtccttaggttcagcaagagtggacccgaattctggggctagtgatgctgtgattcctgatctgcttgctgtttaccaggagtgcttactttgtgaaaaattattgcgttgtaaacttaacaatatttgggcttttctttatgtatgcatcactaaaaatgttttttaaaaaactatactctctagaaaaggacaatgaggtaatggttttggaaatcataaaatgtttttgttgcttgtcttatctaaactgattaccagttgtgtgtataataaatgctagctcttctttatttatctattatttttttttcttgtagagacagagtcttactatagcccaggctggtcttgaactcctgggctcaagcagtcctcccgcttcagcctcctaaagttctgagattatagatgtgagccactgtgcccagctgcgagctcttctttatacttgagtttagattgccagatttaacaaataaaaatacatttgaatgtcagataaacaacaaataattttcagtataaatatgtaccatgtgatggtacttacactaaaaatacttgtttatctgatattcgaatttgcatgggacagtcactaaaaattatttgttgctatgcttaaattcacgttttaaggctgggcatggtggatcacgcctgtaatcccagcactttgggaggccaagatgggcagatcacctgaggtcaggagtctgagaccagcctggccaacatggtaaaaccccatctctactaaaaatataaaaattagccgggtgtggtgatgggcacctgtaatcccaactactcgggagactgaagcaggagaatcgcttgaacctgggaagcggaggttgtggtgagctgagattgcaccactatactccagcctgggcaacagagtgaaactccatctaaaaaaattaataataataaccaaccccccgcccccccccccaaaaaaagcacattttactgggcatcctatattttatctggcaaccctaaattaagctgagacctgaagggagtaaggagtacaactgagccttatttgagagatcagagaatttccaggccagatggaaggaaataatccagtagagaagcaaattggtggaggatgtcggatggggtattctaaattgctggtgggaaaactgaactgatgtcaagagtgggtatgtggagtgacctggaaagggagaagcgatatgaatgttgcactactcagcctgcatgatggggtcaagacactttctgctggaggttgacatttgttttagtagtttatgttgatgcaaagatcctgggaaacatgcatgattttgagccttttcacaaggaagggtgatgttaaaagtgagctaacttgagaaactggcttcaaaatctgggccaatttgagcaacaaaataaataatggtagaagggtattgtaacccagagaataaaataaatatccacaagtccttaatgatgatataaatacataagtggggagaagggaaaacttttgtacagaggattccattagtaaaatgtagaaagaatgatgaaaatgaagaggtcagcatttggaaagaccactgtaatagttgttgctgtcaagaatcatcaatggggctgggcatggtggctcatgcttgtaatcctagcacttggggagtccaaggtgtgtggatcacttgaagtcaggtgtttgagaccagcctggccaacatgatgaaaccctgtctctactaaaaattagctagaaatcgcttgaacctggggggcagaagttgcagtgagccaagattgcaccattgcactccaacctgggcaacagagcaagactctgtctcaaaaaacaaacaaaaagaatcatcaatggatgctgcatagtgggcaaaaatatgataaggaatctcaaatatttcttcataaagctcttgcgctaattccaaagagaaaaagagtaattttacagtggagaaatctggccaataccaccttaactaagtgatcaagttaacaccagcagtaaaatgttctattctgcatgttgacatcatgtacacccatgtatgatgtactgaggagggtacaccatcactcctgggacattcctgccaaaaatgcatatcctcagtctgatcatgaagaaacattaggcaaaccccagttcgggacagcatgcaagataattggcctatactcttccaaagtaccaaggtcaagaaagacaaagactgaggagctgtcccaggttaaaggagaccaagagagacaaccactaaatgcagtggatttagttccaggattgaattcctcccttcccctcccctcccctctcttttttcctttccttttcccttttctttccttacagggtcttgctctgttgccagactggactgcagtggtgtgaccatggctcactgcagccatgaactcccaggctcgaacaatcctcccacttcagcctcccaagtggctgggtctacaggcatgtaccaccacacctggctaattttttaaatcttttttattttatgtagagacaggggtcttactctgttgccaggctggtcttgaactcctaggctcaagagatcctcccaccttgacttcccaaagtgttgggattataggtgtgagccactgtgcctggccaacattttcattattatagaaacgtttctattaggcagtgctactctagaatatgatttttaaaagttgtgtagtatttacttaactttacctctgcattggttatttatattttctatttttcgtatttaagtgtttaatattttgatgagtagttttgcacattctttcttaaacaacagcatttaataacaggtatacttcacattaccgtaaatccatcaattgaaattgtgcaattcaggctgggcgcggtggctcacacctgtcatcccagcactttgggaggctgaagtgggtggatcaaaaagtcaggagatcgagaccatcctggccaaaatgctgaaaccccgtgtgtactaaaaatacaaaagttagccaggcatggtggtgcgtgcctataatcccagctactcgggaggctgaggcaggagaatcacttgaaccagggagttggaggctgcagtgagccgagatcacaccactgtactccagtctggcgacagagcgagactccatctcaaaaaaaaaaaaaaagaaattgtgtaattcactggtttttagtgtatttgcagagttgtgcaaccatcaccactatctaattttagaagatttttattatcccagaaaataaactctactcccactagctgtcactccctgctccgctgtcctccagccctgggtaaacaggaatctactagctgtctctgtgcacatctattttggggagaattttaaattattttccttaggaaaaattctgttaaattacagtagtctgccctcatgcgtgagggatatagtccaagacccccagtggatgcctgaaactgtgggtagtactgaaccctatacacactgtgacttttcctgtacacacatacctatgataaactttaaattacatatcaggcatggtaagagatgaacaaatacaattataaaatagaacaattatagcacaattatagcagttcactgtaataaaaattacgtgaatgtggtctttctctttcaaaatatcttgctgtactatactcacccgtgttttgacaatggttgactgagactgaggaaaggggagactgctgtatggggtcaaatagtgtgaacttttttaaaggaatttttttttttttttttttaaacagagtctcatgctgtcacccaggctggattgcagtggcatgatcttggctcactgcaacctccgcctcccaggttcaagcaattctcctgcctcagcctcccaagtagctgggactacaggcgtggctactgcacctggctaatttttgtatttttagtagagacagggtttcaccatgttggccaggctggtctggaactcctgacctaaggtgatgatcccgccttggcctcccaaagtgctgtgattacaggcgtgagccaccgcacctggccttttaaaggtttttgatgcatcatgccaaactgccctccagaaaggttgtccacgtttatgcttccattaagagtgtatgagagagccctttctctacacctcggtgacactgttatcatccttattttccatctttgtcaatcaggttagtgacaagtggcatcccctctttgcatgtgactcctagcaaggaacacctttttgaatgctgcttggccattcctatttcgtattagagttgagaaagctcatcagcctctgtgtggagagactcgaagttaagaccctcgtgaggaaaaaggaagaccagacagaagggtataaccagaggctgcaggctgggctgccctggcgatagctggaggagagcttcatgtaggagttgggggtggggtgcaggacttgctcaggggtactttgagctccttgtttccctgtagagtggaggccaggaatcatttaggccagggaatagtagtgtccttgggcaaaagtatacctacgggcagtctggcagggcaagctcaagctcacagtgattgggaaattgcattagaaacttcctttcccactgtgatgaagtaaggccatcgttggttttgaggccatgtgtgttttaatggcaagttcagaatgaaaaaaagtaggctggcacaatgaccctatggcccatagtggtcttaagtacttcctttgtggcttggtgatggctttacccattgacgtgagagctacagagtgtgtgagggagagggcagaggcaggggatgtccaggatgccaggtaggatgcagggtgttgcgttatctacatctgtggttctcgtccctggctgtgcactagagtcagctggagagctttggccttacccccaaaacgggaccctgtctctggaggtagtgttgggcattcgcacatcgattctgtacagccagacttgagaagtgggaatttgatatgcgtgttagtcaggagcccagcagcagccacccctggagatcttttgtgagcttttagagtggctgggggaagactgttgctgtgatcattggtctagctctgtcccaaggacttggctcctcttcagaacctgctgatgcccagagctgtccaggtacacaggcagcaacttttggccaagaaagagccttgctcaagctgtgtttgggataactcataaaattatgttccaggctgatctttctagcatccctgcagatgctgactggatgccctgacccttgccccaacccctttcagcatacagtaggtggttcatagctatgtgatcttgcatgatgtctggtggtgtggtgggggcactgctctgggaggcctcccttcttcactgagagggaagtggcacaaaataaagtcgagatgtgagacgggggtaggagcagggccacattcattggctagcctggtagagcctttttatttaaaagctttccatcggccaggcgcggtgtctcacgcctgtaatcccagcactttgggaggccgaggtgggcggatcatgaggtcaggagatcgagaccatcctggctaaacagtgaaaccccatctctactgaaaatacaaaaaaataaaaataaaaagaaattagccgggtgtggtggcgggcgcctgtagtcccagctactcaggaggctgaggcaggagaatggcgtgaacccaggaggcggagcttgcagagagccaagattgcgccactgcactccagcctgggcgacagagcgagactccgcctcaaaaacaaaacaaaacaaaaaaaaactttccatcacaacaggagatgctgacttggtcgtcaccctggttggctgcatcctcagcctggctgtggacaggaaggaggcaggaattgtcttctagccaactgtcttgctaagggtgctctgctatcttcctttttttttttttttttgtaaatgctgcctttgctgggagagtggagtaggtgccccccaaagttcaaattgtttttcggctttgggtgtgcagaagatgatttaataccaattcagggtaacttatttcacgtggaaggctgcccaggccaggcagggttgtatctgcagttgaccagttttgccgtatgttaatggttttcagataatcttcctggaaccactgcagggggccaggacagcctaggaggcagagtggtctctgtcccaccctaaatcatagtgatttctcttatgtgtgttatatatagttgaggttccattgatactttttaaaagaaaagtttctacccatttaaaccatttgagaaccactgttgtgcacagagaaagttaggtcagcctgatttttatatatagctcactgatgccattaatatggagcctaaacaaacaagaaatgccgagtacctcacactcagtagatgccgaataagcatggaacacagttgtgtatgtgcctctgcctttcctgtctctgagccttcatttacctagaacaccttcctgctgactctggtttttgaatgtgttcagtgcttatttggcatctactgtgtgtgaggcactcagcatttcttgtttgtgggatcctttggggtttgaatatgccccccacagttcaagtgttggaaactgaatccccaaggcaacagtgttgagaggtgggacctttaagaggtgattaggtcatgaagactctgcccttgtgaatggattaataatggtatatctggagcgggttcctggtaaaaggatggatttagcccccttccctgctttctcttgcacatgctttcacccttccatgatgcagtaagaaggcccttggcagatacgggcccttcatccttggacttcccagcctctagaactgtaagaaataaatgtctgctctttataaattactcagtctcgggtattccattatagtagcacaaaatggattaagatatggcgatactaaaatatacagccagagccctgccctggcttatttggctcagtaagcttatttgtttgactaatatgaggagacatacactgctaaccctacctagtataaaatcataagccacaaaagagaggtgggagaaatgtttgagtaatccttggtggatcattgcctcctgctgcacatcttttaaaacgggaaactgtcccttgtttttgccctttcctgtgagaatattatgatttttaaaagaatcttgtatagccattttggaaaacagtttggcagcttcttataaaactgaacatattcttgttgtataatccagcagtcaccgtccttggtatttacccaaatgagttgaaaacttatgtccacacaaaaacctgcacacgaatgtttatagaagcttattcataatgacaaaatttggcaagatgtccttcagtagatgactgcatcaataaatggttgtatatccagacaatggcatattatttagcactaagaaaaaatgagctattgagccatgaaaagacatggagaaaccataaatgcatgttagtaagtgagagaagccgatctaaaaggctgcagagtgtatgattccaaagatacaacattctggaaaaggcaaaactttggagaaaataaaaggatcaatggttgccaggggtttttggggaggaacagatgaataagtggagcataggggatttttagggcagtgaaattagtctgtttgctactgtaatagtagatacatgccatacacttgtccacacccatagaatgtacagcacccagagtgaacccacacatgaactgtggacttcgggtgataatgatgtgtccatgtaggttcctcatttgtgacaagtgtaccactctggtgggggctgttgatagggaggggggctgtgcatgtgtgaggaaggggatatatggaaattctctgtagcttttgctcagttttgctgtgaacctaaaactgctcaaaaaaaaaaaaagtaaattcattgaaaaaatactggaaggaaataggccaaaatgataaatatcattttttaaaaataattcccactgaagtctgttggcctattgactattaatgatctttcaaaaatccactgtgctcccccacctcctttggtgtccccgaaggagaggccctgggcacacaaacaccttcttctggggccactccatgcccagggttccaagggccacatttctctgtgcgtaggggtgggcttggccttcatctcctagctgcagccaagaaggagctatgctgccatcactgagctgggatttggggattcgctggtgccccaaaaccatgaagatactaagttttagggataagtagaacccctggaccttttcttccccggtactcccttagcccctcttataagtgcagtaggatggactggaaaggatatagataagtcagcctgattttgcgcattagatttaatctttgaacttcagtttcttcatgtataaagtgatgatgttttatagaattgttgttaaatgaagaaacacatataaactgtctagcaccgtgttggcacttgtgatgtttaataaatgcccattctaggctagatgtggtggctcacacgtgtaatcccagcactttgggaggccaagatgggaggatcacttgaagccaggagttcaagaccaacttggtcaacatagcgagaacccgtctcttttttataaaatataaaatgaaaaagcccattctaaagatggagcatcagggactggatgaacctcctgcctaaaacaaccaaaaaaaaaaaaaaaaaaaggccaggtgcggtagctcatgcctgtaatcccagcactttgggaggccgaggcgggtggatcacttgaggtcaggagttcgataccagcctggccaacatggcgaaacaccatctctactgaaaatacaaaaattagcgaggcatggtgttgcacgcctgtagtcccagctactcaggaggctgaggcaggagaatcgcttgaacctgggaggcggaggttgcagtgagccaagatggtgccactgcactccagcctgggtgacagagtgagaccccatctcaaaaaaaaaaaagaaaaaagaatatatgaaccaaaggttttcaagacactggacatcaagaaggtgattcttgagagataggaagcaaatgaggtgagcccagtgacagccccagctaattgcctcgagagaatttccaggccttggcacagggagggagaagagaggcagaacctggtggactccctgagttgaaaaggagctgagagtctatggggaccaaggcagctagtttgtaggactctagcaaaacctttgtgaagcaatatctgataaagaacttgtatctagaatgtataagaagttctcataacagtaagaaaaaaaacaggcaaaagatttgggcgtctcactaaagaagaaaaggatgacaaataagcaggtgaaaagatgctcacacacaacatcagttactagagagatgcagattaaaactacaatgagatgctactgtataacctattacaatagaatggataacatttaaaagactattcatgccaagtgttggcaaggatgtggagaatttggaactctaatgagctgctggtaggaatgtaaaatgatataacttcttcagaaagcggtttgtcaatttcttaaacagttaatcatccacctaccataagacccagccatttcactcctaggcctttactcaagagaagtgcaaatgtatgtccattacaaacgcttgtacacaaatcttgatggcatctttatttgtaatagcctcaaactggaaacaacttatgtgcatcaacaagcaaatggataaacaaactaatacattcatatggtggaataccacatggcagtaaagaggaatgagctcctgctgcatgtaacagcatgcgtgaatctcaatttatattgagtgaaagaaaccagataaagtacataaaccagataaagtacatactccagattccatttatataaactagaaaagacaagctaatctgtgatgacagaaagcagatcagtggttgcctggggagaggaagaggaagcggggagggattgcaaaaggcatgaggacatggggaatctctggggcagtggatttgatcattgtcttgattgtggtgatttcacaggtgtatagaaatgtcacaacacggggctgggcacggtggttcacgcctgtattcccagcactttgggaggccgaggcgggcagatcatgaggtcaggagttcaagaccagcctgaccaacatggtgaaactcttgtctctactaaaaatacaaaaattagccaggcctggtggcacgtgcctgtaatcccagctactcaggagactgaggcaggagaatcgcttgaacccaggaggcagaggttgtagtgagctgagatcacgccactgcactccagcctgggtgacaaagaagactcttgtctcaaaaaaaaaaaaaaaaaagaaaagaaaagaaatgtcacaacatactgatacagaagcagggaagagaagtgctgggtagaggagggcatggtccctggctagggctctataccagggacctaggtgaggacaggcacttctgcctttgcacccaaatattgcattttccaaaaccaccccagcctgccttgctcccatcctgggcctataaaaacctgagaccctagcaaggcagagacagaagctgctggacggcgagaggaacacatcagcggaagaagatacaagcagctggatggcgagaggatgccaggagcacaccgacagacgccaccacactggcaggccatcagccggcagaacgaggcagagtttggctggggcagtcggaggagagcctgtatgctcccctagaggtttgagcaggggggcactgaagaagcgagccacactcccattgcacaccctgtgagagggacaagggaacttttcccatcataataccaaattgcactctttaaataggtacagcttattatatgctacttatatctcattaaagctgttttataagaagattgcttgggctacaatttggagaatgggctaaaggggcagtaagtctaattgcagaggaaaaatgcccatcccttcctctcttctcctaaaagtgtatcccttattcctctcacttcccttctggtttttgagcttggttgttacagtaacatgtgatgatattttttctttcctctgttgggcatttctttaaaatcctgtggcatggggggccctggcaaagccaagggaggctaagagcctactctttttcttcttgttgagcctgagcctctcctcagcccagaccacttagtgaatgtacaggtgagattgggcagctcaccaccagtggtggcagggtctggtttctacaagggcatggccacagtgcagtcaccctgctccctatcccatagccagcgtctggagaggggctggctccaaatgagtgagagggaagtgtttgtggggggaacgattggtttcctgaagggcaatcagaaggcacgcacctgcagggcccctcacagaagggcaggaggagctgcgggttgccccccagggagaggccttgtgattgaggtcccagtcagaaagatggtcgtgtgtgcaagggacaaggtagaatgggaggtgggccagggtgggtagtaggagactgggggcagggctggtctggggtctgaatccctgatgaggtgatatgttatggggtgaggaaggagctcccctcatgatggggggggttggggggcatgtgtggcaggaatagccacagctgccaaccagatagtcataatgagacctttgagttggaactggggctcagattccctctttcaaacctacccactgtgcagacttcagtaagtgacaggacctttctggaacttgggttttagacaggagatggcagcagctccttcactggttgaaatccccaagtctggctaggtgcggtggctcacgcctgtaatcccagcactttgggaggccgaggcgggcggatcacctgaggtcaggagttccagaccagcctggccagcatggagaaaccccgtctctactaaaaatataaaaattagtcaggcatggtggtgcacaactgtaatcccagctactcgggaggctgaggcaggagaatagcttgaaaccaggaggcagaggttacaggtagccgagatcgcatgctgcactccagcctggatgacagagtgagactctgtctcaaataataataataataataaaaatccaaagaaaaaaatatctgtgagtccatactgatatactgcactccagcctggcgacagagtgagactctctcaaaaaaaaaacaaagaaagaaatctccaagtccagggtctggcccatagtagacacatgatttcctagaatgtgaaatgcagtttttttccctaccttttctgtgtaggaagtacttttagatccatttagccacaaggatgaaatcttttcctacctacttggcttcttatggggtcttcctcactctgtgacccatggtttcaaacacaggtggcttccttgttttgtatctgtgctaggtggtcactggtcacggtggagagaaaggatgtcagcagcccgaaggactcagctgcaggaacagaaagtgagggacagctgaaggcagagggtcacaggcctcagagagaggaagccagaagagagtgtagctgagcagggtgtggagagaggggaggaagccctgccgttgagagataaagtggcaggaagtccagtggggcactggctgttgtcagagcatccacgtgaagacgctggccaccctgccagcatcttatgaacaggggtaggagagggtgctggatttcattccccaaacccaaataagatgcatttgcttctgccgtctgggccagcagcattgcactgacacgtgcaattcatttcacctttcctttttggtgagctgtcttgcaggacggtcctcttcatgtgctcatgctgtgggtggtggaaagggtgggcatgccatgctaagctgctgagtccctgtgcccctctgctgtttgtagccagcattttacaggaggttaaacaaagaggccacagcatttgggagtggttttacaccacgtttgtgagcagaattatattcacaaatgcactgctttaacattacatgtagcctgcttcgagtgtgcttagttgatgcctgacaaactagcttttgttgctcattgtaaaggcttagagtcaggtccaccaggggacttacgatgggtaatctggaagtggacttcggcattaccaaacaataacctaactcatatcttgacattttgccatggcctgatatttggcatttttcggaaagatttctcccccattgtcacatttgaattatgtcatcgccagttcccaatagatgtccatagaacccatttctctgtgtttaggtctgctgaggggatactaagtgcactctgtctgtggctgggggtgttcagagatgaataagaccctgggccttggaatgaagtgcttgtgggggaacagacatgtgtgcccaagatacaaggaagcaggtgccaggtaaggaagaaagaggaaaggactgtgcagggaactatgtggaatgtgattcaactcacacttgtttccttgagcacttgcggaggccacagttaagacatggcccttattctgaaggcacttgcaattcactaggagaggcaaatgcccaggtaactagcaactcaccacagcatggtaggtgctgtgcccagtggcagatgcaccaccaccatcacttccacatttgccccgtcccaaatactagaggccccacttggctcggcctggtccagtggtcactgtgcatgggcccctagcagcagccgcgacaccactgctttccagggtgacgagaccgcttaaaggagccttaaagatgagtggtgatgcctcaaccctgttgggtttatgctttgctgctaggtgggccccacagctccatgtgtgccagcaaaagaaatgcagtttgcccggaactgtattttctaccttgagagcataaggtacctaagttgtatataaaaatcattagacagaaagaaatgctgatgcctctgaattacttgatgctttcagtttcatactggtgggggctccctgttgactttgctgcttgcaaggaacagaaatgccagctgtccagtaatctcatccgcccgccaccctcccctccacaggcacatatacatgcacacacatgcatttcatggccattaaagagaagatggaagggagaaggcaggcaggaactttttgggggtgttggaaatattctatatcttgatttgggtttgctttacatagatcatttgtcaaaactcattgaatggtagacttacactttttgtgtctgtttgtgaattttacccggaaaaaaataagcctaagcaaataaatgatgaactctagttaatgatggggaggctgaagtgtttggggtgaagttgctgcctgcaactttgaaatgcatcaagaatgggatggattgttggattgattgaggaatggttagcaaaacattaattatagaattgggatggtgagtatgtgggtaccctctgtataattccttcaacttttctgcgtgtttgaaaatgttgaaacagaagaagaactgcagataaccaatacttgtgccctcttgagctttctataaatgaatttctccaatggtcaatgtcttgtctgtttcctacagactgcttcaccctgcttcctggtgttggcagaggggctttctccttaaacctgttggtgtgggggaatttcatgaaggatgtgttagcttggacttcctttgatggtgatgcagtttatcaacttaaaatgatatgaactctgaaacacagggctttctaccctgtgggcagaaggctggggatttgcagcctgagaatagccctggcagattggagccagagttagaaaaggatgcctgagctcctcctgaccaaaggatgccagctggctaccttgctgggtgctaggggagcaattgatatttataaaatctgtgaagttgatttttcaaaaattttaacattatataatgtatttgaacatattcaaacacttttttgagacgaccttttaaaatctgtaaagtaatgaatgcctgctgtcttataaaaaactacagaaaatgtaaagaaataaggccagctacagttttacaacataaagaaaccactgtttatattttaatatattcctccgtgaatcttttttcatcttgtgcattgtttacataattgtgctgtctttcatttgactgtaatgggggagttctttgggagggagactccaaggcctccttgatgtggatgggcccggagcctgggctgctactgtaggggttctgggctggcctagcctgagagacctccagcctgttcacagagcccatgtgagatcccgagaggcccagaacttcttagacagctctttttaagctgaaggcactttttgcaggaggcagtaacatgattgtcatccttataatttgcctgttaattgagcatttcccaagtatggggccctgcactaagtactttgcacatattctcttaacagtaaccctacgagggggccactgttgtccccattttctagcccaacatcggagtttaattagtctgcgcttgtcacatagctagtaaattgtggagctgttttagaccaggtgtcccaataagcactttgtagttgaggcatgttaactctttagaactttttggttttcaaagcaactcttaattgctgctcctgggaatatgcagggcagatggaaggaacctctatttcctaattaagaaacggacacccagagagctgatcaccattaatccaaactacaggagtcacgggtaggtgggaggctcaaggttagaacctggctcttcaaatttgttttttcaggccaggcgcggtggctcatgcctgtcatcccggcactttgggaggctgaggcaggcggatcacctgaggtcagtagtttgagaccagcctggccaacatggtgaaaccccatctctactgaaaatacaaaaatcagctgggcttgattgtgcattcctgtagtcccagctacttggaaggctgaggcaggagaatcacttgaacccgggaggcggaggttgcagtgagccgagattgcaccactgcactccagcccaggtgacagagtgagactctgtctcaaaaaaaagttctctctctctctctcgatggatgatctccctatgttgcccaggctggtgttgaactcctggcctcaaacagtctgaggaaggaatcgtggggcaggctgagatgaaagcctcaggacttgagtgaacagaagggcaggagtagaatgtactaggtaggggcccatcagcaaaggctgggctaagaccctgtgggacttgttagggggtgaggagctgctggtagaagggcagggaagagcacttgcttgcagtctgacaaacccagggcttggggtgtgatatactttttgtaaaaattgaggttactaaatcctagttggtggttcccactgaaaattaaaggaaataatttagttggaattgtctggccaggcatggtggctcacacctgtaatcctagcactttaggaggccgaggcgggaggattgcttgagcctaggagttcaagaccagtctgggcaacatatcaagatccccgtctcaaaaaaaaaaaaaaaagggaggaaaaaagaaatttcccaacctgcatgcttggcatattatagtgatggtgcaatctttctgaactgtcttacaaacagtgggaaccttcgaaagctttgggtggggtgagggagggagttgaccaagcccaggaattctgaacattagcataacagtggggcagggaaagtgggacctaaagtccagcctggtagctgttttctgcagttgaaagagtgacagagggagagggagagaaagacacttcaaatgagtcatccactggatttggtggtgggctggccatggggagggatggtattatgctttgttcattggcttttttatgactcagtttacactggttccctcctgactcactgatgtttctcttgtccttgcaggagcctgtgtgaaatgcagcaaaggggtgtttggggctggccaggcctgtcaggccatggggaacctctaccatgacacatgcttcacctgtgcagcttgcagtaagtgtgggtgtgggtgtcgggtgtgtgggggatgcataaggaacatgggaaccgagaaagggaggagagagaagatcatctttctggagacggttggtccatggccctcctcagccccacagaaaagccagacagtgtcttttacagcagggtttcttaccaccaacagaagcccatcagggcacggtgacttaacacaataccaaagattgcctgtgattctggtgataagttgaatgagttcagagtgatccctaatcacatcaggtttgaaatatgtaagaagaggtttcagaagatttgggaggaagtgctgggattcaccatgtctaccctgtttgtcagttctctcccccactgtggggaccagccaaccaaaagtgattagtcagtcagctaccccagtgtgaggtggaggtgggggtcctttattactctgtaaccacctccctaacctaatctttgatttggaggctgctgtatgagcatgaggtgtgtgtgcatgccacccatgtgctggtgcctacctagcacacacctgtgggcatctttgtactccagtacatgcattataattcaagcagcccatcaggagtctggattgaatggatggcaaccgctccccgtggaagattctaacacattgcatgcttgccaagtctgaccaagttatggattttgcttgttttctgtctctatcaaagattaattttgaggagtatttttggaaaatgtcctacttatattctcaatcctatactgaggctaacagctctcaactaaaagggaatgttacagcagagtcacagggtgtcaggaacaaaggggtctttctaaccatctggccccgtggtttgcaatcctggctgctcattagaatcacctgtggagactttaaaaccctgctaatcagaatcagagctaaatcctaatctgataggattagctaggaacctcaatctgattctgctaatcaagggtggggccagggcatcacccttggaatttctagagtgaggcaagtgtattaatttttttttttttttttgagacggagtctcgctttgtcacccaggctggagtgcagtggtgctatctcagctcactgcaacctccgcctcctgggttcaagcgattcttttgctacagcctcccgagtagctgggactacagatgtgcaccagcacgcccagctaatttttgtatttttagtagagacggggtttcaccatgttggccaggattgtctcgatctcttgaccttgtgatccacccacctcggcctcccaaagtgctgggattacaggcgtgagccactgcgcccgcccaagtggggcaagtgtattttttcacagcttctcagatacttccagggtgtgatcagggctgactaccattggtttggggatcctcattttgaatccttctggagaagggaaggggaagaacttgctcacagccagagatcctaattcccagtataaagttaaccagtgcatgtggttaaccagtggcctcctaacctgctgagccttgatggtccaggcctgagttctgaacctcatgcttcagtcctcactgcaatttgccttagaacacatgcctgagagtttatggtttacacattgatcagtgttcacctgtgtagggaaagactttgagaatgtccgcagtggaaatctaggagtggtctggttatcgaattctctgggtctctgtgcctttccttgtctttgagctatgttgcactctgtaagttgtagaatattgatggtaacaaacacaattcttgtctatagcaatgcagactgtctggtggaggtgcagttgatgattgttaccctgtggagattgaccagttttgcaatctattaagcaaattgatttcaacattcctgatggcctatggttctttgaattctcccaattataccatttattggttcctttattaattgatgagttaaataaagtctttggcacatgtttgtgttttatccatatgggagttgtgtttaggcccccctttatttatttatttagttagttaaattttaattttagttttagattcaagacgtgcaggtttgttacaaaggtatattgtgtgaatctgaagtttgagcttctattggtcctgtcacccacacagtgaacatagtacccagtagaaagtttttcagctatttggttttctgtttcttgtgtttctatgttgctgcaaaggacatgatgtcacttttttatggctgtgtagtattccatggtgtatatgtaccacattttctttattcagttactgctgatgggcacctaggttgattccatgtctttgctattgtgaatagtgtggtgataaacatacgagtgcaggtatctttggtagaagatgtacttttctttgcatatatatccagtaatgggattactgggtcaaatggtagctctatttttagttctttgagaaatctcctaactgttttccacagtggctgaactaatttacactcccaccaaccgtgtataagcattgccttttctctatagccttgccaacatctactttttgactttttaataatggccattttgtggttttgatttgcatttctttgatgataatgatgtggaggtttgttttgttttgagatggggtctcactgtgtcatccaggctggagtgccatgatgtaattgtagctcactgcagccttgaactcaagcaacccttctgccttagcttctgagtagctgggactgcgggcatgtgccaccatgcccagctaatggtttaaaatttttgtagagacagaggtctcgctgtgttgcctaggctggtctcgagctcctgacttctggtgaccctcccacctcagcctcccacagggctgggattactggcataagccaccacacctgacccttgagcatttttttcatgtttgttggctgcttgtatcagatctttgtttacaatttatctttgacctttgactcctacaacagtttctcaatacttgctctatttttcaggaaaaagaaaataaatattaaggagaggctgttttccacctcaagcagttaccatttgaattagggaagctgttggtgagggaaaaccaattgatgagcgtcttagtctgtttggactgttataacaaagtaccatacactggttggcttataaacaatagaaatgtatttctcacagttctagatgctggaaagtccaagatcaaggtgctggcagatgaggtgtctgttgagggcccacttcccgggcactcatatggtagaaggggagctctctgggatctcctttataagggcactaatcccattcctgagcgttccacctcatgagaatcacctcccaaaggccctaccccctaatcccgtcaccttggaggttaggattttttttctttttttgagatggagttttgctcttattgcccaggctggagtgcagtggcgcagtctcggcttaccgcaacctccgcctcctgggttcaagcgattctcctgcctcagcctcccaagtagctgggattacagccatgcgccaccaaacctggctaatttttgtatttttagtagagacagggtttcttcatgttggtcaggctggtctcgaagtcctgacctcaggtgatctacccgcctcagcttcccaaaatgctgggattacaggcgtgagccaccatgcccggccagaggttaggattttaacataggaattttagggggacatagacattcagcccattgcagatgagtctgtgggttccacccaaggctgctagagtggctgtctatttcttaatggattgagtttctctttcttcaaattgtgacaagcacagacacttaaggaagacagacctggtttgggtttttgattggtctagcattgaaggcctttgtggtcttgtccctgtcttatcacttcctgtttcctattccagtcaaactgaatttctctttttcacttccatgcctctgatcacattgttatctagaatagcctctccccattcacttaatacatttctctgtccagtcttatgactcagctcaaatgcctcctcttccaggaagccttccctgtttccttagcaggaagagacttctcctgaatttggtgcactctgctttcttgttgttttttgttgttgttgttgttttgttttgtttttaagacggatctcactctgttgcccaggctggagtgcagtggcatgatctcagcccactgcaacctctgcctcccgggttcaagcgattctcctgcctctcagcctcctaagtagctggaactacaggcatgtaccaccaggcccggctaatttttgtatttttcgtagagacagggtttcaccatgttggccaggctggtcttgaactcctgacctcaggtgatctgcctgccttggccttccaaagtgctgaaattacaagcgtgagccaccacgcccaacccttgttggtgttattacatagatggtgaacctcattctctgtggatctattgccagcaaaccaggccctagaacagagttgctgaaggaatgaggattcggattttgtcaaaaagtgagtgcaggggcattgctgtttgccctggggctgcacaccctcctgctctgtgaatgtcccacttcctctccagttccaaagagcagttggaatgttggagactgggcttgtgtctcagcggcttctcttagacactggaggtgacttgtcttttttcagttaccagattgctgccctttacctcagttttcagcagaaggaggcacccgggagctctgtgtctcagctctgcaggtcctgagtgtgtctctgtgagcctcaacaccatggagacggcacagctgggggtctgggtgcatctagggcatcccctccttcttagaagagaaaatgggggcagacaggggaagaatttctcaaggtcaaaaacctggctatggagctggcatggaatccagacctcttgaatctatgctcacctgtacttccttgtttttctggttctccctcctctgatttatttccacctagtcaagcaaaaataagtgtgttttctctgttctttatcttatcttggttattgatagagtctggtgagtgtgtgtatttctgaacatatttgtatatgtatcttttctattttcccatttcatttatgaaaatctagtttaaaacactatatatagtatgtaaagccagattttatatatatttatatatattttattttatttatattttttatatatatatagcatatggcatatggaggtatctgttggtatatacacatacttcctgaggtccattgatactgcattaaaccatagtatttggatactgttaagctcacacacatttacagggcaagtccagggcctgactagtttggtaaagatacaacaagccactgttactttaggcagtttattacttacataggcaggcaacacaaagaatgtgtcaaaggtaccatcttcctgggtccttgtcccatacactgaagaggatgacactgaagcaaaaggggctgatgactgccacataagtgggattttgagaagcaattttagactgcagctaagtggtctcagagcccacagctctgttctgagaggcaggcagaaattcccatacctcattagagatgagacactgtctggtgacaggctcctgggggaatagggaggtgaatgagagacagccgtgcatctttttatgttctggaagcctacaaggtgttccaccaagattcaggcaaacctttgcatacatggctatgtgcagttctcccaggcaccatggcaggttcccttacacggatatgaacatttccccatctgctgatgagaagcagcaatggggaaagctgtgagaaaattgtatcttttttttttttttctttttgagactgggtcttgctctgtcgtacaagctggagtgcaatggtgggatcacagctcactgcagccttgaactcctgggctcaggcgatcctcctgcctcagcctcctgagtagctgggattacagacatgcaccaccatgttcagctattttttattattttttgtagagacagggtcttgctatgttgcccaggctggtctcaaactcctgggctcaagcagtctgtctgccttggcgtcccaaagtgctaggattataggcatgagccaccacatctggctgctgcaaagacaattttaaagacagaaacctgttatgttagcattgtagctcagctactgtcacttttatgttttccttgccagtttttctccaagtttatacacattttttagagttgcgatcatagtatataaacaatgttgtatccttttcaatttaacatcatgtcatagttcataataataattttaagttacatggtgatggatgagttgtgccacagttaatggctggtttgcaggttgttacacacagccccagccagcatcttcgtgcagcatctttctttccttctgtgggattgtttccttggtgctcgttccagcagtaagcatcaggttgtggtgtgggcgtttgtgtggtttgttcaagttcccttcttctttgctgtgctccttgggctgggaatgtttggttgccgtggagatgagtgctgtgggtctccctcctctcccctcaggctctgcccaccccaggcggccatgcccccccactggcactggacactctcaggaagctgttggcacaccctggagtgggagggaggtctgtggagaggacaggagtggcctttgttgacagctgtgtctacttacatgtcaagtggcctgtctgagggaggctggctcccacctgtgcctcagaagcagcagcatgagaggaggaaaaacacgctgacttgtggggttgagtggacttctcggcaccttcaagaatagtctgggaggccaggcgtggtggctcaatctgtaatcccagcactttgggaggttgaggcgggtagatcacttgaggtcacgagtttgagaccagcctgggcaatgtggcaaaaccccatctctactaaaaatacaaaaattaaccgcatgtggtggcacatgcctataatactagctatttggggggctgaggcaggagaatcacttgaacccaggaggcggagttttcagtgagccaagattgcgccactgtactccatcctgggcgacagggtgagactctgtctcaaaaaaaaaaaaaagaatggtctgtgagggagaagtaggcaaggtcctgtgtgctcactccaggcagattgaggtttaaaaactaagacgttcatttcacagactaaacaaattccatcctacttgccatgttagtgtcatgattcctattagtttttcggtgatatgagacggaaaatgatggactaggtaaatatactctccccgccagaagcccatggagcaggggggtgcccaccttggggatggaagctgggaagcagccagtcccacagttgacagaaattacgcctagtgcaggtccgagctcagtggaaggctgcagagggccagacggggtccacttgggatggtgctgggatgtgtaagtcaaggccagaatgaattgcagtggtgtaacctactgtttatattgctcggtgtaagatgcactgtgacctgccagccatgccttagtggggagaaaaagcaaaactaagattatataccattgctcatttcaccttccaaaaaccgaatgtccatggctgttgaagattgcgaatgggatttatagtaaaatctcacttgttgagacccagttggaagaaagcctttcttagtaataaaaagcctgcatctagaacactcacaaaatgccattttgttacttgagataaataaaacaattaggaccaagcctagtgttgtggaacagaggttcttagcgaatgaataagtccttggtgattgactcaccagttagttcgcctctgaaggactggagggttcttgccagctattttgtttttcttacaaagtctaaatactgcatctgaaatcctttcccttttttgttgactttgtaaatgacctcgtcaacccagcccctgaaaatgcttacacattttgaatgagttaagcctgaactagggaggtcttcctttaattcatgcaggtctgcttctgtaaaacagtcactgcgatatttatagataattttgggtaagctttctagcttaccgtgggcctgacaccgcataaccctcctccacccatggcggcgcactaaatcctgtaacaattcagggagttcaacgttcattattattattactctcaacttaagatgtacagattgaggcttggagagtttagtttgtggttggtttcgtcactgttaagtggtgtggtcagcacttgaacccaagacctgtggatccacagctcttgctgttagccactgtattaaattacctttgcttagagagagtatttgccaaagacaggagccgggctgtagccatggggccttgccttgacttttcaggttcagccgctgccttggggttgtgtgacaacagagactggatttttggccaccctcgagttgtgagtgcaggagagtggcctggggctgggaataggggaggtagaattcaatcatgggatgcacccatagtagagaaatggactaagggctttaatccctgagtttctgagctgtcgaattgtccgaatatttctcatcatattcagcagttctgtatgagctgaatgagtcagcaggacctaaggaaaaagctgaagatcaagaatgtgagaaaggaagagtgggcagatgctaaaggaaatcagtgggcacaggaaagatcaggaagcaaccaaaataggctggagctggccagagggctgcagggatcggaagagagtggaggggccacttactttggttatcaaagggtctcttgtgtccgtctcctgcaagcctagttctgctagtgcactggagttggggccaaacctggtttcccaggtcagactctgctggttcagtcagaggccaggaagtccctgacagggaagaccatcagattcctttgttcctatcgtctgaacacagtctgagaggtttcgcagtatattgtagaggctaactttggtgtaacctataccttatgtggccatgtctgcatcctaagctcctgatattgcacatgtctggtttttgttggaagtctgtacctttcctccgtggtagtcccagaccaagggtgatacttggcggtgcccagggtgtcacctgtcttctcaagtcgaagaggagaatgaagagcactccagtacgccaggagcatcacaccgtaattagcaggaagatgttgcaccgcagtgcctcatctcagagccagagtcctgggttagggagtaaactcttttacctaggcctgactgtattctggcattgtaggcactcctcaggtttctgtggccctctcatctcactgagggtatcccttcttcatgtgtctctcagctcttctcttagatttctgcccctggctctggccccttcagattccttctccttctctttcccttccctcctctctcctcctttcaccaacagttttgtttgcacccatagttgcccatcagtggatccatgcctgtaagccagtgtaatacaagctgctgtctgtggagcatttattgcatttattgcagtgagccgtgatcgtgccactgcactccagcctgagtgacagagcgagactctgtctcaaaaaaaaaaaaaacaagatttaggaaccagaggctttatatgcagtccaatacagtagccacaagctgcacgtggctgtcttcttatgtcccttgcttgccttccagccacactcatcttacacaagaggtcatggggtctcagagcggttgcccagctggtgagtggggaagtgtgttcgtgcccaggggcaggtggccactgtgtatacacttgccaccatatccatggccttcacccctcactgtgcgtcagtcgccatcacaaggggcctgttgcagtgccgacctctgcctctgcctgcagagatcctgatttctgagatctgtgtgtgcagggggagcatcctgggggattgtgatgaagttagctgggaacttggctgtggccctgcagtgggcctcaccaccagcccacttgaccttcatgtggacttcagtcctctggcctctctctgacctgtagacctgcaccatctaacacagcagctactggccacctggggctcttgagcacttgaaatgtggctagtgtgactatggaactgcattttccattttatttcattttaattaattaaagtttaaatttattttagtagccatgtacagcttgtggctactgtattggactgcatgtaaagcctcttgttcctaaatcttttttttttttttttgagacagtctcactctgccattcaggctggagtgcagtgctgcattatggctcactgcaacctctgcctcatgggctaaagtgatcctcccacctcagtccctttagtcccctggctaaattttttgaaattaatttttgtagagttggagtcccactatgttgcccagattggtctcaaactcctgggttcaagtgatcctcccgccttggcctcccaaagtgctggaattacaagtgcaagccacaatgcccggcctctaaatcttagccagagttcacttattagtaggaaattattcatgaagtttcttgtttttgatattttatacatcaccaagtcaatgtagtcacattgtcaaaaaatgtatatgggagaagaaaatcacctataattcaataccaaaaagaacccccaaaaatgtatgctgtgcctacatagacgtttttgcctggttgtcatcacagtgtatgtttgcttttatgccctgctttttccacttagaaatatatcatatgccttttccctcattgcttcatagtcttcataaccatctgctgcgtaagatcctgttgatttgatgactcaaagccaacataaccttcttgccagttaaagtttaaaggggaagtgaactcttaccatgggagctcccagactcttcccaggagtactgaggctggctgagtgtggatcctgtggccaggttttcaaggaccagatgcatagcagggcacgggtcagcctgggggtccggcaaatccaatgcctggccagaggatgcaggcccttccctgtgttcaggggcagggtgacagctgcctctccacatccgcagcagccctgcaatggtcaccattggtggcatttggatgccagcagggtcccatatgccctgttttgggcagagcgtctctgtctcttgcatggatcactgctgtcacctccagtctggtctctgggcacagcagcgaggaggccactccacagctcagagaccttcagctactttttgccttaacattgtagtccagttcttttgcctggtgtttaagacatttccttaaattagttctaacttccttcctgtcttctttctttctaactatccccctcctccgctgccccacagcctcccgaagtgctgaagtccctggccacactgcacatcacctgtccttttctacccctgtaccttgtcacccttagcctccatcaccacccaggtgaatatcactctcccttcagtgtcttccattgccatctccattgctactctcctgatcttgggtcccatgtgcacccttcatttgcctgtcctatggtgttttcaattatgattagattgaaactgtttgcaggaatctctatctccccctaggtgatcagttttgggagaatagggacagggtttaactgatcatgattttactccttataacccttcagcacctttagtataattctgaacacagaataaatgttggaataaataaaggtgacacttccccattacctggtactcatcacttcacctccttactcaccttccctcatccctaagcaaccactgatcttcctatccctatagatttgcctattctggatatttcatatgaatgaaatcatacaatatatgatcttctgtgtctggcttttttcacttagcgtgcattccaggttcatccacgttgtagtatgaatcagtatctcatttctttttatggctgaatagtattcccttgtatagatgtaccatattttgtttatccattcagcagttgatagacacttgtttttatttttggctattataaataatgttgctatgaacattcctaggcaggtgtttatgtgaatgtatcatttctgttctcttgggtaaatattaggagtgaaattgctgggtcatatggtaactgtgtttaaccttttgaggacctgttttttaaagaagctctaccatgttacattcccaccagccatgtatgagagttccagtatttccacatccttgccaacgcttaggcttatctagtttttttattctaactatcctatttggtgtgaagttggatctcattgtggttttgatttgcattttcctgatgattaatgatgttgagcatcttttcatacatttattggccattggtatgtcttatttggaaaaatgtcttctcaattccctgctcatttttacttggattgtctttttattattgagtcttaatcgttctttgtataggatttgggaatattttctttcattctgtggactgtcatttcatttcttgatggtattgtttacagcacaaaggctttaaattttgatgcagtagaatttatctactttttttctttttttgccagtgttttggtgctttttgtaggaaaacattggctgacccaaggtcacaaagattcatgtccatgttttcttctaaatgttttaaagagatttaactaataagaaaaaagtctcacttgtcctcgcatttgccatttctgctccttctcatccctttgtttagattcaggttttcatctggtaccatttttccttctgcttgaaggacttctcttaacattttttctttttcgtatgctgatttggtgatgaattctttaaacttttgtattctgaatttatctttctttcatttttttattttaaaatatatttttttggctgggcgcggtggctcacgcctgtaatcccagcactttgggaggccgaggcgggccaatcatgaggtcagaagatcgagaccatcctgactaacatggtgaaaccccgtctctactaaaaatacaaaaaattagccgggcatggtggcgggtgcctgtagtcccagctactggcgaggctgaggcagcagaatggcgtgaacgcaggaggcagagcttgcagtgagccgagattgcaccactgcactccagcctgggcaacagagtgagactctgtctcaaaaaaaaaaaaattatatatatatacacatatatatatatataaaattatatagatatatttatatataattatatattttatatatataattatatatataaaatatatatattgctggatatagaattctagcttgatacttttttgagttccttgaagtttttttgttttttttttttttactattttctccctttttttttttaatgagaaatctgatatctctattctctgtatgtgacatgtttttcccccattctggctgcttttaagatttcatcattgattttgagaaatttgattatgatatccttggtgtgcttttcatgtttcttgtgcttaggggtttgttgagcttcttggatctgtgtgtttgtagtcagtcttcatcaaatctatttcttcacattcctccccatccactagggactccaattactccaatcttaggcatcttgaagttgtcccagagctcacttatgcccatttcgttatttaaaaagttcttttcctctcatttcattttggacattttctattgctgtacctttaaattcactaatgttttctcttgcatggtgtaatctgctattaatcccatccagtgtattctcttttctaaaatttttaaaaagctttttgttatttatttatgtatctttttttaaattatactttaagttctggggtacatgtgcacaatgtgcagttttgttacataggtatacatgtgccatgttggcttactgtacccataaactcatcatttacattaggtatttctcctaatgctatccctcccccagccccccaccccccccaacaggccccaatgtgtgatgtcccctccctgtgtccacgtgttctgattgttcaactcccacttatgagtgagaacatgcggtatttggttttctgtccttgtgatagtttgctgagaatgatggtttccagcttcatccatgtccccaaaaaggacatgaactcatcctttttatggctgcatagtattccgtggtgtatatgttccacattttctttatccagcctattattgatggatatttgggttggttccaagtctttgctattttgaatagtgccgcaataaacataacgtgtgcgtgtgtctttatagcagcatgatttataatcctttgggtatatgcccagtaatgggatggctgggtcaaatggtatttctagttgtacatccttgaggaattgccacgctgtcttccacaatggttgaactaatttacactcccaccaacagtgtaaaagcgttcctgtttcccacatcctctccagcgtctgttgtttcctgactttttaataatcgccattctaactgacatgagatggtatctcattgtggttttgatttgcatttctctgatgaccagtgatgatgagcattttttcatatgtctgttggctgcataaatgtcttcttttgagaagtgtctgttcatatcctttgcacactttttgatggggttgttgttttcttgtaaatttgtttaagtcctttgtagattctggatattagccctttatcagatgggtagattgtagaaattttctcccattctgtaggttgcctgttcactctgatggtagtttcttttgctgtgcagaagctctttagtttaattagatcccatttgtctattttggcttttgttgccattgcttttggtgttttagttatgaagtccttgcctatgcgtgtgtcctgaatggtactgcctagattttattctagggtttttatggtttttggtcttacatttaagtccttaatccatcttgagttaatttttgtgtaaggtggaaggaagggatccagtttcagctttctacatatggctagccagttttcccagcaccattaagtagggaatcctttctccattgcttgtttttgtcaagtttgtcaaagatcagatggttatttttttttttaagatggagtcttgcccccattgtgcaggctggagtgtagtggcatgatctcagctcagtgcaacctccacctcccgggttcaagcgattctccttcctcagccttccaagtagctgggattacaggcatgcaccacatgcctggctaatttttgtatttttagtagagacagggttttgccacgttggccaggctggtctcaaactcctgacctcaggtgatccaccctgcctcggcctcccaaagtgctaggattataggcgtgagccaccgcacccgcctgttatttattttgagacagagtcttgctctgctgcccaggctggagtgcaatggtgtgatctcggctcactgcaacctccgcctcccaggttccagcgattctcacgggtcagcctcctaagtagctgggattacaggcatgagccaccatgcctggctaatttttgtatttttagtagaggtggagttttactatgttggccaggctgatctcaaactcctgtcctcaagtgatacgccttccttggcctccctaagtgctggcattacaggtgagagccaccatgcccggccagccaatgtattgtttatctcagacattttggttttcatctctagcagctcagtttgagccttttaaatattttccatgttgctacttaacatttccaacatattgaatatagaaacaatagcttttaatgtccttctctgctaattctaatatctgtgtctgatcggggttgatttccatagattgattattctcttccctgtgggttgtgctttcctgcctctttgcatgcctgggaatatttgattggctgccagacattgtaaactttacctttttgagtcttggatattttgtattctttcaatcttctgagcattgttctgggatgctgttaaattatttaggaacagtgattctttctagtcttgcttttatgatttattagatgaattcaaagcagagctcagtctagggctctattattcctcattctcagggctggtgggaataggcactgtttccagcttttgtgggtgccaggcactgttcttgcgaatcctgcagatgtttgtcctctgactttggttagtttcctcacaggcaagagctgatccatgctctgctgaacacttaacggagaccctctgcacatctctgggttgtctctgtgtgcagtattctcatctctgatccagacgataatagcctggaataggggaaatggaaaactaactataagacaaagactttggagtggcacgtgagaagagaattggagcgtgaggcagcagtgctcagaacatggtccttggccagcaccagcaaaggccgagaaagagatgagaacgtttagagaccttcctaagagtttgacagagtggctttgtgtcagttgaattggataataactacagttggggcttggattttatgtttcatttttctatattattgtattttacaagataataagtctgacagatggaaattaaaaacaaaagcctcccatacctagccctttgtcacagataaactgagaaggaaggagtgatgtaggggatttggatgaggagggagagagggtggtggttatgattcttagctctggtgggtgtcatttgaggaaacggaaggtcaggtagggatgctggcaacagtcacaccagatgcctggtatgaggtgcactgggctgcgttccctactgtgatcccacttttatccttaccagggaacctgaagggtttgggtgacagccagggtctcatttcagggaaggggcaaaggcaaggttggaccccaagcctgagtgcttttccactttgcccctttctgctgtgctccttggcttactgaggcttggcaagcctgcaaaatcgaggctggatctctccttcacttgagccaaaccaaattgatttgtttttagcaatatcttttaagagttaacctattctggggctgggtgttgtggcctatgcctctaatcctagcactttgggaggctgaggtagccagatcacctgaggtcaggaattcaagaccaacctggccaacatggtgaaaccccatctctactaaaaatacaaaaattacctgggagtgatggtgcatgcctgtagtcccagctactcaggaggctgagccaggaggatggcttgaatccagaaggcggaggttgctgtgagccaagattgcaccactgcactccagcctgagtgacggagcaagactgtctcaaaaaaaaaaaaaaaaaaaagaaaaagaaaaaaaaaaaagaacctattctagaaaagctatttgaagaagtagattggttagaattttgtgcgatgatgcagatattctaaagcttccctagtcacaagtggccatcaagtactcaagatatacttgttcaagccctggcgctaaatttttgatgttatcttaattgatttaaacttacataaataaccacatgtggctagtagccaccatggacagtacaggtagaagtcactaactgggacagtacaatcaaaacaatccaagtgactactgatttttactttcttttctcggaaactcttctcattgttgggaaacccttgcatttttacttctcagggagatattttggaactgaaatttgtggtggagtcttaccgccaaggaccagttatgtttccagaataggttatagcttatttctattttatagggaaggaagagtggtgagtattattgcacgttttagttttgtcagattaaatggctgacctctctttgtgatgtccttaactcttgtttcctttgttaaactacaccggctttatcagatgcatttttctcttttaaactgaggatggcttgaaggcaaatataaaatactcattcacggcctgcaggtggctcacacctgtaatcccagcactgtgggaggctgaggcaggtggatagcttgagcccgggagtttgagaccagcctgggcaacatggtgaaaccccgtctctactaaaaatacacacaaaaaattagccagtcatggtggcatccacgtgtgttcccagctactcaaggctgaggtgggaggattgctctagcccaggaggagattgcaccactgcactccagcctgggtgacagagtaagaccctgtctcaaaaaaaaaaaaaaaaaaaaaagaaaaaagaaaaaattcattcactacatctacaggaagtgtctttttggagtggattctctgtgagtctgcacatttatcagtcaatttttttttttttttttaagacatagtctcactctgtcacccaggctggagtacaatggtgcaatctcagctcactgcaacctctgccacccgggttcaagtgattctcctgcctcagcctcctgagtagctgggattacaggctcacgccaccaggcctggctaatttttgtatttttagtagagatggggtttcaccctgttggccaagctggtgtcgaactcctgacctcaagtgatctgcctacctcagcctcccaaagtgctgggattataggcatgagacaccacactcggcctatcagtcaatattttataaacggctgatgtaaataaagaaaataaagagcattttgactactgtcttctaaactgtaaaaatggtctattgagtatatatttagtgtgacgatcatcagctatttcctagtggagggaattcctttactggaagcaggacgattctgaaactagaattataaagatgtaacactgacactcccacccccagtttatgtttgatgctgattattcagggatggtttaggtcttagcatttttgaccaagatgaacagcatcaaatggaagtgccagttcagagacaagcctgaggcatagtctgacttggtggttctcaaagtgtggtccctggactagcaccatcagcatcactagggaacttaactagaaatgcagagtctcgggccccttcccacacttactaagtcagcagtctgtgtttcaacaaactcacctggtggttctgaagcatgctaaggtttgagaaccacctaagtttttggtgtttatccctcggctattccattttgtcctctgtccttattagctctgccaaagccgcagcagctccctagtgttacgtctctacgtatgagccgccataacaagtcagtgaggacagtgaaatttgcctcttcaagggagcagaaggaagtttaattgggaatgccaggaaatccatctacttccctggaaggactgaacgtttataccgccccctcacaaatccttatgttgaatctctaatcccaacatgatggtatttggaggtggagtctttgggaggtgattaagttatgagagtggatacttcctgaatgggattagtgtccttataagaagagctcagagatgtagttagttccctttccaccatgtgagaaaacagcaggaagacagccatctgtaaatcaggaactggatcctcaccaagaacctgaccctactagcaccctgatgttggacttccaacctccagagctgtgagaaataaatgtctattgtttaagctactcactttatggtattttgttctaacagcctaaaatgactaagacattccccttagtctgagagatattccttttggaacagaaaacaagagagacagtatagtgtggtggaaagagtgttgactttgcacaagagagacctgggttcgaatctcaacttttctatttaacttttagctacataggtgaatttaacctctttagcttttgtttctccatcagaaaaaaaaaaaaaagcatcagtaactcaaccgtaatatagtaagtgagtttcctttttctttttctttctttttttttttgagacggagtctcactctgtcgccaggctggagtgcagtggtgcaatctcggctcactgcaacctcggcctcccgggttcaagcgattctcctgcctcagcttcctgagtagctgggattacaggcacgcaccaccacacccagctggtttttgtatttttagtagggacggggtttcaccatgttggccaggatggtcttggtctcctgacctcatgatccgcccaccttggcctcccaaagtgctgagattacaggcgtgagccaccacgcccagccgacaagtgagtttcaactgcccaaacgtcagggcacattattgcaagattaatgaaatgactcaagcaggcctccagggctggctggcttggggtaaattgtgctgcttcaacctgtccttgtcctggctgtggtttggcaccacctagtggcggttgggtgctctagcttaaatgtcaataaggaggattctggatcctgctcttgattggaactttcaggacagtggcagtgattccaggaattttcaggttagttggcgtctgtttcattggccaaatctggggtgattcagcctggagaataccttttctgcctccctgcttctcagcaccaggttgcttgctgtttcctacctggcctcagcctcctctcagcaaccccctttctccaaagatacaaactttagcctgtctccaagtggaaggttacctatcaagttacatctaaatgcctgtcatcacaaggagtttttacggagctgttcatgacacttaagtgagacatgaggcaagtaaaaggcccagtacctagaaagtgtttgaatgaaaattcccttttccggccagatatggtaactcacacctgtaatctcaacgctttgggaggccaaggcgggaggattgctgagaccaggagttcgaggctgcagtgagctatgattgtaccactgcactccagcctgggcaacagagcaagacgctgtctcaaaaaaaaaaaaaaaaaaggaaaaagaaagaaaggcctgtcccatttcctggcagaagagagaaactggattctgcatataggtgtgcatccaacaagcattaaatactgctgcatggcctcatggtgcagtggaacaagcacagtcttcacagtcagacaaatctgggttcccatcctgcccacttactacctgggtaagcctcaatttccttacttatgaaatgaaaacgataatgtgtaattcataagtatcatatttttactccagaaagttaggagtaatccttgggtgtgatttcaagtgattcccaaaaataatcaattcctgtatccttgtactgctccatgacattgacatgtgatgtgttttatttctgcccgactctttactgaaccctttctacgctcactgaaacctggagtaggtgatggctttgagtaggaaatgactttgtgagtttcttccgtaaaaggcatgtgacagtacagggtcagaaggtggagtgatgcagtaacctgtgtggcaaagttttcaagcatttaaaaatatatgtgaaagccctaaacatagtacttagaccacagaagacaatcagtagatgttaggcttttctcccactcagaatacaaacaaatatattttgatacactatccagtttctaacctcaggtggtctttcaaaaccgaagtgaaaaatgaagtgtgagttcttcagagcaaactaagccccaccctcttaggtcagtgggggagtctcagttttttaaaatttggaataaaggaaaatcagacgtagtcccccaaccccctgtactggcctcctgtgtccggacatgggaattctcagctgtgggaactggcagcaagaggacttatctagccagctgggcaattttttaaatgatcagagcaatacctgctcattggtaaatctttgggaaagtgtaggaaagtatatagaagcaaccaactaggaaataaaccatcccctccaccatgcagattctttttttttttttttttttttttttttttttttgagactgagttttgctcatgttgctcattgcaggctggagtgcaatggtgtgatctcagctcaccacaatctccactccttgggttcaagtgattctcctgcctcagcctcctgagtagctgggactacaggcatgcaccaccatgcctggctaattttgtatttttagtagagagggggcttttccatgttggtcagactggtcttgaactcccgacttcaggcgatctgcccgccttggcctctcaaagtgctaggattacaggcatgagccaccgtgcctggcctcaccatgcagattctaaatatgtccactcagaggcgttgccactcatgggcagatttcctttccagtctttttttctttgaatttctttatatagttgagatgcacaatttttaaatcttgctttttacttttcacattataacataagggttttcttttaagattaaaagtattttttcatattatacatatttctagaaaaatttaatatagaaatatgtgaagtaaagtgaaatttctctctaataccatctgtcactgtacctaatactagaaagaaaatttaaaatattaaagtatataaagtagaaagtgatgtttcactgttatacttctaccagtgttacccactgtttgtttttttcccttttgcatatcagtggtatctgcaaattactgaaatggaattgtactataaatacacttgtcaagtttgcttttttcacttgttaatatattttcagtctgggtgcagtagttcacacctgtaatcctgagatgggctgatcacttgagcccaggagttgttgactagccttagacaacatggcgaaacactgtctctacaaaaaaatacaaaaattaggcagttgtggtggtgcacacctgtagccctatctactcaggaggccgaggtgggaggattccttgagcctgggaggctgaggctgcagattgcaccactgcactccagcctgggtgacagagtcaggctccatctcaaaaaaaccccaaacatatatatatgctatccccaaacatatatatatgctatatataagcattttccaatatgactaaaacactatttaaatgacattttaaatagctatgtaacatttcatcatttatatgtactctggtttatataaccattcctctaaggctgccagtttggatctaagtaaatatttattcactttttaaaattctttcccaaagctaagtctcagataacctcactgagtcagagataaacattttaaagtttcccttccagggagagtttatcatcttacactctcagcagtagcttatgaaaatatacagtgacaacaatcacaaacacttaaaaaatctttgttgatctcctggatgaaaaagctctcgtttaatttgtttcttaacactagagggttcagtgcttctgcatgttcaatgatcttcctctgtgatttttggaatagaggtgatcttcgccctattacacaaaacgttgatttccagctcagattccttagaacttgctaaccccattcctggaaccaaagtgctgtttgctgtgttctccatacattggatcagaagcctaagctctggaagtcctgcgccgtttcctggtggcctcctagctccctctaggggccccatccgcaactgcagccccaccttctttcctctcttgaggaatgagtttaccctgcgggaattccgagaaggaagaggcgaaagtggggagctccacaagtaaagatttggactttgtgatcagacagtgtgtgaatagttttgcttactggttgagcaagcttctcttaggtgggctgtctttttttttttttttttttttttttcccgagacggagtctctctctgtcataaaggctagagtgcaatggcgcgatcttagcttcctgcagcctccgcctcccaggttcaagcgattctcctaccgcggcctcccaagtagctaggattataggcgcgtgccaccatgccaagctaatttttgtatttttagtggagatgaggtttcgccatgttggccaggctggtctcgaactcgtgatctcaagtggtccaacagcctcagcctcccagagtgctgggatcacaggcgtgagccaccgcgcccggccaggtgggctgtttgtgttcctcgtcaccttgttcctggggagggacagagggcagcagatcagctgtcacccaggtaggtgtccgacgtgggaaaagtatgggaaagatactctagttagttctcattttcttttctaaaacttcgagttctctggagtccctttatagagagaaagtttaagtaactgaaattaatttccatggctgtcaagggggttctgatgatgatccctgagatcacccagctgtaggtagacattcttggtaccttagtttagcagagtcagaaaatactgcgaacgttcaaggatggggaccttctagaagagagggcaacagtaactttgaggggaggacaagagagcagctttggagacctaaagagttgtggccttctatgtaagtcctattatcccttccatgcacccccacccacattcccctactccattaaactttgtttcaggttataaaaataatgcataattattgcaggaaaaaatggtaattgaaaatcacctatttcttacactcaaagataatgacttaaaatttggtgtacatcttatgtgtatgagtgtacacataattttgtcatcatatatgtgagtgtgttcataactgtaacccacatacttatatacttcctttaaaatattttaagtatttttccctgtcaataaatatttttttgaaaacacaatctttttatggctgcataatattccaacatgtatatgggttatcatttaataggaattggacatttgatgctcatttttagcaagctattataaatctgagatgacgatttctggaactaggataaattcctgaaatagaatttttggggagaaaatatctgaactttgtaaattctactgacatttaatacaaatttctctcctaagagcttgttttagcttctgctatcccttgcagagtgtgaacaagtatctgtttgtctgtgtcattactaacactggggttatcattctttttaagctttgctagtctgataggtaaagcatagggttttttgttgttgtttgtttttggagagacagagtctcactctattgcccaggctggcgtgcacagacgtgatctcagctcactgcagtctcaacctctaggcacaagtgatcctcctagctcagcctcctaagtagctgggactacaggcgtgccccactacacctagctaacttttttattatttgtagagatgggatcttgctgtgttgcctaggctggtcttgagctcctgggttcaagtgatcctcccaccttggcctcccaaagtgttggaattacaggtgtgagccactgtgcctggcagcaatattttttaaatcatgaggaaagctaaagattttattttatagttattgatcattcatacttattttgtggtttgtctgcctattctttacccattttttatataggactgttacttgagttattttcatattagagttacatccttttctgtcatacagtatagatgtttgctctagtttgttattgccttttcgtttacggtgtttcacctaagtgtgtgtgtgtgtgtgtgtgtgtgcgcgtgtaaaacctactggaaggtactatgggaaataatccttatttacctgtcacccagaatgcacagacatttttacattatagttttggtttgatattttttataaaggaaattaaatatataaaaattgtgtgtgtattttaaaacctactggaaagtactataggaaataatccttatttacctatcacccagaatgcacagacatttttacattgtagctttgattctgtatttttataaaggaaataaaatattatataaaaattggaatcatcttgattccttttcccatcctctcccttccttccctagggcagctgccattatgaattgaaattttcctactgttaccatatatactattgtcaataaaaaacatacagtactagtttacagtactagtttgtggccgggcatggtggctcacacctgtaatcccagcactttgggaggccgaggtgggtggatcacctgaggtcaggagttcgagaccagcctggccaccatctctactaaaaatacaaaaattagccgggtatggtggtgagtgcctgtaatcccagttgcttgggaggctgaggcaggagaatcacttgaacctgggaggcagaggctgcagtgaaccaagatcgtgccactgcactccagcctgggcgacacagcgagactccgtctcaaaaaaaaaaaacaaaccagtactagtttgtgtatgtgtgtgtgcgcactctcaaacttacacatatacgatcattggtatatcttcaggcattttgccttatttgcactggtgttcagttcaattaataatgatatgcatagatctagccctttcattttgactgctgtctggtattacatccagtaaatacagctccagtttcttcgtctatttatcaattctcatatctagtgaacactgaagacgcttctagtttttccataacaacgttgccgtgaacatccatacatgtctgtcctcatgcatgtttgggtaatcttctcaaggggcaaccttagaagtgtgttgtggattatgtgtattttcagatctattggcccttgacaaattgttcccaagtagtcatcccagttgatgatactcccaccagtgtgaaagggctcctcttgtcccacaccttccaagacatgctattagatttagtaatttttgccaatctatgaaagtgagatagaatctcattgtggttttagtttgcattatcctgattgttgataggatagaacatctttttattatagatattggggttatgattaataatcctggttattcctaaggtataacaggttttctattctatgcactttctcttcctgccctttgctcatttccccattggattatttatctttttcttattaattggtgttctttgtgtcttaggtactaatactattttaatttattttatttatttatttttgagacagagtcttgctctgttgcccagtcttgactcactgcaatctccacctcctgggttcaagtgattcttctgcctcagactcccaagtagtgcgtggcaccatgcctggctaattttttttttttttttttttgagacagagtctccctctgtcacccaggctggagtgcagtggcatgatctcggctcactgcaacctccgcctcctaggtgcaggcgattctcctgcctcagtctcccaagtagctggggttacaggtgcatgccaccatgcccagctcttttttgtatttttagtagagatggggtttcaccatattggccaggctgatctcgaactcctgacctcaggtgatccacctgcctcagcctcccaaagtgctggcactacaggcttgagccactgtgcccggccaatttttgtaccttttgtagagacaaagtttcaccatgttggccaggctggtcccaaactcctgacctcaagtgatcctcccgtgtcagcctcccaaaatgctgggactacagacgtgaacaactgtgcccggccagatactaatagcattttatatgtgctttggccatcttctgatccatggcttactcttccttttttctttaactcaacatgtactgcactctgttagagtattgccaaagcttcccctccaagtatgaagctgacttagctatatcttcaaggaatgtagcatatactcagagtattaaaaagtcctacaggaacctacaggagggctgggggaaacattcagacaacactagatctggtagcaacgaccaccacagcaaagaagatggatttgtagttaaagttacttccttttttatgccttttccgctgcgttgatgctttcagggtcctctctgaggtctgaggaatgttctttgacagtcttgtcgctatctgccttgcgctgctttgcctcctgtgggcgtcaccaggcgagggcagccagtgttcgtctggcgggtttctctgtatctcgggcactgtttgtgacaatgatgattttactttcattttgtgggctggccccaaagggcttggtttaactttttgcagagagttcattcagtttctgaaacccccacattgcctgttgagtatgtgttgagcctagcactggaaatgccctcagatctgtgaatactgccaagtaggggatcccgggacaccctctgctgaccttgagctcacagccccattgtgttttccataagagatgagagggactgataaaggatgtttacctgtgttagccttatggaagcaagagttccatccaaggaatcagggtgctttgaacttttcccactcccgcctactcgttttaggtcaagagaaacaaaaatatccttccaacaatgtgtgttttctacagtttaggtgagaaaaagataggaaaataatagttaaccaatgtataggactctcctgataggcggtcacaatggtcctggagcatatgtccaaggtgactgtcataaatgcctgtgggaaactgcatcttcacaagagactgttgcttggatgcccccttgtgttgcctctgctgtcctgccaccaaatgctttgctggcatctttccaagcagataggaggtgctggaaggtgagcgtaggatgacttccaagtcagcccttgagtctttttgccaaatagcacctgccagggcacccttcctcccggcctcagcctgcctgcctctcgccgagggccacggcatcttttaggaactggaaagtgtcattgacagttggcggtttttacgtgtttatttctgcctaaagattttgcttttcacttttcactttttccactgcatattaaaatttttctttttttaccctgtgtttgtgattttttccttaggccggaagctgagaggaaaagccttttattttgtcaacggcaaagtgttttgtgaagaagacttcctggtgagtgtgtcaccgaagcctccccttgcatgtcctggccagagtcagagggcaggggcctggggggacctgggccagcgtgtagggaagctgcactgctggagagaggggccctgcctttccttctgtagatacttgggggtggccatgttcctgaggccaatggcaaaccacacagctttgtactttgaaggaactgtggggtcacttggctatcctcttgctgctttctgcagttctgcctcttccaccaccctggactcctcctcttagaccactggactgggacctgggctctcttcttctcatcccactctctctggggatctagcttctcccatggactggaagtccatccatgtgccagtggctcccagacctgagctctagccctgccgcacctctgaggccagctgctggcatcccactggcccctgggctgtgtcccaacccctcacgtaccagcccctcaccatatttctgtgaagcagaaaaatcttaccttgccttgggtcctgatctgtgagaattgcctcctaggtttgtcctcaaccccacctccttgaacgcagccaggcgttgaactctgtgctgccatgtcttccacaattctgcctccgttcatacctccggcatggctcagccaggctagcttaacggcctccgcacacccgcatcaagaggccttatagggcataaacctggcctgcttggtcccagcatgtgcagggtacaaagcacactcagaagctctccgaggtctggaatccccagctgcccacacctatgcaacctcatgccttcgtgcctttgcttgggccatttcccctgcttgcaatgtcttgcccctttattttcccagatccccccaacagccttcctgtccctcctgcacccacaatggaggagctcttctgtgctgccaccatgcccagggcctgccctggcagggctgtgggctgttagccctgagcagtatgtctgcttacaagtctctcctccattgactgaaagcttccaggatagaaagaacatgcgtcttcaccttcacacctgcagattctaacaagatgccatgcagactgggtgcttggtagttggtggttgaaatgactctgtcatctcagggatgaggaatgtgagatgcagagatgggctcagggccagcttctccctgccttcccttgagaaaagctctatttggttttcactgaaaagttgattcattatgattcctgttggccagaaacagactagcaaacccaaacgggcttaagtaaaaaggaaattattccagcagtgcctcaggagtcattttctccacagtttttggccgtgtatctcagtgttagcttcagtctcaggtcctatgtgatggccagatgttgggaggaccccagagtttacattctctcagtttcacatccgatgggcaagagtgccagtccctccttcggaatcctccacagacgtctgatggagtctcattggctcttactgggccacatgcccacgcctggaaaaagtaacagtgctggaggaatgcaaggctctgatgggccagatctgtcaatgccctgcctgggccctggcatggagccagcccacatggtgatgggagccacgtggtgtggagctgggggctggatctcaaatgaaaatagagagctattacccccagaatggggcgtaggtgccagacaacagaaacctccaccacatggtgtagagttgcagaaagtttcccttttttgtttttcccagcttcctttcataaggtttcccccagttaagttgtgtttgtaatacccaaacttctagtctagcgtgtagcatctagtatgttttttgaagagagcacctcatgtctttcaagactgtgtgtgtgtatgtgtttaggtaagataaggtaaggtaaagtagatatttattaagtttctttgaagctaactataaaaggcattagctttttaaccagaaccggagttgaatttgatttctgtccttaccctttgttggctgtgtgaccttgaaaagttcacttaacctctctgagctgccctctgcttctatttgaggattctgggtaataatgtagaccttgcagaattgttgtaagcattagagtgatggtttcagaatcccctgaaaggcttgtgaaaacacagattgccagaacccaccccctgagtttccaaatcagtaggtctggagtggagcccaaggatttgcattttttacaagctttcaagtgatgccagggaactgctctttgagaaccactgagatgggattaaagcatctctatatacagtcccttacatagagcctggcatgctgtgggtgcccagacacagtcattgttagagtgagtggtactagtatttgtgatggctttcgtggcagagaatattctatgactcagcccacagctgtgttgtacttggggatgacagaattctgcacagagtgacacatctttctgagaaattccttataatcctcttggctgttggggaagtggctgattcatcttaccagtctgggtttaactttcttttctttttcttctgcagtactctggtttccagcagtcggctgacaggtgttttctttgtggacatctgatcatggacatggtgagtaggtcagccaaagaagagaacagcatctcaggtggaggaggaggtgttcagagaaaaaagaaattaataattgaggacagtgtttcttatcttgatttgtggttacagctgggcgcagtggctcatgcctgtaatcccagcactttgggaggccgaggcgggcggatcacgaggtcaggagtttgagaccaaccagcctggccaatatggtgaaaccttgtctctactaaaaatacaaaaattttccgggcgtggtggtgcatgcctgtagtcccagctacttgagaggccaaggcaggagaattgtttgaaccctggaggcggagtttgcagtgagccaagatcacgccactgcactccagcctgggcaacagagtgagactccacctcaaaaaaaaaaaaaagtccctgtaaagtacagcttgcttgttctaatagaacccacattgttggcttttattggaattaacatctttaaccatctagagcacacgctatcatgtttccgataatgctttctcctcctctgggctgtttgaatcgcactggcctccctctggcttctctgtgatccttgtggcatcccaggtgagatgctaaatacagtctgtttttactgcagaaatctcagctaccttggagtcaaatgcagaaagccagaggagcaaagttgtttttctccctgtgttatgcccagctcacaccattacgaagatgagtttttagggcctgtcatttagttctgagacagcagagcaaggaccaggttttatacattccattctttgctcagtcactggctctctgaggttattttgggcttcaggtcttcagtggggacaatttttccctagagggttaggttatgaggttaatgaatacaacatcaaattgttcaccattggaaaccagcctttaagaagttctttaatatactgatcagaggaaatgattatataacatactttaagttggaaacagttaagtccctctctaagctgactcattaatttcattctagagaagataatttctaattattagtatttttaattttacctttttattgagaaataactcatagagtaaaagatactaatcttaagtgtacatctgaacgagttttcacatgtgcatatacccctgtaaccaccacccagatcaagatatagaacacttcccaaactccagaaagttccttcttgtctattcccactcaagaccccactcccacaaaggcaaccattattccaacttctattgccagaaattcattttgctggttttggaacttcatataaatagaaacatatagtatagactctttcaggtcttattacatatgtttttgagcttcatccatgctgttacctgtattggtagtttattgatttgtattgctaagtggaattccattgtatggatatagcacaatttatttctccatctcatgttgatggggatttggtggtttctagttttttgctatttatgcatgaagctgctgtgaatactcttgaacatgtctttgatggacataaacactcatttctgctggttatatgctaatatttataaaacatcagtgacccacagccctccccattcgtgatgaatatctgctatctcccaggctttgacagacctcagcagaggtcttagccctattagagccatgtcctcattagtagccaagacctccctgggaaacgtggcccttcccccatgctcgcagtgggaggtaggcagaagctacatatgcttacctctccttcccaggtatcttctagactctgtagggctctatttctttagcagaatttgcctttgtttttagtgtccttctgacaaacctacttcatatgaagtcaacatgctccgaatttatgagtatgattataccctattcttagttctagtaatcctaagacttctttggataacctcagggtatgtcatttatctattgctgcatgacaaaccaccctaaaactttgtagtttaaaacaatagtgatttcttatttatcatcatgcttcatgctgtgggtcaggatttaggtcagggtttagcaggccaattcttctgctctgtgtggcattggctggggtctcctacttaactttgttcagctggtagcacagttgaactggaacatccaagatgacctctcaccctccaggcccctctccctgtagcctctaatcattcagtagtctagttcagacttccttacagcaagagataggaagtggaagctaccagtcttcttaagcctttgactcagaaatctcagaacattgtttcttctgctttctgttaattaaagaaagtcacaaagccagttctgattcaaggggagggggaaatagtccccatctcttgatgtgagatctctaccatatgggatagtatgaagttgaagcttcagtctttcaggtcttccctaggacttgaaaacttttagtgaatgtctagacagaaccccagctgtctaactctttgtgtaaattgtctctctatatacccttttgttaatagaggggtacattctgggcttgcaggttagaaccaggcatagtctcacataaaaaaagtattacagctagtcacaatgcagcaaaatggcatctttttctaatcttactttaggcacaatgtggattaaattaatttaaggatctctttctgccaagacagcattcatcttggggaaaatgcattccaaggtccaaattgccaaatgggttttggaagcccagccagttgttcttcctgttttgccttactgcagattgagagggccctcaaaggttagggaaacccaagagggaatgaggaagcttgaaagctgagcattcagaggaaagctggaatagcacaacgccctcctcttgccttcttggctggagcttgtgcagtgtggagttatccgcctgaggcttccaggggaaggagctgtaacacagcatatctttacccctgggtctcacagtgtactgacaaggcttccccaaatccaaaatcccctttcttcagcctgtttgaaggctttctgtgtgggctcccactgctggatgctgatgaccgttctgtacattctttgcagatgcatgttttggtgtgaccttgctcatgttgattctgtagttcagttgtttttgctaagtttcatgatgcaggtaattgcagaaatgaatctcctattaagtcagtgaagatgctttcaactgcaaattatagaaaaaacccagactcagttcgagttaaaccaatgatcctccaactttaatatatatcagaatcaccctattaaaataccaactgctgggccttacccccagagtttctgattcaagaaatctgggatggggtccaagaatgtgcattattaacaagtttgcaggtgatgctaatgctgaaggtctggggccacacacatttcgaggaccactgacttcataggaatgatattttatctcacctaaaaagaggcttggaggtatgtggttccatgatgagttaattcagttacttacggacctcaccaaggatgttctttccatctcttctctttcctgctgtccatgtcttgggtctgtcctggtttcaggttggctctggcagttccaggtatcccatccagatccagattaaatgacactgagaggaagaagtttgtggggctttccctctattgcgtttaaaaacaacaacagagaaactttacttattacacttggatttgaggtcattgggttgagtcagaacttctagattatcatgctccagagtcaaagctgcatagaaggggcatccaagaggcagaagtgaaggggttccttttgagctctgccatttccacatggaatttcttttcatttttccgagtacttgctgcttcccaaatctgggaaggatgtatccttctgtggccctgctttgcatcgtttcccacttcttcgtggtggattttggccctgggattggcccatcccttccttaccatctctttctcttaaagaactatgcaagagtttcctgttctgggtgagggttggaaaggagccctctttccctgccagctcagagaccctgtgagaggctgcaggagaaggattcctgtgtggtctcttctgtgtattcatctaaacagatttgcctttcccaccccatcacctcttgctcttctcctaggtgaaactcgggggtaagtgtactctgtgtgtgactgctcatgtaatccttaggcctgatgtgttcctctccccttccaccatctcatccttccctataatccccactgagtcttggtctctgctccagatcctgcaagccctggggaagtcctaccaccccggctgtttccgctgtgtcatctgtaatgagtgtttggatggggtgcccttcaccgtggactcagagaacaagatctactgtgtccgagattaccacaagtaagaagggatgggagcagacaggacccattcgtgtaggccaagctgatctcagcagagtgagtggtggaaaccgacaaaactgtgtttgccagccgcccttagatcacagtccagcaaaggcttaatggttttgaggggtacagcagggaccttgggaggttggtcgatgccagtgttgacaggaatgggttaaagaatcatgtttagtgaaaaaaaaaaaacaacagagcacagaaaaactaataatcatatttgtagctaggcctcgggaggaatccaccaagccctgtggcttcagcgttacctaacttcacaaggcccctatgcagtgctggttcctaccactcttggtttgcctgggcctgtgctaggcaccatgagaggtgtaaacaaatcagttagtgctgtccccagaagagtgagaggcagccagtgtcctcattgcagctggggagcaaatactaaggcatattccacaaagtgagccaggtaccagtcattctatgagggaggagagcaaggggcaggaggcggcatggaggaaggctccatgtggattccaagtgcaagtctgactctggaatttgctcccagaagcaacatttattgctgctttgtttctccccacagggtgctggcccccaagtgtgcagcctgtgggcttcccatccttccacctgaggtaagatgcccttccagacatgctcccaggggcttctaagacatgaatatctccctgggctcatttacaagatccatgtcctgtccttacagcttttaaggtatccttttaaaaatctcaactctggcctggtgcagtggctcacgcctgtaatcccaccccttttaggaggcccaggcaggaaaattgcttgaggcctggagtttaagaacagcctgggcaacatagcaagacctcatctctacaaaaaattgttaaaaattggccaagtgtggtggcatgtgcctgtagtcctagctgcttgagcccaagagtttgaggctgcagcgagctatgatggtgctactgcattccagcaggtgacagcaagaccttgtctccaaaaaaaaaaaaccaaaaaaaaccccacttcacctttgagataagtcgtgtcttcacccttccttgttgactggcttccccaacccagtacccttcttgtgctgatttgtccccataaccaggtcaaactcccttacttgatactaattcttagattagcagatgaggagaaaggcttgtcttttcttcattttttaaaataagtgtccatgtaggtctttctttcagtgttaactctgacattctagaaggaaggactcctatccctcctacttcccctctcatcagcttaaatgtattcttcttccagtaagtactcctgatttaccttctcctcccaaggccacctacttgttacccccaaaaccctcttccctccccaccccacggtacatcaagcccgacagcccccctaacaggcctctcctatgtgttcttgcttttctctggtcccagggctcagatgagaccatccgtgtcgtgtccatggacagagactaccacgtggagtgttaccactgcgaggtagacccctccccacccagcccccaaagcccattgtagacatccaagagaaaagcatcctgcgttgactggggcaagaggcagtcaacaagattctggcaagggtcagccctctagagcttctgtaggaaatggaatgaaggctggttcttgggggaggtaggagaagatggaaatgctcaaggtataaaggtctttcttctgcatattcagaactatcaagtcctgcaactgttggagctgctctccctgaagctgcagagctaggagggtcgtggagagcatgggtttcaggtcctatctgcgggccacattgtcaggcaggtgtgcgatttggggaagggactccctcccctccagcttgcaggctgttctatctgcctgaagctcctttctcagctgagccctggaaatcatgaagcccctcttggaaacaggcatgtcagctggtggtgtgaaggcgggtggggtccgcctgccccttcctgccctttgtcccaacccaagatgaaggagcactagtacctgatgactgtcaggaaagctagaggttgcccctcaccaacccttgtgaagggtgaccatggaatttcagccacaattaagtgaattcacccatggaaggagattagattcatttggtgaccctgtgggtagagaatgggggtgtccctcatatagacttgtcccactgccaacactgaagaaatgggtgggaatcattgctgctgggaccccaggtgccccaggtcactgcaggagaaaaaggtgaggacatttgctcaacaggcctctccacattttctagaccagtgctatccaaaagaaatataaggggccgggcgcgatagctcacgcctgtaatctcagcactttgggaggccaaggccggcagattacttgaggtcaggagttcgagaccagcctggccaacatggcaaaaacccatctctactaaaaatacaaagattagtgggcgtggtggcacacgcctgtagtcccagctactcgggaagctgagacaggagaattgcttgaacctgggaagtggaggttgcagtgacctgagatcatgctactgcactccagcctgggcaacagagcaagactccgtctcaaaaaaagaaagaactatgagagccacaaattaaagtcatgtatcattttaagttttctggtagtcacaattaaaacgttaaagaattatgagagccacaaattaaagtcatgtatcattttaagttttctggtagtcacaattaaaacgttaaaagaaaccggtgagattaattattttattcggttcaaaatatccagccaggcatgggcccatgcctgtaatcttagcactttggaaggccgaggcagggggatcacatgagcccaggagtttgagaacagcatggacaacacagtgagaccctgtctctactaaaaatacaaaaattagccaggcatgctgtgcctatagtctcagctacttaggaagctaggatcgtgtcactgcactctactctgggtgacacagcaagaccctgtcttaaaaaagtaaaaaatcctgctgggcgtggtggctcatgcctgtaatcccagcactttgggagggcagatcacttgaggtcaggagttcaagaccagcctggccaacatggtgaaaccctgtctctactaaaaatacaaaaattagccagatgtgttggcgcgtgcataatcccagctacttgggaggctgagacaggagaattccttgaacgggggaggtggatgttgcagtgagctgagatcgcaccactgcactccagcctagaaaacagagggagactgtctcaaaaaagaaaaaaaaatccaaatgttatcttttgaacatgtaatcaatataaaaaagttacccatgagattttttttgtaactccacaatttattttatttcttctaaaaaaaaaaaagggatacgtgtgaagatttattacatagatatatgttgtacgtgtgccagggtggtttgctgcacctattgtcccatcctctaagttccctcccctcacccccacctcccaacaggccctggtgtgtgttgttcccctccctgtgtccatgtgttctcattgttcaactcccacttatgagtgagaacatgtggtgtttagttttctgttcctttgttagtttgctgagaatgatggcttccagcttcatccatgtccctgcaaaggacatgatctcattcctttttcccatgagatatttttacatcctctttttgtcctaagtcttcggaatctgcatttacactgacagcacattttaagtggttcacagcaagtgccttgtggcagtgtctcctgtgttggacaggcctccacggggcaggagctgtgtttctgcactggcatttcctgcctatacagaaacacacagcaccctctgctgattttggggactgtggccttcaggtcagtcttgcagtctgttttgttttgcttcccctggacatgtctgcctccccacaggactgtggtctggagctcaatgatgaagatggccaccgctgttatccgctggaggaccacctgttctgtcactcctgccacgtgaagaggctggagaagagaccctcatctacagcccttcaccagcaccacttctagccagagccacttgcagacatcacggcaggggatgaggagccggggttgctgctgctgcttccggtggcccctggggtggaagtggggtaggggaagaggaggggcaggagggagagttcctgtgagcatgtggggggtgcctttcctttaaccagggaggtgaacactacctgcctcctgcgtgtattttccaagtgcttttctctgttgccacattttcctcaggttactcaggaaaatgctccagcatgtgcgagcacatgacctgaggttgcatcatagcaccaaaggaatcctcctgtcccctctgggaacatttcatgcttcagagggagaggtttttattgagcttgtttcacaatatccccttgaagggacagctcagctgccaatacattcaaccctttctcttccttcaggaaaatacctatacccaaatgttccctcccccgacatatatcatggcatgatttaaggcttcttttcacctgagagcttcagttcttctgcagaatggctgcaaatttaattgcattaaggcaagaaggaagctctaatgtgtgctttgtatcctaagataaatttgcttagaaaaccagagtcaagatttgaaataggtgaggcagggtttcctccttagacactgacagcattctctgtaccccttcaaatccttactctcctaaaggcagctgagtccgcgacagaaatttgccctatgtgagtaaaacatactttgggagaagaacttggtgcaggcaccaggatttttttttttgcccacgtgtttgcgctgtttttctctggagttctcaagagttggtgacttggaaggccgcttctgcaaggcaagtctcaggaacccatgcaggtacatcgcttgcacctgtttttagcttatttaatgacgggcttttgggaagagctgcccgcatactgagagacagcttcttataaacaaggagagtttttgtgtgtgcgagatctctaagccagcgtgggagggagcgcctcaggataagttattatattcatttcgttggtttctctcctgcccaattcttggcacaggcattatgtttgaagaaaccaggataaggtacactgcttttgtctgtttaatttttttagttgtttcccttcactttcagtcttccacacacaaaaaatacctcacagagcttcaccaaatcacagattcaggaggaatttggctttcacactggactcagataccttcttcagtgtgttggaaatcactggcttcacacaggcccaactccagctggtcagggcagagtgatcgtaactaaaggtcagtggggaatagatccgattcagtgcttttgccttatgcatttcagcatcctggctccccagggtggcaggagctgagggagggccacacactggcaagatttcaagaccactctctgcactgaagaggtaaaatttgcactgcaagtcacatccctgaggccagaggtcagtaccctttggtatttcgattagaagaagctgcaaaagaaaggcagcccattttaccattgccagccaggccggggacacaggagccggtgtgtgcactctgcctcctcaccttgcacccagagcaagaggactgggtgctgggctgcagaggccggtcagtggagcccctagcacgtgtgaactcaggcttttcattgggcccggctccacttctaggccatgttttgactcatttggtaaccattgcctgtaagcagcacagaattggtgccatggattatcttttccatgttgatggaattcattctgttggaatcctttggccagatgtcacttcagccagggtgtgcatcatcattggttctttttcacaggctgagcctcctgaaaacccatgaacgctggggctggggaagtgaaccctgaggtggggaccctctcttcccatcaaatcatccagctcagtgtggggcgtggcaggggggtaaatgaagccagccaatgtgttaacctgtctctgtcaacctaagaatgttggccttactgacacacctttgctccatgttcaagaccagaagtagctgggatttgtttgcaaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccaggaagaaaagattttaaaatttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcgtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttctgtcacacaaaatgaagaacagaaatgttaggacttaagagaatgtttggaattcacacctctttgcagtcctttcaaggctgctgctctgtgctgtgtcccatgcatgtgaaagtagagctgtgatggctgctgggacgcttgcaaagatcatgtgtgagaattgagcacaagaccacaaattattactgcttgatgcgcttgttaaaactctatctgccaggaaaccaaattttcttttcttttctttttttttttgagacagggcctcactctgttgcccaggctggagtgcagtggcgcgatctcagctcactgcagcctccacctactgggctcaagtgatcctcccacctcagcctcccgagtagccgggaccacaggcgtgtatgactggctacgcctggctaatttttgtatttttaatagagacgagtttcaccatgttgcccaggatggtctggaactcctgggctcaagtgatctgcccacttccgcctcccaaagtgttgggattatggccattagccactgtacctggcacaatttttttttgtaccctcctttatgccaagaatcagtcctaatttctttactatgtgaagtaacttttaaaggtaatagaaaaggccaggcacagtggctcatgcctgtaatcccaggcgccgtggctcacgcctgtaatcccagcactttgagaggctgaggcgggtggatcacttaaggtcaggagttagagaccagcctgaccaacatggtgaaacactgtctctactaaaaatacaaaattagctgggtttggtggcgcacgcctgtaatcccagctacctgagaggttgaggcaggagaatcgcttgaacctgggaggcagaggttgcagtgagccgagatggtgccattgcactccgacctgggcaacagagcgaaacactgtctcaaaaaaaaaaaaaaaagtaacagaaaaaagagtgaaatatattagctatcttttattctgagccaaaacttgacagatgtgggaaatcttcatatagtgtatgaaaatttcattgtacagggaaattattttcctctgtgtcttttcttttactataaagtgattcagaattttactgttactataaaattatgcaaagtattgtgacaaaactgcatcaatttgttgactattaaagtgctccttgaacattatatttcctgggtcttttctgtgtgtggagtcagcaaactgttttttgctacctggactttgtcttcttttacagctctggattcttaaaagtaccacataggtagcaaacctgtgaagggtatgagattttaccctacttgcaggctaataaagtgagcacaccacatgggttcatggatcctggcagaagttatgagactcataggtcagagacaaaggacagtttattatagcaatagcagtggccagattatcagcatttacactggttccctgagccccaggccccaagaagagggccaggtgagacctgcacacgcagtgggctgcattacaagaggaacccccatgcttaggggaccctggtatttgataatgggcagtaagcctgcctgacttttgctccagagacagacactatctctgtcatccaagactgttcactagataaacatccttgaaaatataagtctggaacctggcaattggtgtctattcttaccagatgtataaaaatgtgagaggccttggagaatcatatcccaagaatcagcagtttcttttactggacctttaagattgagacttgtaaggtcctgatgcagtgacttgtaaggtcactttgtctctcttgtgaatgttactgttttttctcttctgaggttatgaccaaagaatcctcaaggcgagtgatccttcaggtttgagacagccacatgcaggaagacaggacttgtagagtgttggggccaagtgtgtggttagaatccttggggtggggaaagagtttgttctagactccagtgtag

SEQ ID NO: 16989 - DNA, 18900 bp, Human
tcatcccagtgaacagaaggtctgattcgcactgtacttcaaaacatgaaactacaaattaatttttttccaaaaaaatgtagtaactatctcgtcacaaattattggaataaaagaagaatgaaccaagtgttgatattaggaggctgcatcttccaaccagatcatttgatgtgacatcttcccttgacatttgagttttgttgaccaagatgatggttataaaatactcaaagattttatcaatttttcccagtgtgacttttaattgtttgatagttaaagcattcttttgaatgctttttcctcatttattgggaacttctccagctcagacaagtcctcatgtattcatgccctcagtggcttttcatctgatctcccatgacatttttatcaactttggacaactgtagttctgttgtaagacttccaatttcactttgcaattgcttcctcttgtatgtcactcaaactgtcctgccaaagtaaagcattaccctgaaatctcagtggtttaacatccagaggtttattaattccccaatcataatatctgtccaaggtgtgaggcttcaacctactatggctgcaccatccccagctacctccttagggagagggagcatggagaactcatacctgctctcttctgcatcagcccggaaatggccatgtcatgcagttctggcccattggtttgaattagtcacaagtacctgctgccctcttcatcagcctggaaatggccatgtcatgaagttctggcctattagtaatgagttccccatctagctgcaagggagtccaggaaatatagtcttcctgtgtgatcagagaggggaaaatgaaatggcagctgtctgccacttgttgtatttttttggggtccagtgttgttcaaatgggaatatatattaagaagaatggtgtctgagtgggtatttattttattttattttattttatttttatttttatttctttgagatgtggtcttgctgtgtcacccaggctagtgtgcagtgatgagatcatggtttattgcagcctccacctcctgggctcaagcaatccttctgtcttagtttaccaagtaggtgggaccacaggcacctgccataacactaggctagttttccaaatgttttgtagagatggagttttgctctgttgcccaagctggtctcaaactcctgggcttaattaacatcctcttgccttggcctcccaaaatggtgagattacaggcgtgagccaccatgcccagctggggattaattttataaatggtcagatcgttaggaaatatttctgtattgtgatcacttttgctttgttatgaagtaggggctctgatcaggaatcgtcagaaaatgagcttctgagcatggggaatcaggaacagcatcttagcacacacagagccactccttcctgcccaagagacgtgatgcttttctcaattagggattctaatgggtcctcaccctcctcctccacaaggaatatttgtcgtctggatgcaacagcagacagcccctctcatgccagacttttgtccagtaaagtctccaggcgagtaaagatggggagcactgtttttgcttttctaagaccccatgaaatgttgccttttctttttaacagacagagccttgctttgttgcccaggctggagtgcagtggcgcaattatggctcactgcgtcctcaacctcccagtctcaagcaatcttcctgcctcagcctcctaagtagctgggactgcaggtatgacgaccacgcccagctaattttcttttattgtttttatagacagtgtcttactatgttgcctgggctggtctcaatctcctgggctcaagtgatcttcccaccttctcccaaagttccaggattataggcatgagccaccacgcccagctaaaaggtgtttattttttattgtaattttgttttgtcattgacagattttgaatttctctttcttaccctcttcagcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgtaagtttcctttcctgccactcacgcagaaacctgggtcctgcagtcaatagaagtgggttgtattggtctgttctcatgctgctgataaaggcataccagagactaggtaatttataaggaaaatgaggtctaatggactcacaattccacatgtctgggaggcctctgcagaaggcaaaggaggagcaaagccacatcttacatggtggcaggcaagagagcgtgtgcaggggaactgccctttataaaaccgtcagatctcgtgagacttattcactaccacaagaacagtatgggataaacttgctcccatgattcagttacctcccaccgggtccctcccacgacatgtgggaattatgggaatacaatacgagatttgggtggggacacagccgaaccatatcacaggttgagaaccctgccaaagttctcaatgttgaacctgccaaggttcaaccacgattcggggttgtcctccctgcgaaggcacacacatcttctgacccaagggctgaggactcttggcctaaatgtgaaggttcaggccgtcccatgttcaggttttggtggcaggtcctggcaggcagggacgtttgtcctcccatctgtgattctttcatagagcctggctctaggaagccctttgaggatgttgtgtgacttcagctttcctctagatcagagttctcaaccttgccactattgtcattttgggctggataatcctttgttgtaggggcctccctgtgcattgtaggaagttcagcaacgtgtctggccttatctgctagatgcagtagctcccccacccctggttatgacaatccaaaatatcttcagacattgttaaatgtcccatggagaacaaaatcaccctctgttgaggaccgctgccctagatcttccaggtgacccatcccaggtgacctctgcccccaacccctgacacctccttatcaaccagggtcccttgttgctagcccacccggccatgtcctccccagcagagctcatgcatggaactttccagactctacctatgcccctatgaaaaatttaatgtttccctttagtatccagcttgcagccatatggcaggaatgtattggataaataacctcttggcatagattaatatccctccaaacagggagtgacatcagggaagcttcttaacagcctatacactgttccaaagacctggcttccatcctgctcattttagactgcagagataattaaagggcagaaacattgctcagaaagccaaaaagtacaccatacgagtggccaccaactctgcctacatatacggctcccgttgatggatcatcatgacaatagtaacataaactataatgcctgtcacttagcgatcactgtggcccttttatgcatgtcatctcatgtgatccccaccccagctgtaccaggtagggcaccgacatctccttgcaccgggttacaggtgaaggaactgcgcctcagggccattcgggcacttggcagagtttacagtgcagtaagcagcagagccaggatttgagccattccagaggctcctggtcctagagcctgtcaggggagatgagcacaataatcgcatttgggttctggagcttcttgctgagctgctgtgagtggcctgggcagggaccacattgctgctatggattatagcagtggtccccaacgtttttggcaccaggaaccggtttcatggaagacaatttttctacagactggggagggggcattgcagggggatggtttcagaatgattcaagtgcattacatttattgtgcactttattattattacattttaatatataatgaaataattatataactcgtcataatgtggaatcagtgggagccctgagcttgttgttctggactagacggtcccatctgggggtgatgggagacagtgacagatcatcaggcattagagtctcataaggagcgtgcagcctagatccctggcatgcacagttcacaaggttgacactcctataagaatctaatgcccctggtgacctgacaggaggcagagctcaggcagtaatgtgagtgatggggagcagctgtaaatacagatgaagctgccttcactggctgctcacctcctgctgcgtggcctggttcctaacaggctacagacaggtaccagtccatggcccatgggttggggagtcctagattatagtatttggacccaccattccaggagctcactgtgaaataaatgggaccgaatgttcttttagaatctcctttttctatttcttcccatctagtcctttgggatcctgaaaaggtcccagacttagtgaaaaggatagacagacattaggggcaggaaaaccatcagccttagtgaatcgtatccagcacccccagggtatattatcatggcacatactaagaagatgcagatggactttttgtccatcggtgagtctgagggtattcattatgtatttggaattgtgcttggcaactggaaagtagaaggaaggccatcttgggcagtgggggaagggcagcagccaccaaagcacacagggaaatgaatgcttttggctgaagacaggagaatcttgtctggtcatcccatccattgcaatgtttgtttgtttgtttgtgacagggtctctctctgtcacccaggctggagtgtagtgttgcgatcatggctcactgcagcctctactgcccaggctcaagcgatcctcccacctcagactcctgagtagctgggactacagtcacacaccaccatgcctgactaattttttgtatttttttgtagagatgggttgccccggctggtctcaaactcctgggctcaagcaatcctcccacctcggcctcccaaagtgctgaaattataggcatgagccactgtgcccacccctgactgctattacttccagcaactcagcctcatcttttctcccatactctctgagggcctggaccacctcttatcctttgggagaaagtagcagggcatcacctggagccggttagaaatgcagaatcctggccaggcgtggtggctcacgcctgtaatcccagcactttgggaggccaaggcaggtggatcacctgaggtcagaagtttgagactagtctgaccaacatggcgaaaccctgtctctactaaaaatacaaaaatgagccaggtgtgctggtgcatgcctctaaatcccagctactcgtgagactgaggcaggagaattgcttgaacccagtatgggagggttgcagtgagccaagatcatgcatcgcactccagcctgggcaacaagagtgaaactctgtctcaaaaaaaacaaaaaaaggaaaaaaaaaaagaaatgtagaatcccggctgagcgcagtggctcatgcttgtaatcccagcactgtgggaggctgaggtgggcggatcacctgaggtcaggagttcaagactagcctgacaacatagtaaacactgactctacaaaaaatacaaaaagtaggcgtggtgatgtgcacctgtagtcccagatactcaggaggctgaggtgggaggattgctcgagcccaagagatggaggctgcagtgagccaagactgtgccactgccctccagcctggatgacagagcaagaccctgtctcaaaaaaataaataaatagaaaagaaagaaatgcagaatcccagtccccaccccagacctcctgagtcagtctgcattagaataagctcctcaggcaattctcacatgtgttgcagtttgagaatcctggaagcccaccatgcctcgtgcctaattagcagtcagtgtttgcatcatgaacggacggcctttctctctatttccattttgtgttacaggcctggtgggtaggagatgagttttttgcagatgtctggagaatatgtaccaacaacacgaattgcacagtcatcaatgacagctttcaaggtaagtgtgaatgaaggaagctgactgagaagcactgagggaggaaggaacggtcaggagtgaggcttcgggttccccgactccgtaccctctcctccactcactgcatactccggtgggcctggccgcgtttgctcagtgtgtgctggagcggaggacagcacaagctggagatgccaggggtgtggagaagccggaggctggagggagaccaactccagctaagttggacctcatgccttctcttctctgcctcttggcacagccgagtttcccgttctcatcctttctccagcttcagctctcatctagaattttctcttcccttctttttttatccaagccttgcctctaaatgggctcagagaccataatttactctccagtcacttttccctgtccagcagtaagaaatccgagatctggcggggctcagtggctcatgcctgtaatcccagcactttgggaagcagaggcggatggatcacttgaggtcaggagtttgagaccagcctggtcaatatggcgaaaccccatctctactaaaaatacaaaaattagctgggcgtggtggtgcacgcctgtaatcccagccactgaggaggctgaagcaagagaattgcttgaatccaggaggcggaggttgcggtgagccgagatcacgccactgcgctccaccctgggtgacagagtgagaccctgtctcaaaaacaaacaaaaatccaagatctggcttccgttcctagacaagctgtgtagccttgcattgggcatgtcaatttcaacatcctcagctgtagaacagaagtaataatgatgcctttgctgtgcccacctcttcaatgagctaaaatacatgaaaaggctttaaaatacagaaaatcccattcaaaaacatgctaaccactgtttttcattatgaagtgaatggttctgtttttcctcatagaactgatgaaatagatactttgggatcccagttgcctgataaaatacagtatacccggttaaattagagatttcagataaacaataagtactgttttttagtatgactatggcccaaatattaatataacatgggacatacttatgctaaaaaatatttggttttgttggtggggggggagggtttagttttttggtttttgtttgtttgtttgtttgtttttgagacagggtctcactctgtcacccaggctggagtgcagtggtgcagtcacgactcactgcagccttgacctcccgggctcaagtgatcctcccatctcagcctctcaagtagctgggactacaggcactcaccaccatgcccagctaattttcgtaatttttgtagagatgtagtttcaccatgttgcccaggctggtctcgaactcctgggctccagagatctgcccacctcagcctaaaggaggaggaggagccaccatgcctctcctaaaatttatttgttgtccatcggatattcatgtactgggcatcctgtctttgtgtttgttttggtttgtttgccaaatctgacaatcctattagggagcaaaggagcctactccctgggtcccagattctcaccacactcagtaacaatatccatattcatcataaaagcagcaaaaataccagtagaaggcaccatttacttaaagtttactgtgaggcatgggtctaagtcctttacataggtgatctcatagccccatcaggcagggaccataggccccattttaagatggggaaactgaggcagagagcagttaagttacccaaggccgcatagccaggagcgaatgatggcggcaggattccagtctaggtgtgaccagctctaaagccagtacccttaaccacggaacaccatcggtgctcccttccatctcgtctgttattctgtcatgctaacctctggccctgggaacagccctccttccctgagctctgcaagccccagctgtcgccagtgtgcaaggccagctgggagggcttgctgtgctctgtggctgtttttctgaatcctccacatgggattattcacttatttttctttaaaacaggggttggcgaaccgctggccaaattcagtccaaggcctgtttttgtttggccggggagctaagaacagtttttacatttttaaaagttgtttacacacacacacacacccctaaaaacaaaacaaaaagaacattcgacaagagaccatatggttcacaaaacctaaaatattcactgtctgtccctctactgaaaaagtttgccaactttttttactttaaaaagtttacttttaaaatagcccacttttctgtacataaatctactgtatttatttagtggagacagggtcttgctatgttgccaaggctggtttttcacgcctggcttcaagtgatcctcccaccttggcctcccaaagtgctggggtttataggcatgagcctctgcactcacccataaatctattttctttttttttttccgtttgaatcagggtctcgctttgtcactctggctggagtgcagtggtgcaatcacagctcactgtaacctctgccccccaggttcgagtgatcctcccacctcagcctccccagtagctgggattatgggtgtgtgccaccacacctggctaatttttgtattttctgtagagacagggttttaccatgttgcccatgctggtcttgaactcctgagctcaagcgattctcccacttcacccactgtggcctcccaaaccataagtctatgttaaagagaatgtcacatccctcccatgagtgttatcactcgtataaactagtatcacttgccataaaagaagggaagctttctgaaaatactagatggaaagcccaatgatgttatcaaagtctgggcagacacacttccctcctgaagcctctaagcctgtttctggtccttttcatgttaaaaaacaaacaaccccaaacacccagatattagtgggtgtttttaaagcacaaaagcagctggtggagaactcctccttgaggtccttagagaaatctatttatttatttgtttatttatttatttatttttgagacagagtctcgctctgtcacccaggctggagtgcagtggcgcaatctctgctcgctgcagtccccgccttctgggttcaagccatcctcctgcctcaaactcccaagtagctgggattacaggtgtgtgccaccacacccagctaatttttgtatttttagtagagacagggttttgccatattggccaggctggtctcaaactcctgacctcaggtgatccacctgcctctgcctcccatagtgctgggattacaggcgtgagtcaccatgcccagcccttagaggaatttaaactgagcaaagtgagcatccctctcattccgtgaatttgtgtagtttcccgtcctcactgggttccacatacacccatctcaggggctgcctggcaggcacatcctgcaccccctcccagctttgagaaaccctgttctaggaacatctattcatcctttcccccaaagccatgttttccccatttgccccatcatgggtcacttgttgctgaaaatacagattcctggtgcccactccaggacaatggtagcagaatctccagggggagaggcctaagaatctgtatttttaataagcaatcccaggtgatccctgggattgggcagatttgggaagtactgctgtaagccagagggtcaccacttgggctccatattggaattccctcggtggctttacgaagccctcgtgcccgctctcaatgcccgacgttctgatttatttcatctcagtagagcctgctgggttttctttttctttttctttttttaatggagttataatttacaaacacggaaacgcaggcttcttaagggctcaatttggtgggttttgacaattgtataaacacccacgtaaccagcatccaaaagaagacagagaacattgccaactctccagaaagttcctcgggcccccttccacacagttgctaccgctttctgccccgagggcaaccacttctgacttctgtcactataactcacttccacctgttcctgggcctcatgggaatggggtcatgtggtgtgtgtcatagtgggggagccggtctgactcctttcgctccccataaggaattgggggaaaggctagatgctctccaagcaaccgtaatctgtagccagaatggattaaatccacagctctagacgtttcattaagtacttaccaattacgttcactccagtgagttttcaggcaaaactgcaaaattgaaggaaaaaaagacagaaagaaaaagaaaaggaaggtgtgtccttagattttctgtgcagcgtggacgctgtcccctcaccttatcttttggcctcatcctggtggtaacattcagcattcagctcttacacaggactcccaccttgcctgcaccctccaaacccccttatgtagatgagtttactctaccttcctagcccgatgaggaaggagctattagtatccccattttagagttcaagaccaccgtgagcaacatagcgagactccatccctacaaaaattttttaaaaattagccagacatgcctgtagtcccagctacacaggaggctgaggcaggaggatcacttgggcccaagagttcaaggctgcagtgagctacggttgtgccactacactccagcctggttgtcagagtgagaccctgtctcaaaaaatatatctatatccccattttacaggtgaggaaactgaggcccacgaaggtaacccatgtgcaggatgccttccctatggccacatagctttctacacattagcctcactgtgacctgcccccatgtgacaccctccaccctaggcctcccttctccactgaaacttctctgtactgagccccaaaccttcataccccagtctctgttaaggctgacctgaaaagaaaggagctttcctcctctttgtaagtagtgaccgtgaagatcagcctccgatacctacaggctagtgtggagtccacagagcacttcacaaggtcacagtcccatgagccctgagtccatgggaatccctctctaaaatggagacccccaaggccccatcctgatttcttgagtcacaatctaccacgttggaacctgaggtttgtccttcaaaagattcccctgtccatgagccaagcatgtggggtctgtgacccagaccaggaagaatgcagagcaggtggttcttgcctcgtcttccagataaggggtcgaggattgtccagtcaaatggacactggaggtgaggggcagggggtctggaagacgccttggctgcccttgtgctcagaccatgtagacgaccgcctgaaccccttcctgtttgcctcctgtcacacctactctggagctgctgcggtcgctgtgtaccccgcagtgccggctggccaaggtcctcagtcctgcgcccctgcccttttcccgcagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtaagtacatcaacgggcttccctaacaaggggctttctggaataagcactcccttcccagccgccaggagggaagccaggaggagggagaatttggaaaggagaaattggcagccgcgcggtgctgtgtgccggtgtgtgtttgcgtgtgtgtgtgtgtgtgtgtgggcgcatgcatgctgtaccacagtgggacgtttatatttgggagtttggattgagttgggagtccagggaaggcatcctggagacatgaagccagaggatctggagggtgagtaggagtcgctgtcgacagtgttgtgtctcaatagagagaggagggaacagtgtcctgggtagagggaacagcatgacggaagccctgtgataggagggacggagagctgcccagtggggctggagtgcagtgggaagtgaaccagcagggcaggcagggccacgccccatggagtcttgcaggccatagaaaggatttggggtctttgttctaagctgatgggaagccatcaacaggtttcaagctggtgggtgacagaggtgcccacgttgcaccaggcctgtgctggctgcaggggctcaagagatgaacaaggcacagcctcagtcctggaggaacttggaggaagcagaggtctcagagcatttttttctacttaggaattttagcaaggcttaagtcagatcagaagtcagaagccacaccatgatcatttgttgtttctcagtgacgatttaaagctttctgatgacaaaatacagaaggcccttctagggtgctttccaatcaggagttaacgagtggcttgatgaaggcaagaaatctgggtgtgggagccaacttaggctgcttggccctaaccactctaactaccacctccttccagccctccacctcccgggccagggtcaagtccaaacctgccatgccctcaggatgaccctgagacgtgtcatcagtgcagtgcagtgacaacttgttctagtttgcctgggaccatcctctgttttaaaactgaaagtcccggtcaggtgcaggagcactttgggaggcccatgcaggaggactgcttgagcccaggagttcaagaccagcctgggcaacatagtgagacctcctctatacaaaaagaaaaaaaattagccaagcatggcagagcacacctgtagtcccagctacttgggaggctggagtggaagatcatttgagcctgagaggtaaaggctgcagtgagctgtggggtgctgtaccacttgtattagtccattctcaagctgctaataaagacatacccgagactgggtaatttgtaaaggaaagaggcttaatggacttacagttccacatggctggggaggcctcacagtcatggcggaagacaaaggaagaacaaaagggcttacatggcagcgggaaagagagcgtgtgcaggggaactcccatttataaaaccatcatatcttgtgagacttactcactaccacaagaacagtatgggggaaccgcccccatgattcaatgatctccacctagccccgtccttgacatgtggggattattacaattcaaggtgagattggggtggggacacagccaaaccatagcaccactgtactccagcccgagggatacagtgagactcttccttgaaaaaataataagataaatagagtagaataaaatacaatataaaataaaaacactgaaagtcccgcatcctaggaaaccccagtccagggcaaagtggggtggttggtcacactcagcgtcccctccccttggggcacttttactggacagccaggtaccaccccttctaggtacaggtggagaatgagagtgttttcaagtgcaaaagactccggagggtcacttgatcttgagaaccccccaagtccaccacagtccttccggggacctttctaaagtgcagactcccaaggccccagcctgccctcttgaatcagcatctgctgggttagagcctggggatttgtactcctgtccctgagccaagcgttggagagcaacaagccagaacaaatgaggcctaaagggagaatgcgttcttcccaaggaccctgggcgaggtagtcaggaggtgtctgatccccctcctttactgtctctgtatctgccagttagaggcgtggaccccccaccctcaccgaccccattaaaggcaattgaatcctgtcatttaacttggggtggggggacttgggtggttactctgttgcccgggctgaagtacagtggcgtgatcatggctcactgcagcctcggcctccagggctcaagcaatgctcccacctcagcctcccaaggaactgggactacagacatgtgccattatgcctggctaatttttgtagagatggggtttcactatgttgtgcaggctggtctcgcaatctgccagcgtcagcctctcaaagtgttgggattccgagcatgagccaccgcacccagcttctgaagtttattttctgttattgtctatgtttgtctgttgatctgtaaggctgcttagtcaaaattgattaccctaatatatgtatttaggaattttatatatataaattttcacatatatgaaaattcccccgtattttaatatgaaagtcacgtcttcccattttccttgcatagcatcccattctccccaactcctgtggccattttctggtccaaagacctggccctccctgttctgcttcaaactgcagagtgtttaatgctgtatcaggcagggatctttagacgcaagcagcagatactctaactcatgtgagagatgggattctgggggtagcctgcaagaatcaaaggaaaagctgaaaaaccaggtcttggaaagaagatccaggcaccagcaactgataggcagcggctccagggaggtgctgtcagaatcaaggaaccctgacagggtcactgtttagactcaggtttccaggagtgagagtctgattggcggagattgtctacgcgcttggcccctggccagagaatgtctgagcatcttgaaggatagtcccaccaaaactgcctggccaggagagagataggtcccccaaggaaaaccacagaacctaagctcatcttagctctaatgtctgtaaatattgggacagcaagtatttctttttttattttttgagatagggtttcgctctgtcgcccaagctggagtgcaggggtgcgaccttggctcgctgcaacctccgccttccgggttcaggcgattctcctgccgcagcctcccaagtagctgggactacaggtgtgcaccatcacacccagctaatttttgtgtttttagtagaggtgaggttttgctatgttggccaggctggtctcgagctcctgggtgcaagtgatctgcccgcttcaacctcccaaagtggtgggattacaggcatgatccaacgcacccagccaaggaccacaagtactaaaattagggtgcttttggccttatgtgagagaaaatcgaattaactgtgatttcagccacaaagatagttactatttttacataacaagtactctggaggtagaaaagtttctagagctgatttagcagcgtctgcgtcaagcacttccgctcattccatccttctattctgtcatctttagtgttggtgttgacctcttcgtggctccaaaaagtttgctgcaactccagatatttcatcctgccccgacaatatttaaagcagtcagcaagagaaaggagagcaatttaaaaaagctttctcctccctcatcgctctcttttcaggcagtcatatttttctttttttttttgagaggaagtttttgctgttgtgcgggctggagtgcagtggtgcgatctcggctcactgcaacctctgcctcgtgagttaaagcgattctcctgcctcagcctccctagtagctgggattacaggcacctaccaccacacccggctaattttttgtatttttagtagggacggggtttcaccatgttggccaggctggtctggaactactgacctcaggtgacccacctaccttggcctcacaaagtgctgggattacaggcatgagtcaccgtgtccggcccagggagtcatatttttcactgaaggttttctgtggtcagaactgggatacatactgacccatcagctataacaagtaaacaggaaccagattgccaagaagaaggttggcaaactatggcccataggtcaaatctggcctgccacatgtttttgtaaataaaatcttattgtaacactgccactattattcatttttgtattgtctataggtggtgtcatgctactgtggcagacttgtgtgaccatggcccacagaaaacctaaactgcttactgtctggccctttacagggtacgtctgtggacctctggcttagaccaattatgttcaccctctgggttggtgatgtggctgcccaaacaaaactgggtttagttagcaagaatgggaagcaaaatagctacagggtaggtgacaatatccttccacaaaatatcagttgtaatttttccaatagactaaaataaatacctattaataataagagcttaaggctgcacgcggtggctcacgtctgtaatcccagcactttgggaggccgaggcaggaggattgcttgagctcaggagttcaagaccagcctgggtgacatggcaaaatcttgtctctacaacaaaataataataaacaaagaataaaagctgaagtttgtcttcaactctggccgtatgcccctgggctacccagggtgcactgtggtccatgatttattgaaaattcacctttcttcctgacaggtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaaaaaaaaaaaaagaaaaaagaaaaaaaaaatccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtgaaacctatctctactaaaaatacaaaaatgagcggggcgtggtggtgcatgcctgtaatcccagctatcaggtggctgaggcaggagaatcacttgaaatgggaggtggaggttgcagtgagccaagaccgtgccactgcactccagcctgggtgacagagtgagactccatctcaaaaaaagaaaaaaaagaaaagaaactaattacgcactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagccaggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgac

SEQ ID NO: 16990 - DNA, 86440 bp, Human
tagctgaagtaagtttcagcactcaaagttatcaagaaaactcttctatccaggatgacttgtagagttgcaaatgattgagattttattgtaaacagcagtttagttttatactattattagtacttagcttatttatattgtgagttaagtaactttctgtgggcttatcaggagaactagccaaactttattatgttgattgtatgagaaaatgcatttttacattccaatcaagtgactcaaaaatactactcagttgaaccatgtgaaattgttgattgatattcaaccatttttgacaaaaatggcagtttattttgaaatgcagtcctgttgacaagatggaaattacctacacattgatttattaattttatatttaatacattcatgtatccttcaagatgctaatcctacaccttaaggatattgggtaaatcacagaattttgaagaaaatttgtgtggaatattggggctttcttgggtccaacccattttttttccacttaatcagagatggagcagacatgaggactctggaattttttattttttgaactgataatagaatgaaaatgcagattcatttgttctattttaggccccaaattaaccattctattttgaagattaagtttaataataatagtaatagcaaacatttattaagtgcatgctacatgctaagtactgttctaactctgcaactgttttatctgcaaagtactattattatccctacttactgatgaggaaactaaagtttaagtaacttgttccaggttatacagctagtaagtggcagagttggcattagaatcactcagtcctactaccgtgtttactgtttacctcaagcacatggttttaccacagtaaagcactcatgctaaaagattatgattcaattcagcaaatatatatttaagctatgattattagtgaagccagacccattcacatatgaaacatattgtattattatcagagaccattataagacagtagaggaccaggtaccaaaattagtcttatagaccacaagtgctataggaatctcagaagaggagaaaataattgtgtactttgtcatgactaactcccagaagagcattgacaaatagtacctcagtattggatgcacagcattttgggaacaaaccaaaattacatcataaatagcaatgtggcaaaatcatgaatgtgtaataatgaagtccaatggggagcagcaaactcaaggttttctttctttctttctttctttctttctttctttctttctctttctctttctctttctctttctttcttcttttttttttttttttttacagagttttgctcttgttgcccaggctggagtgcagtggtgcgacctcagctcactgcaacctctgcctcccaggttcaggcgattctcctacctcagcctccccagtagctgggattataggcaccccccaccaccacacccggctaattttgtatttttagtagagatggggtttcaccatgttggtcaggctggtttcgaactcctgacctcaggtgatccgcccacctcggcctcccaaagtgctgggattacaggcgtgagccactgctcccagccaaattcaaggttttctgttcaattttctgttcaactcaaattctgagtgagcatcctcagtatgtgtgggaagttagaaatttgtggctaggctctctgaatcccagaaatatatgaagaaatgggacctgatggattatttattagatattcagggtggaagaaatgggattcagaaattaaccaaaatgtcatgcctacatgattggaataataatggtatcaaaaataaaatggtttgtacagtggaggggaagatgggctcaggctttagacacatcaaacttaaggtacaggtagactgtctatggaaagctggttttttatgttggctatgactgagtggggtcaacctttgactaatgtacttgtaatttttacagatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcagatcacttgaggtgaggaattcaaaaccagcctggccaacatggtgaaaccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatctcaaaaaacaaaaacaaacaaaaaaaaacactaccttttcaagtgtgcttcatcatcttatatactgtccaccacagacccaaggtcatagactatttctgcagcctaacctaccaatcagtcctttaacatagaactaactatacaaggatcctccctcctccaactccagataccttcagtcctttctcagtatgtctgagagccatgatagcatttgtatctctcaaaatcaccctctataagggcctcatctctcccggagatgtcccacacctattaaggtcaacaggaggatttggttctattcttggaattgacagtgttgtaccctgctagcacttacatgatgtgttaattccaatgataattttatcaatgttggtatccactaccatgcccaaatctgaactagaccttctagaactagtttataagtttcttgtgggcagagatttcatttctctttgtataagcctagaatctagcctactatctggaacattgttggtgattgttatgtaagttgatgatgttgactgccccttcagctaggcagtgatgtatcaatggaaaccatccctgttctgggtgtaatagctttgagttaactagcaatgcattctgtggggcataacaaaatgttgagctagctcctgggcagggtctttgaattgctctgatatttcagcatcactctgtcaattgacataatgctacccctttgggcacaggggtttgtagaatacatagctctgggctgctgcaaaggcatctggattcaaagacagcatgtgtctggctacatctgccaataatatgtgtctggagggttacaaagcaatatgactttatacagatgaaaatgaaaattttaaactgacatttgttgatgtgagtaagggccactgatggaagcagttttagagggcggaagctattaaagagatggagccaggactttgtcagtaggggcaataagaagtataactggctgaaatctgagaaagagctcagaacaaggaccccataataataccaaaaaaaaaaaaaaaaagagccagagcagtaagatagggttttctagtcagtggaggtggcagcagcattgagcctttgaatggagaactggaccagtggggccattctctagagaagtcattttgcatacaattgatgaccaattcaagcctaagaaatgcagtccatgtagtaaaagttacccattattcacctactacttgtagccagtttcccagaagtcttctggctatgtggaagcagggagctaagaagcatggaccctttcctctcctaatcatctcaccctctgatacatgtaagtctctccaccttcagcttttcccctgaggctactcccacaaccatcaaacttttcataatccctggttgcaaaggaagagaggagacaggtggtaagagcaatatcaccttctatagtgggcgtggtcttccctccctctctgagtggtaagtctaatggcttctaaggtttacctcttcatctaacctcccaagttttctcttaaagaaaataatttcctcctttccctaaaactactttatccaaattcagctaccaacgtctctgataccgatcttccttagaatgtttattctgtcctaatacaaaacagttttctctctggtcaaggtcaaagcctctcattaatttttagcacttcttatatacttccctcctgatctgatactctagtcagtcactagactctagtctcttggtgccaatgccaagtttctcatgcagtccaggcatttttctttaatcagtatagcttggaggaatccaagagtcccttagagttaggagtatagaatgcctgggggtccttgaattttattagatttccaacttttcacctggtggtctgtagaaccatttctttagatgtggcagatgctccaatgagttaaagagtggtaagtcaatccaaatctccttttcctttgaaccattcttgttactctgatgagcgtatactatatttattcaatacactcatcaaatatttactaagtaaatacagcagtttatatagtacttgaataaacattcaataaggattttttttaatattcccactgcctagaaacagacttggcacctagtagaccctcaataaatatgtcctgttgccctcaaagtgatttacttccagcataaagaggcagacaataaataaagttggttaaatttgataagtggtatgaagaaaaatatagctgagcaacagggagagagagtgatggggtatgctgtaagatgatcaaggaaggtatctctgataagggaacatttgggaagagacctgaatgaaatgaagtaagagctatgcaaatgtctggggaaaaaagaagcagaaaattcaaaggctctgaagcagaagaatgtttggtatgttccagaaagatcagtgtggctgggagcagagtaagaagaggaagagggaaggagatgagttaagaaagcaaaatccaatctagagccttgttggccaaggtaaggactctggcttttattctgcatgaaatggaggaccactggaggattttgagcagaggaatgacaggatctgatgtatgttttaacagcattcctctggctgctgtattgaaaataggtgcaggaagaaaggatacaagcaggaagaatctttaggagagtattacaataatccaggcaagagatgatggtggcttagaccaggatggaagcagtgtgggtggggagaagtggtcagattttagagagattttgaaggaatggctgaaggatttttcagattgattagataagggatatgacagacagagaagaggcatcagtgaccccagggttttggacttcaggaactaaacaggtagaattgccatttctgagatgaggaagcaaaggagagaagcagtgtagaggaatatggggaaagagtttagttaggcttgttaaatttgaggtagctattaaacagccaagtggatatataagtctacactaaacatcactgtgtatcatgaaaataagatgactctcttttgtacaaaggacttgtcattgaagaagtgagtcagtctggaaactgctctgaacagaataagaggtaggatgggataggtaaatcatagtggggtgagttatggccaaaaaaaaaatcttatcaggtgttgattataaattcacaaattacttgatatgttataataaaaatttaactatctaagctcaggtttgcctcacaagtgtcaaagaacaagtcatttaccttgaagagttaagaacatggcagaagttcgtgaccagcctgggcaacatggtgaaaccccgtctctaccaaaaatacaaaaaaaaaaaaatagcggggcactgtggcacacacctgtagtcccagctactcaggaggctgaggtaggagaattgcttgagcccaagaggcagaggttgcagtgagccaagatcgtgccactgcacttcagcctaggcaacagagtgaaactccatccaaaaaaagaaaaaaaaagaaagaaagaaagaaagaaaaagaaagtctagaccctacttcatttgtttggtcattcatcatttaacaaatgttttttacaggtgcccgccacaacacccagctaatttttgtatttttagtagagactgggtttcactatgttggccaggctggtctcgaactgctgacgttgagtgatccgcccacctcagcctcccaaagtgctgggattacaggggtaagccactgcatccagcctagactttctttctaggaactatagatattaagcttaatgatctccacaaatccctgtgagagaaaaaaatttttataaacagttcattaactcttggaaacggaagggatgtagtgatccttaggagctgcataggttcaccaagaacaaatcaggctgcagaagcctattttcctgttttcatcagactattaaactagttgattagaggcatagcatacacatagtctatcttgccttttaaaaagaaagtcagtggcaatatccagggtatatacaatctttctgactcaccattcaagaatgactaggttcatctcagtttctccattcaaattactttataaatgaaagcattggctagctaagcaggagtctcaaacacatggttagtttcaactcttagaaaagaagtgaatttcgttttctttactacatttcttccttgaattcactgacttgagttggccagaagtatttcagatcgtttaagtttattcgtactaattatgtgaggcctttggttgttgttcttcttcaaagaaagtatgataccttcactgtgggtgttgagtcacaacagttctagaaatctgtgccaggatttcttgctgtgtcttatctttgtgatgtgtttctgaagtaataatagctccaggtggcttgtttggtcatctcttgcacagcactccagaaatccacagaactttattttctagttagaatgaaatgtagaatgtatttgggaggtcatgaggccttagaatcaggtaaaatgaatccagaattcccaaggaggtagtttccatatttcacaaatattattgtaaaaacatctgttctcttccgataggagcattttcaggagttaataaaaatcttaatatctctccacacctgcctgccttccatgtttccgtcctggtaagagaataaaattgcagcatggtgtaatagaagaggtactagactgagctgcaatttcttgattccaatcttgatgtcactgccaccttaccagccatgtgaacttggagaagtcacgtacttctaagcttcagttttcttgtccttaaaacagggataattagccctgcttacctcatagagttgttgtgtttatcaaaagtgttaatgtctgcaaaagtacctcattttattttattttatttttgagagggaatctcgctctgtcacgcaggctggagtgcagtggtgcaatctcagctcactgcaatctccgcctcctgggttcaagtaattctcctgcctcagcctcccaagtagctgggattacaggcacccgccaccacacctggctaacttttatattttagtagaggcagggtttcaccttgttggccaggctgatctcaaactcctgacctcaaatgatcctcacgcctcggcctcccaaagtgctgggatcacaggcacgagccactgcacctggcctacaaaaatacttcaaaaattattaagtgctattactatgctctctctggaaaatgaacacactagtatggtgtgccaggcatttggggcattcacattccctaatttatggacaacaattataatttcttcagaaatgctctctatcagccaaattgcccatttttgttctcactcatgctatccaagcccataggaagaagactccaagcctcacactatggcctacctcatcacagcaaatgatcacatctgcacattgctctgtggcactatctcactctggctggctggctgtatatatgtatccctttttgttagtatttcagaaatttctcttccttgtagtttacttttggacatatcaaaaaacttagtattcttttctactattataaaagagtagagggaaaaacaagattgaaatatatcctttgtacttcaatttttaaaaataataatggaatggggcatagctactattaaattgatacagatgaacatgagagtctatgatgtcaaagaaaacagactttctgcccgtacaaatgttagctagaattaagaattgccctcattttagtactgctcttgtatttattgctttcagtgagccatcactgtggattatcaaatgagagagtaaaatcattttgagagcgatagagtttcaggggcttgttcacaagacaaaagtaaagcttttgaaggctcaccatgtgtgtggactcgaagaggattgttgatttcacatgtagaatccccaaggttgcctgctggtagtgggtgccaacagcttaagtgcccacagcagaacactctggagagtggctttgtatcaaataagacattaagtaagctaaaatatctagcttgctcatactccaaaatatcctttaaaactgtattttcattgatggaactagccctgcagtaaatgatctcaacaggccatcaccactaacacttggttaacaagcatttttagaataccaactgcttgtaagacgttgtaccaggttctgtaattggtatagctaccaaactcctgtacttagtatgtaaggcctaaattgaattgggtatagaggttaaagattaagatgcttaaaatatttatgggattttttaaattacaaaaatgatacatatattataacaaatatgagcaatacagaatcaggaaaggtataatgtgaacatgccctccccacccactgccccgctacaatactgcttataaagttaagacatctttgaggaatatctcacttgcctaaaggaagtcataggcccacctgacctgatgttctctaaaggtccttcctgtctactcagtctctctaaagttccttctagttatttttttctcaatattagggaaattggtgaactctaagccaggagatctagattctaattccagctctgccattagtagttatagtagcaggatgaccttaggaaagtcttacttcacttctctgatcttagtctcttctaaagggttaaactagaatcagtgattctcaactggattgtaagagatccaaaagcatataaggagtttttttttgaagcatgcatactcctgggaattctgaccactctacaccccattaagaaaactatactgaggaaggtactattactgatgagagcatatcatatccttcagatgtattaggataagaaaagatgttgaactactagaatagatggttgaattgtttccttccaactctgatataacttgttactaactattcctgacttctataatataatgataatagctaggctagttttagccaatcagatgatgtctatgtctagatgattaaatactaagggtttcaatttggatggtcagtgagccttttcattagcatccctgagaacgctcaataaggattaagtgcatgcaaatggtttcatgaagtgaaggctaagaaggttaatctgttggctgagtggtgaactgctagctcacttctgtatggctcctcaaaatatcacaggcagatatagatgtgcggtcagaaggcacctgttggctctgtagtgtattacttacacaaccctgccttaccctagattctactccttgacctgtagggcctcttcagtctcaaagataaggaactactacagcttccttttttaaaaaactcattcattcagtaaatgtttattaagtaccaaactagttgttaaatcaatgtttattgatcacccttccagacactaagggcacagtagtgaacaagataagaccctaccctaatcaaactcactgtggatgatttcaatacagtgtagtgaccatataatggggtaagcacagggtgctatgggacacactggcacctgatctagacttgggaggacagggaatgtctcctaataagtgtaacatctgagctgcaaactgatggatgctatagttagccaaatgaagatttgagggaagtgtgcaccaggcagagagaatatacatgttggaaggcttagagtaaagagggagcatggctcatttaaggaactaaaagaagtttgtaagggtgtaggataaagatctaaagtgaaaatgatcataaatgagctggccaagaggggtcaaatcacgcagggctttggaatccattttatggaatttagaaactatcctaaaggcaatggggaagtacaggatcaatgtcaagaatagattatatggcaaatatcttcaaatgctaaacacacatactgtaatccagcaattccacttctatttatagatatactaacatactggaaatcatttatcaatgaagatattctttgctgtactatttataatagcagagaattagaaatacatgtccattatttaggaactcattaaatatgataaatctgtaactggtcatcatggttgctctgaggaagaaaactgagtgtttggggctgaggtgaggagggagttgactagttgaacatgtgcatgttctaccagtttaaaataaacagataaaatttaattttaaaaatagtctggacacggtggcttacgcctgtaatcccagcactttgggaggccaaggtgagaagatggcttgaggccaggagtttgaaaccagtctggacaacatagtgagactgcatctctacaaaaattttttttattagcgaattgtggtggcatgcacctgtagtcccagctgcatgggaggctaaggtgggaggattgcttgagcctaggagttcaaggctgcagtgagctatgattgagcctctgctctccagcctgggtgacagtacaagaccgtttctcaaaaaaataaaaataaataaaatggtcatgatatgccattttctactcattacctaaatacattagcaacaattttataatacattaacatcctattataattaggggtggaaaaactcatatattgctggaaagaatgtaaattgttataaccattttggattttaatctctctggtaaagttaaacattaggatacctgtgatccagcattcactgtcttgggaatctagcctacaaaaataagaattcagccgggtgcagtggctcacgcctgtaatcccaacactttgggaggccgaggcaggtggatcacctgaggtcaggagttcgagaccagcctggctaacatggtgaaaccccgtctctactaaaaatacaaaaattagccaggtgtggtggcatggcctgtaaccccagctactagggaggctgaggcaggagaattgcttgtacccgggaggtggaggttgcagtgagccaagatcgcaccactgcagcctgggcgaaagagtgagactccatctcaaaaaaaaaaaaaaaaatgagaattctagtatataggtcatacataaaaggatatttattatatcactgttttgttgccaaaaggagggataactctaatatctatgaataagaaaatggtaaaataaactacgacatagacatactattgaatattatgtatattattattcagtgtaataataatggtaatattattactattaaaaggaatgagttctatgtagttctgtgtaatggtctgaagtagccatgttctattgctaggtttaaaaatgcaagttttagagtaatgtgtataatatgatcccattttcatagagaaagattttaacatatattttttattttatatgtaaacatatataaaatattttataaatattataggtgtgtgtgtgtatatatatatatataaacataggaacagatgtgggaaagggaagcatcagtgaatatcgattaccttgggtggaagagggttggatgggaagggaataactattaaatggttctttatgtagttctatatgtttgatttgttacaataacatgtgtaactgtaatttataagaatataaaaagtggttaaagtggatagaaaataatggacgtgagagggcataatgaagacaaagaagggaggagattgctgtaatgatacacaaaaggaatgacagtggctgaattaaagtaacagcaataaagacagaagtagatagatttgagttcctaggtagaaaaaataggacttggtgatttgattgaagggagaaaaagaagagtcaaggaagccacccaggtttctggcaaggtactatactagtcactgatataatgatcggggaagaagatgtgtggttttggacaggttgagtttcaggtaccagtgggaaattcaaggaggagaaacctgtaagcagtccaagatatgcatctgaagctcaagagagatagctggtctgaaaatatagatatggagataattagctacattaggactctctcagttacaagtgacagatagctggcctaaattggcttaagattttagaaaagaaggagggggaggatttattgcctcatttaactgcaaagtccttcatgaagctggcttaaaacatggcttaaccttagggcttaaatgatatcatcaggactttctccgctctgctttcctttgtattggcctcattcttcatgtaggttctcactatgaggtgacaaaaatagctactagaagctctagacttacatcttaccaattcaacaagcccagtggaaagaggatgccttattcagtaagaaagatgttggcaacgctggtgagagcagttttagtacagtagttggggcagaagggttcatgatgaaaccagatgaggaattagaaaacagcaaatataaacaaaagagaggaggagaagagaggaatagctagagattcattaagcatctattatgtggaagacactgtgttatattacacccggggacacaaagatgcataaaatatggggttttttttaagctctggaagcccacagccttcagaaaagagaaaatcttataagtaattcacaaaggtgatagataagtacttacatagaagtatgataagactgtcatgggagcatagaggagggaaccacagaatggtcaaccaaatacattaaatacatctctgaggagaagtgcataatggctggcacatactaggcatgcatatatgacgaattaggtgacaattatgttttggaaggtgaatgggactttgatgaagaaagctagacaacccatttctaacaaagggaacagcaagtacaaagctaaccaatcccctaggtttgctggctttcctctcggcatgaggcttagaataagggctgagagaaagccaaaactgttgggcagagaaaatgtgacaagaggccaaaatagcctaagggggccttcaaatgcccattcaggtacttaataagtggcctttcaatcccaaattatcttagcatcttccctacctcactatttctctccgctagcctccatacacagaaataaatgttagcaaggcaagcacaattcttccttgctaataaatataaaatgtaagccatgtataatggttcttaacactggtagcagttttaatttctctgatcttctactataccaatatctggtgcaaggcagcaaaatacatttagtaccttgatgtaatttagaagcaatgattgatcctaccttccttgtgtaagactcttagctgacttagagaacataagtcctatgtaattaacatgttcacaaatgtagagagagctgtttttgaaatggtgaagtaccaaggacgctttgctgtaagcttatgaatcttggctgcattttaccactgcttccagcatgtagctcctttaatgaacctagtactctggtgcattaagtcacttgtttagggtctagtcacgctgaattctatatactgcgagccagaggtctaatcaacctatgctctttgtcacatggtatactggaaagaagaggtctttgtgcagatctattctccctatagcacaacaagtcgtgggcctggcctgctgccagaaagttagtagtgtcatctgtgtagatgaaattcagcaactcattatcttacattgtgccagaagagtgggaagaagattgacttggtaatttgctatgtttcgatcctaatctgtttagaaatatgatttctttaaaaggaaatggaaaagaatgtgtttctcatgatagcttcacagtatctcctgagaggatgttcagttattgtaaatacagcaatttaattctctccttgaatttcagatgtatttcatctctttaaaaaataaatgtgttgaaatgatcagattataaagtatgaattgtatacttccaaaagtggaattttatatttcagattacacaaaaaaacttttttcatgagtcataaagttattggtttgtatactatgttatttttatacatcatctccaaaactctttaaaaataagtttacattgtaacctatttaaaggagaaaggcatatttgcggtacacatattttatctcagagtcatttcagcattttgagtctaattcattcttcccaccctgtagcatagtatgcaaaatccagaagctatcagaagcaaggcccaaatttagtgtagtaaagcttctagtacatgggtgaaatacacacataagaaagaaaaaagaacaaggccaggtgtggtggctcacacctgtattcccagtactttgggagaccaaggcaggaggatctcttgaggccaggaacttgagaccagccggggaacatagcaagacccccatctcaaaaaaaattttttttaattggccaagctgggtggtacacatgtgtagtcccagctacttgagaggttgaggcaggaggatcacttgagcccaggagtttgaggctgcagtgagctatgactgcaccactgcacttgaacttgggcaacaaagtgatgacctgtctcaaaaagaaaaagaaagaaagaaaaaattcagttgatatcaagtttctgacccttagtttctctctgagacagtttggagtaaggaaagagcataagatttaaaatcacacaaatcctagctctactacttttagctttgtggccttggccaagtcatgtaacctctctcaagctaacttttctcattatataatgatagtaatgatacttcctttgataagactttataaggactagagataaattaaaatgcctaaaccattgcaggcaacataacaggtgctcaataattggtaattattagtatcaactgtaaaatgagaatagtactaatttatttctcaggttatgagtcgaatgaatgagaatgctttttttttcaagcaccttaatctcttagctatttcgtagttgaaaagaagttatcctgcttatctcacaggattgtgatgatcaaaaaggataataaatgctaaaacacctagaaaaacataaagtgctgctcaacattgggaccaagcttccctgtatactgaacatctcactatatggtccagaacgggatcttcatggtgattcttagtcctcaatagacagctgtatctagcgtgataagacagggaagtctcaaaacactttacaaagatttctgtcaggtttcaaagtttgctgtcaacgaagtagaccttaattacccagaaaactcatttctgtggaactccttatatggagccaaggaagcaaggtgttaaactgtgcataactcttattaggtgaggactatatagcattgtaattagaaagaaatctgaggtatagtgttcaagccaactctataaatgccgtcttaaagattatataatgtattctaaaatatttcatatggatttctaaagaattgaataacaatcaaatatgctaaacataaaaatgactcaggacacagtttaataattcctgatgccaaatatatatcagaatctgtaggaccttaacaatattatttatgaatataaattattgatcaaaactgtacaagtaaatgttgaagactggaccaaacctgatctgggttgaagtcctgagctccctcactcactcgtcctctaatttggaactagtcagcctccatgtcatttcactgattgctgtagaaggtcaaatgaattgatgtctgtgcaaatgctatgcaaactgtaaaatgatgtacaaatgtgaagtattatttatcataaaagttgaatacagaaaaatggtttgaaacagtttattaacttgggaatgtcaaataaataagagattatgagaaaaccaaagtcctggttatgtttagtatatcatgcaacattgccatggggtggcaaccatagcaacaaagtaagtaatcttttccaccagacatttctggttacagcctcttgtttgactcaagccagtccccctccttgactgcctttttacctcctcacttttgatccttattcatccttccaagatccagctgtaggcttcatagcctttaagaggccttgataaacctctatccagatagctcatcttagtttacattcttccacgtgcatgcttaagatacttataatttctaggcctttttcatgtgcttctcgcgtcttcacagctatgtaacaagccaaaagaggttagagattccttctatctcggtgtggcaactagcataatgcaaacagttaagtacttaatgaatatttgtagattgaaagaaaacatgctgcaggcccaatgctaaagcatacccttctttcaaaaaagaaaactatatttgaaagagcttaagagatggtcagtagacaatgcagttgtctatgaagccacagtgagttatatatataaaatggcaactaattggtaacttattgggagatcaagggaagaagttgttgtaaatatttgttcatgagggagaagccttcaggctctttccagttctatccctgtaccacagtaatgatactgtgcacaaatggcttcctcaaagggctatactgtgtaatatacataatgttccattttcacatttaaatgtaagttaagaaacaaaattacattgtaatttatcatcacatatttattatctccccttcttctcccaaattttatgatttttctgattgctaaggtatagtgtggcactcttcaccatttattggcataatacagagcttagataacattcacatgcagaacaccctccctggagcccttggggttctgtagatttttctagcacgatggctgtaactaggcccccttttcttcttgctcaagaaagcctatcagaatgtgaataagagtgacactatcatagaaataacatttgttccagtttttatttaagtaaattattaatgaccttcaggacttcgttagtaacaaaatgtttgcagtacacttcaataccacagttgcagtcactggggcagtaaaatggactttggtttcacatttaaggacctgggttcaagttgtaagtctgccacttattttctatgaaactttgaacatgcttcttgatctctcagcctcagttcctataaaatggcaataacagtaatacatcactgggatgatatggggattaaatacaatgttatttgaaaaaccaatttttaaaatgtaaagccctgggcaaatctgagttctgtatccccttatgcacccatgtaattctcctttctgtcattgccatgcccttggtttaggccttccaactacctattgctttgtctccttccttaccttatatgaattcctcatccccttttccttcaaaatcattctcttgtagttgatccaactaacagtcacagattcattttcttttccatttgaattagctataactaactaagctaatctaagctaatctaagctaatctaagccctaactcctagaggttgttcttaattatgaacttgcatgcagtctgggacagaaaaacagaaaactccttacttattttagagttttcaatcttttcctccacccccagataatgtttttatatacaccaaaagtcaagctcttctcttgccttcccaatacctccagtgtatacccacacatagcccagtgctgaaagacagcttagggaatgcagaggaaagggactgaccaccaaaaacaagacaaggatcttgtgggaagacaggacccaagttctctagatggctgaactacaacctcaaatgtcttagcattctcaaaatttgtatgggaaccttcagcagtagggcctggctatacctactgctactgttccaagctctaacaccacgtggtccagtccagtagagcaaacaaagattgtaaaactaggaccagctgccacttacagtgtttcttgggccttcacaagcagctccactccttgcccattgctcctcctactggttctgatccatattggaactccctctaacttgcattgccttctccctcattccctagttgtcccagttggatgagaattgtgagttcctagatctctctcaaaagacattcttccatatatacgacaggagacttatacagcgtcaaaatctaacaacccaaatgcccatcaacagaatagtgtatggataaactacgatatattcatacaatgaaatattaaacagcaaccaaaccaatgaactgtagcaacagttatgaatatgagtgaatcttaccaatataatgttaagcttataaaaagtaaatcccctatgttgaatttgccaacaaaagaaaaaactatgtttgtattaaacgtatttaagaagcaagtcatctcggacctgtaataaagacaaacctaatttaatattgaaaagactaagtcctaaaatattaaatgtagcataataacctttgtaagttacaaacaactaactttaaatatatatatatatattaggaatatatacaaatgtgatataattatatgaaaaggaaattgagggaatgaatgaacacaggattcaggataaagattacttgaaaaaaaaagattacttgagtgggtaaattgtagggagatgagagtgagaaggaaatatatggttgaatgtaagtttttaacaaagtcctagcttttgctttgggtgactgttttacaagtgcttattacattattttattaaagctaaataaatacaaaaataagcaatgggggaaaggagtcactattcaataataatgctgggataactgactgtccaaaataatgaaatatgtagaagaatgaaactggacccctacccatcaccatatacaaaaattaactcaagattgattaaagacttaaatataagacctcagactgtaagaatcctaaacaaaaaccgaggaaacaccattctggacatcagctttgggaaagaatgtatgactaagttatcaaaaacaattgtaacaaaaacaaaaattaagtgggacctaattaaactaaagagcttctgcacagcaaaataaatttcaacagagcaaacagacaacctacaaatatttgcaaactatacatctgacaaaggtctgatatccagaatctataaggaacttaagtttgtctttattacaggtccaagatgacttgcttcttaaatacgtttaatacaaacatagaacaaggaaattgaacaagcagaaaacaaataaccccctttaaaaatgggcaaaagatatgaacagacacttctcaaaagaagatatacaagtggccaagaaacatgaaaaaatgttcggcatcactaatcattagagaaatgcaaatcaaaatcacaatgagaaaccatctcacaccagtcagaatggcttttattaaaaagtcaaaaaataacaaatgctagtgaggttgtggagaaaatggaacacttatgcactgttggtgggaatgtaaactagttcaaccactgtggaaagcagtttggagattgctcaaagaactaaaagtagaactaccatttgacccaacaatcccgttactgggtatatatccaaaagaaaataaaccattctaccaaaaagatgtatgcactcatatgttcatggcagcactcttcacaatagcaaagacatggaatcaacctaggtgcacatcaatggcagattggataaagaaaatgtggttcatatacaccgtggaatataacgcagctataaaaaagaataaaagtatggcctgtacaggtacatggatacagctggaggccattatcctaagcgaattaacacagaaacagaaaaccaaataccacgtgttctcacttgtaagtgggagctaaacatcgggtacatatggacataaagatggcaacaatagacactggggactacacgtggagggagggaaggagggagggagagggcaagggttgaaaaactacattttgggtactatgctcactatctggtgatggaatcaattttgctacaaacctcggcatcacacaacatacccatataacaaacctgcacatgtactccctgaatctaaaataaaagttgaaatttttaaaaaactaaataaataaaagtgggctacacatagaccaatgtgaatgtgctataaatgtaaaatagatttcataatagatttcaaagacttagtaccaaaaaagcaatgtaaaatatctcattaatacacatctatattgattacatgctgaaattaaaatagtttaggtttattgggttacataaaaaaaatctattaaaaattaatttcacctgattctttttacttttttaatatggttaatagaaatttttaaattacctatgtggctcacatttgtgactcacattatgtttctatcagacatagaaacgtgtcatggtggtataagaattctagagcactgctctttatgtgtaaacccagctgttttcaggcttaaagctatttagtttgtctttttaggtttaataattctaatttattttttttcagggcttctgaaaccttaattgaaagttttaataaatacaaaagtaatacatgctccttttaaaacaaaattaaatatcagagaaatttatgatgtaacagaaggaatgtaacaccacaatcttagctcccagatatagacacggttaagaattaagaagactttctaggtatatgtgtttttaaagtattagaatgtgaacatcaaagttatccctattctttctcattttttctgacaccagagaggcaacggaagatcatggctcaatgtttgtgccaagcagagaactaaagtagtggttcccacctctggagttacagtcctctatcgttagctggagtttggaatttttttcctggccaaatctcttcccctcaccccaaaaaagtgccatttggcatatgtttacactaaaagctgaagtgaactaaaattagtgttttgagaatttcctaataccccttgggaaaatatcagagacccaatgggatattgtaagaccagaactaacaatcactatttcagggtattgatttccaacaaagtacctgatcatttctctcagtgggtatgaaccaggcttctgatgggagtgtaatgatttggagaaaacaaggtggatctatttctctataggtttctctctgttcttaggaagaaattcaatggaggtagctgtgacagggggagggggggtggaaaaggggtccaaaggtcagatcttgattatgtgctagatcttgaaacttttcttttcaaattgcctgaggccctataaaaatcattaatatagaaatagctattttttcaagccttggactaagtgccatggaaattacagaagttattttctttgttcacattattgattgacaagttcaaagattttggatacatttcttggaacagacatcaaacagtttgacatttttccttttctattcaatgaaatgaatccttcattcaacatcatatgcttaggaaacacaccaatgaatttttaaatcatattctatattacccctgttcctgcactggttgagacctgtgagagaaaaataatacaaactgctcttttactgctattctgattagaatctctttcctctccttttgcagggaaatggcagacttgaactaggcattccaacgaaggcttttctgaaacactttttaagtcattgttctcagccatcctatctattctaaagtccattatcatttttcttctagcctgaaccccttgacaccacaattctaatgtatttgtctgtttcttttttggtcacatgttcatttgtcttgcttctgccttctcttagattggcagttccttgaggtgagagaccatgtctaggtctaattccaaagtaatataaatctacatggtcagaaaatacttattaacaaaattattacctagaacccatttgccccaaactctacctaggtttattttatgaaattaatgctttcatttaaaaccattaagttcacataacagtaaacttcttcaaagatcacacaaaaagataaattggagctagaaacacaaatgaacagcatggaagagttttggatattaatggcccatgtatatatttttcacatttttagtttgcttttgctatacaaaaatgtgtcctgtttatggagtactgtgtgatcttatttattaaacagaacagtatattagacagatcattcagttggaaatacatctggaattcagatctagttcaaacacgaactagctatgggacttacgtgctcagttttttgggcagaggaaggaaatgacctaacactgatcctgataacctcacaagggtattgacaagatcaatgcatcagaaatatatcagaaagtgttttgtaaactaaataccatataaatatgtgggatgtccttacgtttgcagtttcaacattcaagaagaccattcatttcctgttagcatcccttgtactttgaggatgtggccacaaggtcctttggcctttgtcagtatcatcaaaaatgccagcttttagacacagatgtgatttatttgaaagaattatattagctcacttttatcttttaaaaaattaagacaatattttattaaaataactaaacaggcccagcccagtgaggcacgcctgtaattccagcactttgggagaccaaggtggaaggattgcctgagttcaggagttcgagaccagcctggccaatgtagtgaaactccatctctaaaaaaaaaaaaaaaaaaaaaaaaaaaaaaaaaaaattagctgggtgtggtggtacacgtctgtaatcccagctatttgggtggctgaggcacaagaattgcttgaacccgggaggcggaggttgcagtgagctgaagttgcatcactgcactccatcctgggtgacagagccagaatctgtctcaaaaaaaaaaaaaaaaaagaaagaaagaaaaaaagcagctttctcgagatataattcacatatcatacacttcacccatttatacaattcagtggtttttagaatgttctcagacttgtgcaatcatcaccacaatttattctagaacaatttcatcacctcaaaaagaaaccctttagctattatccctcaattcccctattccctctcccagtcataggcaaccagcaatctactttctatctcaataagtttgcctattcgagacatttcatatcaatggattcatacactacgtggtattttgtgtctggcttctttctcttagcataattttttcaaggtttatccaggttgtaacatatatcaatacttcattccttttttatcatggtaaaatatacataacaaaatttaccattttaaccatttttaagtatacaattcagtggcactgagtatattcataatgttgtgcaaccattgccactgtacatttccagaactttttcctccttccaaaaagaaactctgtgtccatcaaacaataactccccatgaccctgctccctgcagcccctggtcacctctattgtactttctgtatctatgactacctattctagttccctcagataagtggaatcatacaatatttgtccctttgtgtctggcttactttccttagcatataagtcaaggtccatctgcgttatagcatatacagtacttcattcctttttgtggatgaatcatattccatttatgaatatactatattttatccactcatcagttgatgaacacaggttgttcctgctttgggatattatgaataatgctactgtgaacattcatttacaagatttttatggaaatatgtttttatttatcttagctatgtacctagaagtggaattgctgggccaaatgttaactttgtgtcagctttttaaggaaataccagactgttttccaaagtagctacatcattttataatcccaccagtagcagataagggttctaatttgtttgtcttctcatcaacacttgttactatttatctttttgattatatcatagtgggtgtgaagtggtatctcactgtagttttcatttacatttccctgatgaccgatgatgtcaagcatcttttcatgtgattattggccatttgtatattttctttagaggaatgtctatttagatattttgcctagtcttcaagcagattatttgtctttttattattaagttatttatatattctggatcccatctcttataagatatattatttgccaatattttgtctcattctgtggatggccttttcactttattgttggtttcatttgcagcacagagtttttaattttgataaagttcaattcatctattttttttcttttatcacttatatttctcattttttagtgtttctattttctattttttagtgtttctattataacttagaaaagtccaggatctgttttttttactgagaaaacttagaaaaggccagggtatgtttttcactgagattttatatcagtcacaactcaagtggctctgtgatttcactgtgatttcagggctttatagcttctttgaccacaatagtctgcctagctttgccatcttagtttctctcatatttgactctctgaaaaatggtatggtctaatctgggtgacaaggagtcaatatttcttctccctcaccctcctgtaaagaccttccttcccatcttacagttggcagaaatggagtgagactatatcatataggtatgtctgtgccttaacatcgaactaacctgtacatggtctctccaataacagactgcattttgcctacagagatctactatagtaagtattctgtaacacttagctatgatgttggctgttaggccctagcaacctgtgctttttctgaatagcttagttacaaaatactgtagcaaaagaattcgtcggagctgattactataacaatgtgccagaataatacttttacatttaaaaaatctagacctctaagattcctctcagccatgaaattatgttaactttgagcagttaaaattattttataaaaactaacatctgatttacttattctagactaaataagccaagtgctgtaataaagatctcaagctatattctaaaaaattatcattgattacattcctactatgttccaggcactatggtaggcactctaatcctcccatcatctctgcacatgaagtggaagttactctcattttacatatagacacagataacaacctcagatatgttaaataacttgagtagagttacaggtggtgtggaaagataagaacaaaaataaagtcttccttgtcttattttgcccctctgggcaggtgttcattttgtctttttgatgcttccagtatctgtgttgaccttttcttgcctgagccttgggcaggctgggctttctgtagagctacttgactggaagctttttctagccacaagcattccactggggttgtgggggcatctgctcactttactgtctcttggtagaaaagcttaaagtgaatttttaaagtgaaagtttagaatcttagtaaagctataagacatagacccaaccccaaactgctgtctcagtggggttcatctctctttaccgctagatccttttatgtcagtaggataggaccttggacattattgccagtggtatacagtatcactatggtatgactgaaagtttgagtactatttctacactcctgtaccacaaaagcaatctcatactatagaaacaaacctgtactgtagaatagaagagaattgagcaggaaatgtttagtttgcattgcaaacttttttattttttgtttttttctcacttttagcatcttgggcttctattctggggattagagatagtaagtaattataatatcaagatgagatgacaatatcattctttttctgttccaagtgaatgatggctctttggcccataagctgtaacacacataagtaaaggggttaaattgaaggcatgcaagaagcaggaaacaaccactacatggtcacgtgggagaaacattagttgaatacagatataattgttagaagtcagtcacgttctctagaagctttttcagacttactgaataccaactttgtgccctcactttatgtgctttacatcattgaattctcataacaatcctgtgaagttagtattattattctcattttatagacaagaaaactatggctcagaaagattaggtaatttgcccaaagccacacaactagtgagtggcaaatgcagagactgaaccaaagtctttttgactccaaagttctttcaactacactgcctccaaatgacttagcatggtcagatacttgcttttttccttgtagtatccactgttatgatcagcctggtgctagtaatgcagcagcatctgaagcatagtggttggaggagaggggaagggggcgtttaaggaccagaaaatggcatctaagataggacttgtcaagtggagacatgggacctctctcctgaaaccatgaatttaaaattgtattctttacactaagaatcccaacaagtaaaagtcactaatacttacagttgagagtgtgcgtgtggggaaaatgttgctgccgttacttttgagacttagagcagctgctattgcaacctccagggtaccctactcccaccagtcttacttttactttacagtaactgtgaatgtcaaatcttgttttaggcacaaggaacaaagtttccctgccgcttacatctttccccccaagaaacacaaagggctttacaaacccacaaaggagcgttgcatagaaagagaacttggaccataccaagagtgattggtttaacactccacacatttccagtgaaattgggaaaggcatcttgcatgcctttccataaacctactaaatctccatctcttcaagtttccttagactctcttttactatggtttattccctaaattattgctactgtcagaaatcctgttagatatccagaaattcacttttgaggatattgtgtgctctgcagattttttttcttaaaaataaaacagagttcttttacatttgctgaggagagctttacttccaactatgtggtcaattttggaataggtgtggtgtggtgctgaaaaaaatgtatattctgttgatttggggtggagagttctgtagatgtctattaggtccccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatctttctccatccttttattttgagcctatgtgtgtctctgcacgtgagatgagtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacgtttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcctcagcaaatgtaaaagaacagaaattataacaaactatctctcagaccacagtgcaatcaaactagaactcaggattaagaatctcactcaaagccgctccactacatggaaactgaacaacctgctcctgaatgactactgggtacataacgaaatgaaggcagacataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaacaaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaacagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtggacttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattcatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaagcaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctgcaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaagtaggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccattattctcagtaaactatcgcaagaacaaaaaaccaaacaccgcatattctcactcataggtgggaattgaacaatgagatcacatggacacaggaaggggaatatcacactctggggactgtggtggggtcgggggagggaggagggatagcattgggagatatacctaatgatagatgacatgttagtgggtgcagcgcaccagcatggcacatgtatacatatgtaactaacctgcacaatgtgcacatgtaccctaaaacttaaagtataataaaaaaaaaaaaattaaaaaaaaaaattttttttttaaaaaataaataaataaaaaaaaaataaaacagagtgacttccatttccaccaaggtggagaaaccccattcctcctatgtcctccctcttacaactaaaataccctgggtataacacaacaaacaaaactgagtggtgggaagaaaaatgaagactgtcttggaacttgaagaacaagtggtcagctccctgggtttcctttttgcctctcacatatcccagacagggcactacagaagcctccaattcataactgccactaagcacagacaaaaaaacactctaagaaaagcctgtttcctgtatccaaaaaaaaaagaggtaaagggtcactttacagcagaaaactttttgaccatacttttcctactccagtgtaacaataacggaaaaagttttaccctccccaccagcctacagcttcagtgggacctacccagaagttaagattctattccatttcttccccccacaaaagcagacagcttgctcttaatccactactagagcattgttggcaggactgagcagacagctcatcgtctctcccccatctgtcagaagcagatggtgctcctattctcctgccagagtagtgtcaacccagtccagtggcaacctaagccaccacacccaccaagcagcaaggagaattaatggctcagtataaggtagggctaattgccagtagatttaaccccccaccatctcatgtcattgctgcccaatgggggtaagaggttgagcttccacccctacctagtatcaaaaagactgaacaaggaactgcatgtcaagactagtaagctcattatgttaagtgaattaagccaggcacagaaagacaaacttcacgtgtcctcacttatttgtgggagctaaaaatcaagacagttgaactaatggagatagagaatagaaggacagttaccagaggctggaaaggataatgaagggctgagaggagagtggggatggttaatgggtacaaaaaatagttagaagaataagacctagtatttaatcatacaacagagggactatagtcaataataatttaactgtacatttttaaataaccaaaagagtataagtggattgtaacacaaaggataaatgcctgaggggatggatacgccatgttccatgacatgattgtttcacattgcgtgcctgtatcaaagtacctcatgtaccccataaatatatacacctactgtgtacccacaaaaattaaaaataaaaattttaaagactagtaagggccagtcgcggtggctcatgcctgtaatcccagcactttgggaggccgaggcgggtggaccacctgaagtcagggattcgagaccagcctggccaacatggtgaaaccccgtctctactaaaaatacaaaaattagccgggcgtggtggcaggcacctgtaatcccagctgttcaggaggctgaggcaggagaattgcttgaacccgggaggtggcggttgcagtgagccaagattgcgccactgcactccagcctgggcaagagagcgagactccatctcaaaaagaaaaaaaattgtttaatttaaaataaaataaaataaaaataaggactttacttttccctcagcccctggtgctagggaggcccggtggaaagctgaacccccacacccacctgacagtaatgagactgaaagaggcagcgtgaagcaaggctagtcaccactcctattcccactgccctgatgtcagcaaggcccagtgaggaactgaaccaccacctccaatcagcatcagtgaggcttaacaaggtggtgaaaggtaaagctaattggcaatccgcttctccccctcccatcccctgatgccagcagggcctggcagggagctgaccttacacctccattcagaggcaacaaaatccagaagccttgtcagtcattgccccactttcacttggatagtatcagtgaggccaagggggtagccgaactttcactccacccatttgcaacaggaaagtgtgagtcagtgccccactttgttgccagggtcatgtcagcagggcacatcaggaagctgaacatacttggccctcacattatacctcacataggggtttcctgctttaaaaagattaaatagaatccagagtttcataatatataataatatccacaatttcaagattaaagttgaaactcactaatcagaaaagacaatccaatggacaccaacaccaagataaatcagattttatctgacaattataaaacagctgtagtaaaatccataataaaaattatctaacaagcaattacaaatcctcctgaaacacagaaatatatatataatctcagcaaagaaatagaagttataaaaataagcaaatagaaattatagaactgaaaattacaataactgcaattttaaaagttggcaaatgagctcaatagtagagtggagatagcagaaaacagaatccataaacttgaggacagatgaatacaattactttatctgaacaacaggaaaaaaaaagatcagagcctcagggaacccgtgggacaataacaaaagatctagtattcgtatcatcagtgtctaaaaggaggggagagagaaagaggttaggctttcttttttttttttttttttcattttttgtgtgttcatagttattcattgaagcattcttatgatggctactttaaaaatatttgtcatataattctatcatctctgtcatctcactgttggctgttggcttctactgattatcttttcttcattcagttcgacatattcttggttcttagtatgatgggtaacattttattgaaaccttaacatttttctattttgttttaatgttctcaatcttatttaaacccgctttagttaaagctttttgtgacactgtctggtaggcgtagaggggctgccacctcattactgcctggtagaagtggaagtgtaggtcccacacttggtctcctctgacacctgaaggataaagagcttctcgttactgctagattggggtaggacttccagctacctgtaactagctatctactgatagctatctactgattgatagctatctactgatagctatctactgattgatagctatctactgatagctagaccagttccaactgccggagtctagttatctgccaggggggatgaaagtgtcagctctcttcttggccttctctgataccacatcagcagggtaccttgttacagcctcatgaaggtggaattctaggctccccactcggcttttgttggttgtttgtgtgaatggggtggggccacaggttttttttctgtagtgtttgactaaagcggatattatcgaaaagttttctctcatgctgggttgctccttttttggtcctttggctcaagagagcaggattttgctagggcttttttttttttttttctgtctgttcttgttggcatttctaggttgctgacttcttcacttccaagtctgggatttatgaggcagaaagaaaaccaggagaacttattaccctgttgctccctgggtcccaatggtcagtccatttttctctgttcttcagattgagtaaactatattcatctgtctttgagtttgttgtttctatattttgtcatctccactctatattttagcccatttagcaagttggcttattttggtcattttaaattttagttatataatttctatttttatttttttaacttctatttttttgttttgtatttgttcattagtttcaagggaattcataattattgaagcagtttttgatgtctattttaaaacttctgtcaaatagctcaaaaatctgattcatccctgtattatatcagttgattttttgattcacattattactcctggttctcattatgatgcgtgatttttttattgtattctggacatttttaatattatgttaggagatttttgaccctacttacatcttctatttaagcactttttaagtacagtgtgtcagctctggcctacttctgtgggctgtaattccaatgacaattttgttttctaagcccttgcaatgcctctattctggtctgcttcatgctctggctctacttgagctcctgcttgactcctactggtgttacctatgggaacagaaggtgcttccatggaccatccagtttcactactagaaggtcaggaatactagacctgcgggacagagaaggttttctcttaactattctccagccacccagagcttgtgggctttccactccatctctgctagtgcctgcagaggaagaaattacctaattgggctcccttctgctgggtagagggacagcaggtacagattctgtatgagtctttgccactaggtggaggttcagaaatctcctagccggagatcattttctgtcattttttgccactctttggagggccaggaggcaccaaggcctgtgttgccttctgccattgggtaaatgtctgttggcagacgcctggcctggattatcttctgttgctaggtaaagggctaggagccactgcatctggggagagagggttgggaagcacctggccagctggcactgctgctgcaagagaagtgcctgccacccactggtgtggggcagaggatgggttagcctgctccggttccactgttgtattaatagttactttaagaagattgggtcccctgccactgggtaagggtttccctgctaagtccttgttgggctttcctttttccaatcctttggccagagacagcaggcttttatttttttcatttttgtctatgcatgttggtgattccaggttgcaggactcgctagcactgggatatatgagagacagagggaaaacccagggaactcaccgccatgtagtttctcaagttgtgatgtccctagccagtccactttctcttttccacttttcaaagcttttgtgattgtccattgaattgtttccagggtatttagttgtagttaaaaggaagaaggcatcttgtcccagaaccagaaccctgacttacatatattttcaattgtaataagtggcatcctattgtctttatgtttcttcaatgtgcttttttcacagaatatcatgtttttgagatccactcattttggtaaacatacatgtataatttattcattttaaatgctataaaatttgctcttatatgaatatgccacaagttatttattcattctcctgttggtggacaatgaggtttccatttctctctattacaaacaatgctgcagtaaatgttctcatacatgtctccttgtgcacatgtgagggagtttatttgggtctatatccagagtgaaattactaggtcccaggatatatacagcatgaactttgtcaaatattgcctaattgctctccaaaatcataccagtctatactcttgccaaaaatgtgtgagatgtttcattttgccacattttcaccaaaatttgtattaatgtagtcaactttattcagctcttttcctatgagtctgcttttgtgtcttctttatgaaatctttccctacactaaagtcataaaaatattcttcaatatgttttcaaatactttaaaaatgttttttctccaatttaggcctttagtctgtgtctgtgacttatttttgtgtgtggtctgataaaagaatcttattctactttttctaatatggatagccaattgctccaacaccattcattgaagagtcctttctttccccatttataatgccacttcaatcatgtttcacgttcccatagagtctaggttgactctgaagtttaaaaaaacccttaaaaaacccttaataaaacaaaaataaataaataatataaaaaagtaaaataataaataaaataaaataaaaataaccccccaaaatgagggttaagtacaatattgagtttaaaatgagaaactttttattacaggtaccccaaataaaaccttaaccttaaactaactttctactagtaaaggaactttgaggatcaggggtagggattaacactgattaagtacctgttaacattgattaagcacctatgatgtatcagatactgctggtcaatttactgccatggtcattttatttatcctttgcaataactttgagaaagaaattatgttattaccattttagaggtaagaatgctaaaactttgaaaggttaagttgcctaggccacacagcaggttggacagagcttaaattcaggtctgtctgattcaaaagagcttgattttgtcagtctactacactgcttccaaggaaagctcacagccctgaactgaggaagatgtgacttgcccactaggagtagaatatgtgttacaatgcactgttgtgcattgaatgaccaagtattctcagaatgactgctttacttgtttgcactcctgactagtgcaaaacatcagtctaagatgagctcctgcttcctctctcatcctcttctagtttatttatatctctatctcatatttcttcaacttgaggtacaaatttggttgtcagagactttcctgctaagctctaggtagcatgggggaagaaaaagtaaacaaggggtggttaagggagggctaaatcacttattcttgttaacaattttggattggatttcatatattaaaggaaccaaatgtaacgctgatgtgatatcagcccttgcattattttatcatgttatcacaattggatattaacttcttattaaactatcattttttcctcctttgaactcggtgctcattgctccctaagactgttatgaagaagttgtagtaagtggcaaaagcaagagatttggtatcagataacataagtttgagtcctaactctgcttttggctctgggatcctacacaagtgatattttcttccttgagcttcaggtttcttctctgtaaaatggacattaacatgagttaatgtgaggattaaataaaataacaattgcaaatttaccttgtaaaataatgtgcaaagggaggttcttattcatctgccattctctataatcatttctgttcttttcacatctataccaacagctccctgctagatgaccctgatgcagcaaccctaatgccattgttctcaaattcataagaatcacctaggacttgctttgtaaatacagatttcctggctctaccctcagattttattaatagatctgagttgaggcccagaaatctgtacttttaaaattctttccagacaattctttaaacacagccagatagaagacatactttgcctaaaacacttaccaccatatatacaaagaatttcttggccctgagtgggattcaaggttaaagcagcttacagtgagaggttataatccccagccttccctaatgttccaaactcctattccacctaggtcaaagaggacccagccacatgatatcttaacattcccttccactgctgtgattgcagctgcattgtgagtccctagaagcaaagcctagtaaattaaaccagcaattattgctgtttaaaatggtagtgattttaagagttttctttgaaaagtctgtcaataggagcagaagactatgaataacaccaaaatatttagctgtctattgaaatttctttacagtatcaaataaaatgggaacagatgcaactagaccagaacttggttagtaggtaacagatttattgggcttgctcattttaaaaattaaggttataaacaacacatgtcaaaaatcctataaaactgctgtggaaatcatcttcctggaaagccaaaatccctgctaatattctgaatttgcttttcagaactgaaaatggcattgtatacatctgccccactatttgaaacaatgtttccttgagacagagctcactctgccctgagtgtgcattcagtagctaccccaaagtttcaaatacctgctctcttcccagaatgtaatccatccaatcccttgagagaagacaaattctgtatttacaaatacaggtggagttgctatgagttacagttttctggaagttttcatatatagctcatgatttgaaagtaaaaggaagtcatatgacagtgaagtcaccaggtcttccatctatcctgaaggatagagagagacctgatgagaatctcaattggctgtttttctttttactgtcacatatgcaggtttcctgttgaatctctctggtccactgttccctctaatgaagtcatgttctgtgctcagggcagtaatatcttcagaagcagatgtctcccataaagcatgacttcattccttggaatgggaagagccagcagtagactgttgggctaatgggtggggagggctttatttaaaaatagttttctaaaataatgtgtttaactttttaatacatttctataaaaaggcaaattagtttgttgctgttttttgttgttgttgtttttgtttttgtttttgttaacctcactccgtacttccagaaggggcaaccactagaccagaaggaatggagtcctcgcagagcacaggcacttccatccagttgtttgtacagatgggtgaaaattaggattttccagatgctgaatctaggctctgtatcagaccccactgaatcacagcctagatttcaacaagcctttttataacagccctggagcttagaggaaataaactgaagtgcccaaggaaagttactgacccagatgctccagcaaattaggcaagtgggaatattgctagagaagggaagagtagagaaaaagggtggaccaattagaaggatgcagtttgaagtcaatccaaacttgctaaagagaatgggctttccaggctattcctgttcctttagaaaagtacatgtagggcagttcctgaacactgacttctcaaattattaggaataaccaagatgaatggcatcctgtactctctgacatcctatcatcagggcttacaggcactgcccatgtgttctagtgtgttactcacttctatttctgtctatgcagaaggtgatcactaaacaaggtccaaagagctaatttcctaaacatggagggcaaagaccttttccataaacaagatccataaacaaggaaacatgataaggtagttaccatctgagcttggtaccttcaatttgtaaatttaatcactacatccccataagaggtccatttcagttacagctatgcattaaaaatgaagatatgccaataattctgtaaatattgattgatggcagtaaatactgaaattaaatttcctttcccaactcccacattagtcaccttggccagcaaccggtcctcctccagataactctttaagcttcatctccaccataaagcctgatacagtttggctctgtgtccccacccaaatctcatcttgaattgtactcccataattcccacatgtgagtgggagataactgaatcatgggagcagtttcccccatactgttctcatgatagtgaataagtctcacaagatctaatagtttgataagggcaaacatgtttcgcttgactgtcattctttctcttgtctgctgccatgtgagacgtgcctttcaccttccaccatgattgtgaggcctccccggccacgtggacctgtaagtccattaaacctctttttcttcctagtctcaggtatgtctttatcagcaccatgaaatggactaatacagtaaactggtaccagcagaatggggtgttgctgaaaagatacccaaaaaagtggaagcaactttggaagtaggtaacaggcagaagttggaacagtttggagggctcagaagaagacaggaaaatgtgggaaagtttggaacttcctagagacgtgttgaatggttttgacaaaaatgctgatagtgatataaacaataaggtccaggctgaggtggtctcagatagagatgaggaacttgttgagaactggagcaaaggtgattcttgttatgttttagcaaagagactggcagcattttgtcccaccctagagatttatagaactttgaacttgtgagagatgatttagggtatctggtggaagaaatttctaggcagcaaatcactcaagaggtgacttgggtgctgttaaaagcatttagttttaaaagggaaacagagcataaaagtttggaaaattaacctgacaatgggatagaaaagaaaattccattttctgaggagaaattcaagccagctgcagaaatttgcataagtaatcagaagccaaatgttaatccccaagacaatggggaaaatgtctccagggcatctcagaggtcttcactgcagcccctcccatcacaggcctggaggcctaggagggaaaagtggtttcgtgggccaggcccagggtccctgtgctgtgtgcagcctagggacttggtgccctgcgtcccagccactctagcagtggctaaaaggagccaacatagagcttaggccatagcttcagaggttgcaagccccaagccatggcaacttccacttggttttgagcctgcaagtgtacagaagtcaagaattggggtttaggaacctccgcctagatttcagaagatgtatggaaatgcctggattcccaggcagaagtttgctgcaggggcaggatcctcatggagaacctctgctagggcaatgcagaagggaaaagaggggtcagagtccccatacagagtccttactggggcactgcctagtggagctgtgaaaagagggccaccatcctccagaccccagaatggtagatccactgactgcttgcaccatgcacctggaaaagccacagacactcaacaccagcccatgaaggcagctgagagggaagctgtaccgtgcaaagccacaggggtggagctgcccaagaccatgggaacccacttcttgcatcagctggatatgagacatggagtcaaaggagatcatttcggtactttaagatttgactgccctgctggatttcagacttgcatggggcctgtagcccctttgttccagccaattcctcccatttggaatggctgtatttacccaatgcctgtactgtacacttattgtatctaggaagtaactaacttgcttttggttttacaggctcataggcagaagggacttgccttgtctcagatgagactttggactgttgacttttgagttaatgctgaaatgagttaagactttggaggactgttgggaaggcatgattggttttgaaatgtgaggacatgtgatatgggagggatcaggggcagaatgatatggtttgtctttgtgtcctcacccaaatctcatcttgaattgtactcccataattcccatgttgtgggagggacctggtgggagataattgaatcatgggggcagtttcccccatactgttctcatggtagtgaataagtctcacaagatctgatggtttgataaggggaaacatgtgttgcttggctctcattctttctcttgtctgccaccatgtgagatgtgcctttcaccttccaccatgactgtgaggcctccccagccacgtggaactgtaagtccattaaacctctttttcttcccagtctcgggtatgtctttatcaacagtgtaaaaacagactaatacaaagccttcctagggcaacctcccagactttgtttcttatctccttgagtccatccttcctgtctcctccttctgtacctttgtctttcatccttcccacctctgatgcctctagagacaataacattggtgcctgaaataaaaataaatggaaaacagataagaagagattatgaacttttaaaaaatcattgtagctgagtggactgagaaaaataaactgaggtcgtgtatgagttgttgtctctcaagaaagtgtcacacactaggaataaccatattatttttaatgaaggatactggactttttttctaccagggagaaaaaagtcacccaatgatatcctagaaaaagggagttagggctaagtatagtggctcacgcctgtaatcccagtactttgggaggccaaggtgggtggatcacttgaggtcaggagttcaaaaccagcctggccaatatggtgaaaccccatctctactaaaaatacaaaaaaaattagctgggcacagtggcaggtgcctgtaatcccacctactcgggaggctgaggcaggagaattgcttcaacccaggaggcagaggttgcagtgagctgagatggcgccattgcactccagcctgggctacaagagtgagactctgtctcagagaaaaaaaaaaaaaaaggaaaaaaagaaaaagagaaaatgggagttaggcccaaatcgagatattacagaacaaaacagttcccatgttccttaaactgttacaaagcatagaaagagaaataattcctctcagttcatgttataaaattggtataaccttgataacaaactcttccaaagcagcaccagaaagacaactaaagatatctcacataaaaatcttaggtaactactagcaaatcaaaccatgcaatatatttatagtgtgtcatgaccaagtagggtttgtcctaggaatgcaaagattattcaataataggaaatctcttaatattatattatatcatcaactcaaaggatataaatcatttgatcacctcagatgtcacaaaggcatttaataaaaatctaacactctttcctgattattcttagtaaacgaggaataaaagggcattctctaatatgataaagaatatcttggcctaataaacagcatagtacttaatggtaaatatattagaggcatttctgctagaattgggaataagacaaagatgctcattgtaactgctgatgttcaacattattcttgaagttcttaccaatgtaatggggcaagaaattgaaataagagatatcactgttggggaattatacaaagtaccattatttacagatattgttctatagctagaaaacccaagagaatggattaaaaagatattataaatagcaatcaccgaggtggccaggtcttatattatctgtttgtagtacaaatatggtactagcatatcttgtgttcaaacaacatttataagttgaatataattgaaagaattaactgaaaaagaactttctacaggcagttaaatccttcaaggccatttcagaatcttgctgtgtcttgggataattattgtgaacaccaatttatattggataaagaggttcagttaattgagatttctgtttgcttgagtttgggacaaatgaagtttatatggttatagaattttgcaaaaagatgaatttgtctttattgagtgcctagagaatatcttacacttgcttttcatgttatcttgtataaacctcataacaactctataaggtaagtaatagtatccccattttataaatgagaatgtactcagagagatgaagcaatttgctcagtgtcatgcagcacttactaagtagtggagctgggcttgaatgcagttctgtgacttcaaagaccatgccttttccactagtgactttcaattatgtgttcaatttccctggaagagaaatgtatttcctgggacaaagttctgctgagtataatgtatagaggatggccaacacacagctaccaaaacagacactgcctttatggagaagggggtggcaataatgaaaatattaaaggcaagataaatacttaccatgttgaaggataatcccagaagaatccaggtagtatacccttcttggggaaaaaaattggattggctctttctaaatcaaagtattagcagcacctccatcctagggcaggcactaatgtaaatgactggagtacatacaaactgaacatcagaaatccttagtttgtcccatcagaagaagaatctagtgtgactcaggataagctccattcctgattaaagggacacaacatgcacaatagcacaatagctagccatcttgaactgttctgggacccaatctagagccatgttgcatatgtgtggttctcaatgtaatcgctgtttgtggtttggtttggctggccagctgccatggtagcactcctcctcagtgaagaggagccagccaaatggctgtcatcatatgcttctgggaacagcacattgatgccagccatttgggccccttcagcccattgatggggttaatctgccgacagtaagacagggtagctctgatgatttatgtcacatcccaaaagtagattcccttctgactcctatgttctgctgaacaaaaaggttggatgataaattgccagtgtagcctttactatgtttagtgagttaacacatctcaactactgaagcaatccatttgattcatgtgcatactgcttaaaataattttttgcatttccttagcacttcatactttccaaagctgtttttgcttctattatctcattaatcccaagagctggagatggaatactctggaatattcttaacctcagacttctgttgagcccaagtgaaggagaaatggtgttcagggcttgtcctagagtagtggttctcaaccttggtcacacattagactcccctgggaaggtttgaaaaatcctcatgcccaggtctgaccccacaccaattgcatcagaattcctagggctggggtccaagcattgagagtttttgaaactccacaggtgattacaatgtatagacagatgtgagaaccactaagaagataaattcaatctgaggcatgagagttcccggtaacaggaatgcgttcaagtggcaatgtcacagtggtattagagacacgggctgtatcattctccatgagggttgaagtcctggaacaaaatgtgctcatgaaagagtgtgtagataaagaaaagcaggggcctgaaaactaacttttgatattcatagtgttaaggtttctatctgtgttaacctagtttttttttcaaaggcaacatgatttcataatgaaaaaaaaaaacatgactaatcagaggcctttgtggaaggaactgtgcatatatctaaagggatcaatgggtgtaatttatttagactttcaaaaaatctctaactgacgttctgcagcaaaggttattatgctttaagttatgtcaccatgaaccatggaattagaggggccatcctatgaagagggcttgaatgcagggataaaggggagtgataaatgctgtttctggttttattaaacatttttgtatatagtctaggtgaaagagtttgcagtggaatctctaagtttgcagatgatgaatcatttagtccaaacacccattcaaagttctgccacttactagctgtgtgacccttgaaaagttacttaacctctcttgtcctgtttcctcaactgtaagataatggaattggacatgaacatctcagctagaaattctgtagattagcttaactcagctcccctctttgtgttgataatgaaaacaacacataatcaagttctttggttgattagggcaatgttagagagtgacaattatggggtcaaggaccagagaaagcaattgttatacagaattattcactatacagagttcattgtaaccagattgacaaagcactatttctgccagccatctgctggaacacaaaaatagctttgttatacaggaccgtcctttataattggatttaacctgtatgacagatttcttcaacaataaatttataaatccttgtatagcattttagacctgaggttcataaaattttggagtaagaggtcacctagtccatacctatatttggcaggaggagagagaaatgcagacaggtgaagtgattcgcccaaggtcagacagcaaataagtcatagagctgtatctctggacaactactccggttttcttctccctacactcagttctcaaagcagtcaggaatatagccatttgagtcccaggccagacctattttgaagctgtttggttagccctgccaggtaggtatgtggcttgataatgatggtgatagaaaatgaatgtgatgatgatagctgctatttattgagtgcctatatgtgctaggccttgtgttaagtactgtaaattatctaattcaatcctcctgacatcccttttgaggtagatattattgtcccaattttcataaatgaaaaaactgattgagaggtgaagtaacttgcccaaggttacatagctattgaatattattatagaactagaattcaaacccagttctgaaaagttaacaaagttcatgctgtttccacaaccccagtatttcccaaacagtacaatacagaacattaagtcaacaagagataggtatttctttaaaaagcttctataaccaaataagtttgggaaatgctgcatttcatatcccctttttgaagagtcacatttctaagtagtatattaaaggatatgagaaatcttcaatgaagaaatctgtttttccttaaccatgtgtttcccagactcttttttgaccaaggagccccatttccaataacatccgttgatgtcacacaggaccctggtgctctctagaacacagtgtgaaaaacactgcatgatctcccattcatctttctgattatcttcagagattgttacccttaggcctggctttctccatcctaaccactaaagtgaccaaagactaagtgttgcagaatacttatttagcaaagaaacacgcttatgactttgggaacatatttggtacctatacctcatgaaactttgagggaccattatgcttctgaaatgtcagtagttggtaggactcttttagtactgtcttaaccacagtaatattttttagtcttttccaaactaagccagaactgagccagagaagtttcacagctgatcataacttaagtttgtggagcctgaagccccagagatgggcccctgctgcaagggctagagaggaaatccttggatgaggaatgtaagccatctcgcctaagaaatacttgagattgggatgggatggggcgggatgaaaatcaacttgcaaacccctaccttttcttgcctttttgtcacgctttacagcagatgctgaaactgtaatctgggttctgaacatgggcattccatgtggttctcattcaaaattctcactcttctttgaagctaatggcttctatcttcttcatatatattgagcttgccacgcatatttgcacatttcctctgtttacaattctaatagtgtgagatagaagataaactcttaagatgccaagatttgaagatacaaactgtattgaagaatggttttctttttcttgaataaaatgtccattcctgtacctccctggttgctagccattgccttctctttattcctttactaactggtactgaataaatgttgacaatgtccagttctctggtattgttctcaacataaagggagaaaagcatgaaagctagaagcctgggccaggagcagtgactcacacctgtaatcccagagaggccaacgaaggaggattgcttgaggccaagatttcgagaccagcctgggcaacatagtgagaccctattgctacaaaaaatagttttaaaaagctagctgggtgtggtggcacatgtctgtagtcctagctacttgggaggctgaggcaggaggattgcgtgagcccaggaggttaaggctgcaatgggccatgattgtgccactgcactccagcctgagccacagagcaagaccatgtatcaggaaaaaaaggtgggggaaagctggagcctactacctgtataaccagagaacaaataaaattaaattaaaatttatgaatacctactctatgcacatgactttcatttatttaggccataaaataactataaattgatagaattatgcccattttacaaatggacagttttttgaaactattatcgttaatactttaagcttagcatgactgtgattcaatggaaggtacaatgagcttggagtcagaatcttggtttacttcccaggtttaccactttcttcgtcattcgtttgttcattcaacaaacatttttattgaacagctactataaaagaaatgctttaggagctggagatacagagatgagtaattcacagcccttgccctcaaggagttaacaatgtattaagtagaacgatcacatatcagaaaattataatttgataaatgcaacagtgtgttaatggaacacagaggaattagtgtctgacttttaaagttttaaaggatgtgtaggtattgagggaaagtgggactggagaagggcacttcaagcagagggaatggcatgaagaaaggtacagaggcaagaggtatgtgaaaggtgtggtggatgtagagccagggcttggagattcatgttgaactacatgccatgcagtgttgcttttaaactagtggatgttttataaatttatttttataattacagactatttttagaacagtttttgtatacaggaatattgaacagaaacagagagttcctgtatacaaagagttcctcttcccacccttggcaaccactgatctttttactatctctgtagtttttccttttccagactgccatatggttggaattatacagtatgtagcattttcaaactgacttctttcacttagcaatatgcatttaaggttcctctgtgtctttttctggattgatagcttatttatttttattgctgaataatattccattatatggatgtccacagtttatttaaccatttacctatgaaatgacatcttagttgcttccaatttgaggcaatgatgaataaagctgctataaacattggtatgaaggtttttgtgtggacataagttttcagcacatttgggtaaataaacacctaggagcacaatttatgggtcatatggtaagactatgtttagctttgtaagaaactgccaacctgacttccaaagtggctgtaacattttgcattcccaccagcaataagtgagagttctttttgttccatattctctcaagcatttaatgttgtcagtattttgaattttagcccttctaagagatgtttggtgctatctcattgttttaagttgcaattccctgatgacaatggtgttgagcatatttttctatgcttatttgccatctgtatatcttctttgttgaggtgtctatgcaagtcttttgcccatttcttaattggatcatttttttctgatttttgagttttctgttcagatctttgcccatttcttaattgggttaactgttttcttattgttataagagttctttatgtattttggataagtcctttatcagatacatgttttacaaatattttctcccagtctgtggcttgtctcttgattcacttcacagtatctttctcagaaatttttaattttaatgaagttcaacttatcagttttttttctttcacagattgtgcttttggtgttctatctaaaaatttattgccaagcccaaggtcatctagatttctcctatgttatcttataagagttttatggttttgtgctttgcatttggatctatgatccattttgagttaatttttgtcaaagttgtctagatttttttgtataaatgtccagttatcccagcaccatttgttgaaaaaaaaactatcccttctccattaggttgcctttgctcctttgtcaaaaatttattgactgtatttgtgtgggtctatttctgttccattaatttgtggtatttcacaaataccactgtcttgattactgtagctttatagtaagtattgaatcaagtagtgtcattcttcaactttgttgttattcttcaatattgtgttggctgttctgagtcttttgcctttccatataaactttagaatcagtttgttgatacccacaaggcaacttgctgagatcttgatattgtttggctgtgtccccacctaaatctcatcttgaattgtggttcccataatccatacatgttgtggaggggcctggtgggaagtaattgaatcataaaggcagttactcccatgctgttctggtgatgctgagtgagttctagtgagatctgatggttttatgaggggctttttcccctttgctcggcactcctttcgcctgcctccatgtaagacatgcctgttttgccttctgctatgatggtaagtttcctgaggcctccccaaccatgtggaactgtgggtcaattaaacctcttttctttataaattacccagtcttgggtatgtcttcatagcagcatgaaaatggactaatgcagatcttaattgggattgctatagacaaagttgggaaaaagtgacatcttaacaatattgagtcttcctatccacgaacattgatcatggataggaagacacaacattattaagatgtccattgatttagatctttattttctttcattgaagttttgtatttttcctcatatagatattcatattttgttagatttatacctaagtatttctctatatattatgttaatataaatagtgtttgtttttaatttctaaattccagttggtcactgctggtatgtaggaaagcaattgatttttatatattaggtgtgtatcctgcaaccttattataattgctacttagttctagaagatttttgttgattccttgggattttcacatagacaatcatgtaatctgtgaacaaagacagttttgtctcttacttctcaatctttatgcctcttatttcctgttcttgcctattgcatcagctagcatttccagtattatgttcagtaggagtggtgaatgggaacatccttgccttgttcccaatcttaaagggaaagcatctagttcctcaccattaaattagctgtatggtatatggatgtccaatattccaggatcataaatattctgaatgttatagatgttctctatcaaattgtggaagtgccctttgattcataattggctgagagtttttatcatgaagtgatgttgcattttgtcaaaaatccttttttggatctattgacatgatcatatgattcttctttaaccttttgatgagtaatgggattcaattgatttttgaatggttaaccagccttgcataccaggaataaatcccatttggttgtggtatataattattttaatacattgttggctttgattagctaatattttattgaggatttttgcatctatattcaagagatagcagtggtagttttcctttcttgtagtgcctctgtctgtttggtatatcagggtaatgctgacctcatagaatgaggtaggaagtgttccccctgcttctatttccttttttatataatttcaacttttattttagatttgggggtacatgtgcaggtttgctatatgggtatattgcacagtgctgatgtttggagtatagatgatctcatcacccaggtagtgcctctgattttagtttttgaaacagactgtagggaattagtatgatttcatctttcaatatttgattaaattcaccagtgaaaccactggggcctggtgctttcccttttggaaggttacaaattgtcaattcaatttttttattacatataggcctacacagattacctgtttctccttgtgtgagttatggtagattgtgtcttttaaggaattagcccattttacctaagtgatcaaatttgtgggcatagagttattcataatattcttttattgttcttttaatgtccatgggatcaatagtgatggcagcccctctgtcatttctgatattagtaaaatttgtgtcttctcactctttcttggtaggagtttgtcaatttttttgatctgggaaccagctttcaatttcattgattttctctattgctttcctgtttttactttcatttatttttgctctcatttttattacttcctttcttctgcttactttacatttaatttgttctttacttctagtttcttaaggtagaagcttagatattgattttatatctttctcctattctaatatatgtatccaatactataaatttccctctcagcactgcttttgctccatcccacaaattttgataggtttcattttaattgtcatcttgttcaaaatatatttttaattttccttgagacttttcctttgacccatgtcttatttagaagggtggatttgtttgtttgtttgggttttgttttgttttgttttgttttgttttgttttgttttgatgcggagtctcgctctgtctcccaggctggaatgtagtggctcagtcttggctcactgcaacgtccgcctcccaggttcaagtgattctcctgccttagcctccagagtagctgggattacaggcatgcaccaccatgcccagctaatttttgtatttttagtagagacagggtttcaccaggttggccaggctggtctcaaactcctgacctcaggtgatctgcccgtctcagcttcccgaagtgctacgattacagatatgagccactgcacccaacctagaagggtgtttttaaatcaccaagtagtttgggatttttccaactatcttgttattaatttttagtgtaattccattgtgatataagagcatactttgtatgatatctctttttaatttttaaggtgtgttttatggcacagaatatggtctgccttgttcagtgttccatgtgaatctgagaagaatgtgtatcctactattgttagatgaagtattctataaacgtcagttagatctagttgattgatggtactattcagctcaactatattgtcactgattttctgcctgctagatctggcaattactgaggacatattgaagtctccaactaatagtagattcctctatttctccttgcagttattttgccttatgtattttgatgttctgttgtcaggcacgcatacattaaagattgttatgttttcctggagtactgactcttttttatcataatgtaatacccatctttttccctaatcattttccttgctctgaagtcggctttgtctgaaattaatacagctatcccagccttcttttgattaggagttagcatgatatatctttctccatccctatactttaatctacctgtgtctttatatttaaagtggatttttttatagacaacatatagttgggtcttgtttcttcattcactctggcagtctttatcttttaactggtgtgttcagagcattcacatttaaattgattattgatatagctggattaatatctatcattgtattagtctgttttcacactgctgataaagacatacccgagactgggtaatttataaagaaaaaaggtttaatggacctacagttccacatggctaaggaggcctcatgatcatggtggaaggcaaacggcacgtgttacatgatgtcaaacaagagagaatgagagccaagcaaaaaggggtttctccttataaaaccatcagatctcgtgagacttattcactaccacgagaacagtgtggaggaaactgcctccatgactcagttatctctaccgggtccctcccacaacatgtgggaattatgggagctacaattcaagatgagatttggattggggacgcagccaaactatatcaaccatatttgtaattattttctatttgttgccatttttctttgtttcttttttttggcttccactttttctgccttccctgattttaattaagcattttatatgattccattttctcttctctcagcatgtcaattacactttgtttaaagaaaagtttagtggttaccctacagtttgatacatacatttgcaactaatccaagtccattttgaaataacactatactacttctcccaatccttccctttcatcccttaaaatactgctgtgatttgtttcacatatccacatactacaatcacagaaagcatttttgcattttcgctttttttttttttttggagacagggtctcactctgtcacccaagctggagcgtagtggaatgatctcggctcactgcaacctctgcctcccgggttcaagcaattctcgtgcctcagcctcccgagtagctgggactacaggcatgagccaccatgcctggctaatttttgtatttttggtagagacagggtttcaccatgttggccaggctggttattattttgaacaaactgttatctagtaaatctattaagaacaagtaaaatgttttattttaccgtcatttatttgttatctaatgtgctttccttctttatgtagatctaagtttctgacctatgtcatttgccctcaccgaagaacttctgttaacatttcttgcaaggccgatctactagcaacaagctccttcttttttgtttgtctgaggaagtctttatttctccttcattttgaaggatggtttcactggatacaaaattctagcttgctattttgtatgattgatcctcatcggaaccctgggctttgagtagagacagagtatgtagtgtcccctaatttagcagttgaagaaccagaagaaaagtcacttgccctatggtcattttgtggttgagtaagcactagaatctggctagacctgctgctgctggcctccatggccctgattccatcacaagatccccttttcttattgtcagataggcaaactacctgcccatattgatcaaaatttgtccaatcccaattttactcctatcaaagcagtcccccgtactgcatagctatatgtccccctctgatgcaggtgggttttgtcgaaagaaaacatatggttacaaatagggggaattggaatgatataaaaatgtagcttattacactagaaatagatatgtaatagtgatagtgctctgaataggtatgaataaggttctgaagcatatagagaaaacaaatagatgtatctaaaagattatagaactcatcagggattactgcttttgctctgagtcaagatgctcgcgtctagtatgggacagctctagctccctgacattttctctctagaagctgcaactacagtagcctcaagtgaaagcagtgaacatggtagagacagagccaaatcttaaaggtccgtgttgaaaataataagaattacttactggtcatggtgagctatcttagaacaagaagaaactcctatactgctgaaatgatgtacttattagcacttgtgggaaatgtgatactgtctaatgacaatcttgtgaatacttttacatctttgttttttcccaagggatatgccaaatgttcactaagcaggagctctctgagagcccttctatgacccaaactatagtggaagaagactttgtgagccccgagcccagcaaagctgccttacggaaaagcagccagactgttttccacgtggatctgtgtccctgctattcctcactgagcaaggcctcccgacctgagaccccagccaccccaccgctacctgggctcttgggccagtagcagctctgcacctccctgggacagagctcccagtggaagcaggcaggcctgccacttttgctgcttcacagctccctcctctaatgccctcaggctcaggagagagcaaggtgattaaggactatcatggacctccagcacagtgcagatgccttacagaaaagcagccagactgttttccatgcaggtctctgaccttgttactcctcactgggcaacgcctctccacctgggcccccagcacaaccaccctgcccctgcctgaacacttgtcagtggtggctctgcatttctctgggaaaagaaatcccagagacaacctacagcccctctcccattgcagctgcagcggtatcgcccttactgcccatgggctggggaaggaacaaagggcctggttgtgtcactgtacctccagcacactgcagcaaccacagggagaagagcacagtagctcttccctgtgagtccttaccccctacacttcaccagatagggcccccaacttgggatctcagagtagctgccccaaccctgactgagcattcccgctggtagtggctgtgttcccctgaggtggaacttatgaggaaactgacagcccctctgccactgccactgcagtggttctgctcttgctgccttcagactgaggaagaaacaaagagcctaagggctttacttatacttccagcacaccacagttgccatatggaaaggagcccagtctctcttcccagtgagcctctgaccccctgctcttcaccaagcagggccccagctcaggcccatagtgcagctgccccaccctctggctgaacattcccattggcagcagctctgcatttctctggggtggagctcccagagacgactgaaagcccttctgccactgccactgcattgatactgcccttgctgctctctgactggaaaaggaactaagatcctgagtgctttactcacacctccagcataccacagctgccctaaggagaagaggccagtctgtcttcccctacaatacccctgcctccctactcattaccaggcagggtgccctggcttgggcccacggcacagctgccctaccccaggctgattgctccaatcggtagtggctctatatttatctggggtggagctccaagatacaagtggcaggccctctgccattgccactgccaaggtcctggccctttcagtccccaagctggggagggaacataatgcctgagcacagcccaggagtgccaagtggagagctgagagctgagatctacagccagcactcatgtaggaagggagcccacaccctcagatcactgagagggagcacagctgaagacacaaggaaatacagaggaaccacatggctgggcaagagcctgcctactggccattatgcctaagtgctatctactggatcacagctcaaatttcaacaacaaaaatactttgctagcgtaccccccgataaaatcaaggacaagagttcagctacaaatgaagacctagcgcaaagcctcagccctctgatacatccaaaaacaaagtcaactgaccataactgaaattataccacagttaaaggaacatcagcccacgcagatgagaaagaaccagcatgagaactctggcaattcaaaaagccagagttctccttacatccaaatgaatgtaccggtatccagcaagagttcttagccaggctgaaatggctggaatgatagtcataaaattcagaataagattcaggagaaagtcaaaacccaatccaaggaatctaaggactacaataaaatgatacaggagctgaaagatgaaatagacattttaagaaagaaccaaactgatgtgatagaactgcaaaatacactataaaaatctcataatgcaattgcaagtattaccagcagaatagactaagctaaggaagaacctcagatctcacagactggttctccaaactaaatcagtcagacaaaaataaagaaaaaaagaattttaaaagaacgagcaaaacctctgagaaatagggaattatgtaaagacatcaaatctaacactcattggcatctcttgaaagagagggagggaatacgagcaacttggaaaacctacttgaggatattatccatgaaaatttccccaaactcgctagagaggccaacattcaaagccaggaaatgcagaaaacccctatgagatactgtacaagacaaccatccccaagacacatagtcatcagattctccaaggtcaacatgaaagaacaagtattaaaggcatctagagagaaggggcaggctacctacaaaggtaaccccatcaggctaacagtggacctttcagcagaaaccctacaagccaaaagagattgggagcctatattcagcattcttaaagaaaagaaactccggccaggcacagtggctcacgtctgtaatctcagcgctttgggaggccaacgcgggtggatcacctgaggtcaggagtttgagaccaccctggccaacatggcaaaactctgtctctactaaaaatacaaaaattagtcgggcatggtggtgcatgcctgtaatcccagctactcgggaggctgaggcaggagaatcacttgaacccaggaggcggaggttgcagtgagccgagatcacgcctttgcactccagcctgggcaacagagtgagactccatctaaacaacaataaaaaaaagaaactccaaccaagaatttcatgtccagccaaactaagcttcataagcagaggagaaataagatccttttcaggcaagcaaatgctaaggaaattcattaccaccagaccttacaagaggtccttaagggagtggtaaatatggaaatgaaagaccattactggctaccacaaaagcacaattaggtacatagaccattgacactataaagcaactatacaatcaagtctacataataaccagctaacaacacaatgacaagatcaaatttgcacatatcaatattacccttgaatgtaaatgggacaaatgcaccaattaaaagtcacatagtggcaagttggataaagaagcaagacccaacttctttcttcaagagacccatctcacatacagtgacactcataggcccaaagtaaagggatggagaaaatctgccaagcaaatggagaaagaaaaaaaaaaacaaaaaaaaacagggattgctattttaacttcagacaaaacagcctttaaaccaacaacaattttaaaagacaaagaagggcattacataatggtaaatggttcaattcaacaagaagacctagctatcctaaatatatatgtacccaacacaggagtacccacatttataaaacaagctctgagagacctacagagagacttagataaccgtacagtaatagtgggagacttcaacaccccactgacagtattagaaagatcattgaggcagaaaactaatatagatatttcagacctgaacttgatacttgaccaaatgagcctaacagacatctacagaactctctaccaattaaaaaaaaacccagaatatacattcttcttatctgcacatagcatatgctctaaaattgaccacacaattggccataaaacaattctcagcaaattaaaaaagaaaaacagaaatcataccaaccacactgtcaaaccacagcacaataaaaatagaaatcaataccaagaagatcactcaaaaccatacaaataacctgctcctgaatgacttctgggaaaataatgaaattaagcagaaaccaagaaattctttgaaactaatgaaaacaaagatacaacttaccagaatctctcgggcactgctaaagcagtgctaagtactagatgcccacatcaaaaagttagaaagatctcagattaacaacctaacatcacactttgaggaactagaaaaacaagagcaaaccaaccccatactagcggaagacaagaaataaccaaaatcaaagctgaactgaatgtatttgagatgtgaaaaaacatacaaaagatcaatgaaatcatacttggttttttgaaagaataaataagatagaccactagctagagtaataaagaaaaaaagagagaagatcaaaataaacacagtcagaaatgacaaaaggggcattaccatcaatacaacagaaatgcaaaaaaaaaaatcagagactatcaaaaacacctctatgcacacaaactagaaaacctagaagaaactgataaattcctggaaacatacaacctcctgagactgagccaggaagaaattgaatccctgaacagaccaataatgagctccaaaattgactcagtaataaatagcctgctaagaaactaaaaagcacaggaccaggtggattcacagccaaattctaccagatgtacatagaagagttggtaccattcctactgaacctattccaaaaagttgaggaggaggggcttccccctaactcactctgaggccagcatcatcctgctaccaaaacttggcagagacaaaaaaaacttcaggccaatatccttgttgaacataaaagcaaaaatcctcaacacaatactagcaaactgaatctagcagcacctcaaaaaagctaagccaccacaatcaagtaggctttatccctggaatgcaaggtttgttcaatgtacgtaaatcaataaaaattattcaccacctaaacaaaactaaaaacaacaaccacataatcatctcaatagatgcagaaaaggctttcaagaaaatacagcaccacttcatgttaaaaatcctcaacaaactaggcattgaaggaacgtactttaaaataataagagccatttatgacaaacccacagccaacatcatactgaatgggcaaaagctggaagcattcttattgagaaccagaacaagacaaggatgccctctctcaccactcccattcaacacagtattggaactactagccacagcaatcgagcaagagaaagaaataaaaggcatccaaataggaagagaagaagtcaaactatccctctttgcagacaatatgattctatacctagaaaacccccatagtctctgcccaaaagctccttgatctgataaacaactccagcaagtttcaggatataaaatcaatgtacaaaaattagtagcattcctatacaccagcaacatccaagctgagagccaaaacaagaatgcagtcccattcacaacagcccaaaaagaataaaatacctaggaatacagctaaacaaggggtgaaagacctctacactgagaattacaaagcactgctcacagaaatcagagatgacacaaacaaatggaaaaaacattccatgtttatgcgtcagaagaatcaatattgtcaaaatggtcataatacccaaagaaatttacagattcaatgctattgttatcaaactaccaatgacattcttcacaaaactagaaaaaactattttaaaattcatatggaaccaaaaaagagcctgaatagccaaggcaatccaaagcaagtagaacaaagctggaggcatcatattacctgacttcaaactatatgttaaggctgcaatacccaaaacagtatggtacagatcgaacaatggaatagaataggtagcccagaaataatgtcacacacctatgaccatctgatctttgacaaaattaacaaaaacaaacgatctagaaaggacttactattcaataaatggtgctgggatagctggctagccataagcagagataattgaaactgggccccttccttacaccatatacaaaaattaactcaaggtggattaaatccttaaatttaaaacccaaaactataaaaacccttgaggaaaatctaggaaataccattctagacatagaccctggaaaaaaatttatgacagagacatgaaaagcaattgcaacaaaaacaaaaattgacaaatgggacctaattaaactaaagagctcctgcatagcaaaacagcaaaagaagctatcaacagagtaaacagacaacccaaagaatggagaaaatatttgcaaacaatgtatctgacaaagatatatccagtatctataagaaacttaaacaaatatacaagcaaaaaaacaagcaaccccattaaagagtgggcaaaggacataaacagacacttttcaaaagaagacatatacatgagcagtaagcacatgaaaaaatgctcagcatcactgatcattagagaaatataaatcaaaactaaatgagataccatctcacaccagtcagaatggctattactaaaaaaatcaaaaaataagagatgctggtgaaattgtggagaaaaaggaacacttatatacttctggtgggagtgtaaattagtccagccattgtggaaagcagtgcggtgattcctcaaagaacttaaagcagaattagcatgcaacccagcaatctcattattgggtatatacacaaaagaatataaattgttctaccataaagacacatgcacatgtatgttcatggcagcactcttcacaatagcaaagatgtggaatcagcctagatgaccatcaacggtagactggataaagaaaatgtacgtacatgtcatggaatactatgcagcacagtagactggataaagaaaatgtacatacatgtcatggaataatatgcagccataaaaaagaatgagatcatgttctttgcagcaacatggatggacctggaggctgtaatcccaagcaaactaatgcagggacagaaaaccaaatgctacatcttctcacttataagtgggagctacacattgaatacatatggacacaaagaggggaacaatagacaccagggccttcttgcgagtggagagtgggaggagggtgaagatcaaaaaactacttattgggtactacgtttattacctgggtgatgaaataatatatacaccaaacccctgtgacacacagtttatctataggaccaacctgcacatgtaccccagaaactaaaataaaagtttaagaaatgactttgagccctgtttctgttggtactcttcatgtcatgggcattttagggaaaaaatataaaaattttagttaactctttgtcttacactgtatgccaaaatctataccagattaattgtagatttaaaaataaaaatgaaaccataaaagaactagaaaatatataaagagttacctataatatcacattagggaaggcctaagtaagcatgacactgaaggcagtaaccatataggaaaagattattaggtttaactacatgtaaggaaagcttttcacaccctttgacccaacagtgtcatttctaatgacacatcctaaaaaacctttggacaagtgtataaaaatgtacatatgtggggccgggtgcagtggctcacgcctgtaatcccagcactttgggaggccgaggcaggcggatcacgaggtcaggagatagagaccatcctggctaacacagtgaaaccccatctctactaaaaaaatacaaaaaattagccgggcgtggtggcgggtgcctgtagtcccagctactcgggaggctgagacaggagaatggcgtgaacccgggaggcagagtttgcagtgagccaagatcgcaccactacactccagcctgcgcgacagagcgagactccgtctcaaaaaaaaaaaaaaagtacatcattgtttataaatgtacataacatataaattgtttataaatgtacatataaattgtttataaaatgtacatataaattgcttataaacatacattgtttataaatgtacatcattgtttataatagtgaaaaactggacccaatctaaatatttatcaaagatgattaaacgctgatgcatccatattaaaaattacaatgtaaaaatgtagttattgacataaaaaaggttatcaaatgacatttttcatctgatcccattttgtaaaaatacctatttatatacatagaagacttctagatgtgcatgaaatgttagtagtgattatttgggggtgctttaataagctctttttccttttgctcctcttttgtatgtatatacgtatgtatgcatgcgtttatgtatgtgtaaggagtaggtatattttgtatgaaaataatagaagcttaaaaagattttaaaatttccatttctctcttttcacttgtggatttaagtcagaccttctccaggaagctatttgttccccttaagtggccagtataattcctgaagccactccctcatcttttgtatttccctattcaactgtaagttcttgaaggtagagttgtgagttgcgtttcattatttactgccttccatacacatactctgtaaggactggttggctggtgatggcctgatttcttcaaagtctgcttttgaagtctgatataacagtgcttacccttaaccagctgaaacggtcaaaaacttggtccgggccagcacacctttgcaaagagggcagggtagccataatggctgtcttcctactactctcctaggctgtggtggctagctggctgatagagctgagccctttctgtgtaaatctttccccaaacagctttcttgttcaagaaaaaggcgtttctcaggttgagtcgctgcctcatatcattaatgtctatgtagttgtgctttcctctcagaacttccaagcacattttcaagaactcgcaatgctgttaaaaaaaaaattcataaaggatgggtaacaaagaaagaagacaaagaactgggaggagaggagaggagaagagagaaggaaaagagaattgagattcatgaccttaagtacagcaggttgctccaatctaaaacatcccctggacataacaatagctactgttgcacatgaaattactttgccagaaaagtctacacagacattggtttttcaagggacctgtgaaagctctgatggccactctggcagccctccaggttagagactttactgatctctaatagggcctgctcttatagttagagatcattccacgtttgttgcaaatatcaaatgagatgataaatggaaatatgttttataaactataatattgaaatgcttggtgttccttttgtaagctcttgagggcactgacagtggtttaatgtataactgtgtcttcatggcagtttggaacagattttaaatacctgtatttaaagaaagtcaaatccgtatacagaatgaagagaatttatttcctagaagggaaaaaaaaaatgactgtctgggagcgacctaaactgtttggggagttgcggtcacctaactatgttagaaacaccttgggttttctaagtaccttcaattgattagaattattttccttagaagtaatttccaataaaatgcttgtgatttcactgccaatgaaatggttgacatgtcttattttattttattttattttattttatttatttatttatttttgagatggagtctcgctctgtcacccaggctggagtgtagagcgtgatcttggttcactgcaagctccacctcccaggttcacgccattctcctggctcagccttccaagtagctgggactacaggcgcccaccaccacgcccagctaattttttgtgtttttagtagagacgaggtttcactgtgttagccaggatggtcttgatctcctgacctcgtgatccacccgcctcggcctcccaaagtgctgggattacaggtgtgagccaccacccccggccgacatttcttttaaagtgtccattaacttatagtaaattacaatggaaatgcatgtggccctcaagagtgtattatggtcaaacttttaataagtaacaaattaaatcatgataaggaagtgactaaaagttaaacactgctgctctgctctttccatgaaaatgaccctttgctccttccaagttcaacacgagacttcatatcagattctcacctgaacgcatgactcttcaacctcaggacttgcagaattaatggaatgctgtcctaaggttgttgagttgtgcatttctgggcatttcatctctatggggaagtacccattccctcaccccaaagactgaagtagagagatttttctccctagggaagaatcttccttgaaacttttgtggcctcaggagtcagaagacagaatggggaggtttgatagttggatccttgccaaaagcctgacccttggctgtgagactccctcaaatttgcagtgtcttggggatccctcctagtgactatcttagaaaataaacattttctgttcatttccaatgacttaattatctattttatttttcttataggcccagttaaaaacaagaaaaagggtaagttcctgactttataaaattgctgtcttgtcatatattttctaaagttagaagaaaaaaatcaagagtgcgatttttgtattatattctttcagcattgtctgtctgttattttattcaatcatatgttatcttcttgagtattgtagtttctgaagaacaagaaatcattcttcagtgatgattcacctctttcattcttccttgttcttctccctgcccttctttttattcttttttttttttttttttttttttttttgagacggagtttcactcttgttgcccaggctggaatgtaatgatgcaatcttagctcactgaaacctccacctttggggttcaagcgattctcttgcctcagcctcctgagtagctgggattacaggcactcgcttttatcctttttttcctcctttatcaaatcagtgattgagtgtgaatgaaatcctgtgtcaccatgtaggaactagatacgctacctatcaaaagatgtcagtaccctatttcttggacttaaagcttccctgatttgatttcccaaagagtcagggaaggtatttcttgctttgaggattcaatatcattttctctgtaatgaaaaagctattctggagtagtaccctgaccatttagtcttttcaaagcagcttccattgtgccgttgttgggtcagtaagtccccagtgtacttgcaatgaaactggccctagggcatctacaagtgctcacttactaaaagaggagaatcaatccaaagacagaacagtctccaaagacagggccaggcaatatggtctacttcttaggactgaaagaaccaattatgaaactagttaaagcacctgtttgtttctgggttctgacctgggaggaagacagagtaaaactaatgattgttcattaaaatgctttaagtgaaatgatgctgtgtgataagatttatggagctttatagaatagattgtcaaccccggactaggccaaaaagactggcttcagctgcagtctgccacttctttgaacactagggtactctggtgccttgaggtatcatagtccacatggaaaagttgtgtgcctgttgtaaagaagctgaggaatggcctggcctcctgagggcctgaactgagcaaggctggaaaacagccagggagctggagtcagtgaggaaacctttccctgtggggcctgggcacttaccaccaagatattctgtcttttaagaaagtagatttgattttcaaacatgtagttcttaactcttgtcatatccctttaaaacagaaattataactcagatcattgcctggcactgctaccttgtgtacgggacattattgagaagacagtgcacataggctttaaacatttactttggctgaaagttatttagaagccatttaatatggatttccttggacatggtgaataggcacatgcttgaagaggtaaattgaattgttctcttaattttcaccctttaatggaattttcctccttccacaactctctctcactcactcattcactcacttttggttgttctttgattttgggcttagctaaaaggttaaggaaatactcctttgatgaagtttagctttgaaaggaatgtgtatattctttcatctaacactacatagggtatgtttctaagtacaaacgtctctgggcttttatatcatgaggtgttctgttaaagtaaggaaatcgagagaagggagtcaatcctctgaagttatcctcttgctccaggggtcattttgtacattctcttctctgggcccaactttgtgtaagtatgcaagtgtgagaagctcacttgcctaacccttgttgcagagaagcagaggaccagctgcagaactggaacaaagcaggagtttttttttttctcaaatgccttctaacattttcataagtgaacattctctgttttcactgcaaccattagtctcttggactggaggagtttctggctctaattcttccaaaattacattagcaattacaggagactcacattcttgaaggtgaagtttgtgctacccacagaacaccctctagcttgaaaatcactgttaggcttggaaatcttggaacacaggacagcctaatatgcaccaacttctgtgtctgtgccacctagaaaataaggagggagaagcaaaccttacaaccaggctaagaaagcttcctgactgcaaggggtaagccacccctccttatagaaactcagtctcatgaggaaacagagaaatcattgaggccaagctccttgtttcacagatgtagaaactaaggctcaaggagaggaagggatttgcccaaagtgtgtctgtggcagagctggggcttacatccttatctcctgagtacagattttgtgttctttccactacactagctggaattgaaacttgggctctgaataagcctgatttggaagctgcccaaatctgaaaggagatggttttcctgttcagcatcttgaaattggctagatctagaaacggggcagatccaatcttttgctgctaagtgcagagaaacctctaaagctcatgcctctaggtctttaaggctacagggactcttctgggagagatgttctctggaccttcctttccttcctttctgaggaagagaccccacgatgaccccatggtttcattccaaatgcagatgtggttagacatagacaaatggcctcttgagtggcattgccatgaggattgggtttcttggccatgaggcattgttcttaagggaggacctgataaatcaggacaagattctcctgcctaagtgtctggggagcaagaagtcagagtcagtaagaaggtttttagtgagactagagaaggttgtatttaaaactaagaaactacctcaggtgaagacattgtgatgaagtctggaaacaggcttccattcctgaaactttccataaaattgtgagaaggtggtgaaggaaggaagaagacctgtgcctacatgtagtctttgagtggagctgcacagagcagaggaagtcaacaggaagagctggaggttttggttcaagaccacagttatgactcatttaagataactacatcctggtgggaatgttgaaaggactggaatatgaaataggagggtcgagattgttctagaaggatagcaaggaggaaagggggaagagttggtgggcatgattaataatacatttgagaatgggacttctgaggaaagactttgggaagctggattatttagcctatagaaataggggttggtgggtaacttaatttcttttcatatataaggattattatgtatatgtatattcttctctgtctacacaaatagaataagagcttaaactgccacaagagggacatcatttaatataccagagaacttcctaacagtgagcagtgaggggcaataaacattggaacatgttactatggagtttgcagaatttcctttcccagagatcttttaaaatagagtttacagaggtcagctgagagagtgaaacttgctgcctcctcctcagctccctctactctctgtctctgcttctttcctgtttctcaatatctctctctctccctcctcctctttccgtgcccctcttcctccttctccattcccccatctccaaaactccttcccattcctcattcccgactagcactgtccccatcccaacccccatttcctgtacatcctgactcctggaggaaccttcctggagctgatactgttcctaaggccaggctgtacggcttcctcttgttatcgacatcaagtccaccaaactgggcagtaaacataaaagctccacattcttcaacaatagccctttctaaaaagaaccacaaagtgacccataggtctaatcacttggtagagaaattctcatcctttggactcagctgaaatgtaacctcctttttgaaaccttctctgacctcttcagcatttggtccctacccactaaggtagcacttctactatcccatgactgtgtctgtttccccacagacacagactgatctcctggagggccacttatttctatatgctcaaacctagctttgtaaatgcatattcacaaaagggagtggggggaggggagagaaagcataagacagacggagacagggagacagagatgtgtgataaaggtatccaactctttagcagggcctcccagagagctgactttgtgtcctcagaagtctgtagaactcctgacagtacactcatcacaggaaataactacaaatgtaacactgaggccaggcgcggtggctcacgcctgtaatcccagcattttgggaggctgaggcaggcagatcacccgaagtcaggagtttgagaccaacctggccgacatggtgaaaccccgtctctactaaaaatacaaaaattagcaggtcgcggtggcacgcgcctgtaatcccagttactccagaggctgaggcaggagaatcgcttgaacccgggaggtggaggttgcagtgagccgagatcgtgccactgaactccagcctgggcaacagagcaggactccgtctcaaaaaaaaaagtaacactgaatcctatttttcaggaaagaaagcaggacctcctggacccaatggccctccaggacccccaggacctccaggaccccagggacccccaggaattccagggattcctggaattccaggaacaactgttatgggaccacctggtcctccaggtcctcctggtcctcaaggaccccctggcctccagggaccttctggtgagttcccctgtctctccaccccaccaggtgcctttaaagtactttaggagagcaggagtgggtgatcctgagagcagtttcaaacggtggagatggggttggtgtgcaataagggatgcagatctcctagcccagtgtaaaactaggaattggacaagccagtagggcctggcctgctctagcttcttatatctaccaaactgtcaaggacaggccacctgttcttgccccatctcaacccttctgttacaagccctccctgactcttggcctccctgtagtggaccagtaaaactcatatgagccagagacagaggccctggtggttcacaggagttccagtggggaatagatgtaatcttctgtgattcccagcatctagctccacatgctgatgtttgcatagaaataggctatggagtagaaagttgaggactgaacaaaatgacaagccctaggatagtttcatcttgtgaagtctgaagtgcttttcccatagcaagtagtcactaatggtcaagaagttagaaacttaagagtcactcaggctgtggatgaagcaaacccaggcaccaaggctgtcctgtccgggaaccaagtgcttcttgcactagatccttaccctaccacacttgccattcaaatgtcatttcatccctttgcatctttctccttaagccctgaagggcatccgaaaggtatgaatgcagatccaaacctgcctaattggagttgacaagagtcagactgcctgggctaatgtcagttgttatttctttctcctgctcctcactcccctgccctgtatcttggggctttaaagaaatggacccttacagctgatttctccaggggcaagaattctgcagcaggattcagattctttaacttgtacttcacacagggctcagcagtgttaccatggccacaagagatggagttagagattttttttcaaccaatcattccttaaatattgagcactttctgtatacaaagagatatattgatacatggtcccttttcttatagagtttatctcctagaggaagagagaacaaagaaacaagatatttacaaatagcagtgggctctatgaagaaaattaatagaaagggagcaaaacactagagaagccaatgccattgcctcagggtcacacagtgatgggaatgctctctcattgttctccatgggtgcccggtggggcttgccttgggctaatattggccagaggcaatactcagaagtttccctgctgggtgctgggcccactgaagatgaaggtcagggcaggaaacagaaggggtgcactctgactcttcctccagctctgagccctggagaataaagctcagacagggctggctgcagggagcatggctcaccaccactagctgctcaggtgaggggaaaaggaagtcaaaagattatgccctctgattgtcctatcctattttgcaggtgctgctgataaagctggaactcgagaaaaccaggttggctggggattgctctcttcctgggtaggagggaaagccacaggctagagccacctttaaattagcttcttattagatttcctgaggctttatttcatgagaacaccccggagattctgacggttttcactcacagccccctcccatctctatgaatagaaaagctttgccccagggcatgtttttagctaaggaaagggtgtcttgccaggatcatttttcctcattccacaggagaccccaggttcaccatagccaggcccagtagtcagctgaaataagctgccagtcagacctattcacctgagcctccaactccccaaccaccccagacaccttgccggctctcagaccacctgggatccggagctgaagagttgaagagtatgtccttgaaaaacagccaaccagctccaggcccagcctagcctgggcgtctgccttaatggcctgaagagctcctcccagtctttgagcttcctaatctgtctctattggcaggttctactgccttgccttgtctcatctcagcctcccttgctacagctgtgtggccacagtgataaatctacacagctgcacagtgcttgacggcttgcagggcaattttatatccatcacctcatttgatcttcagacatccctgtgagagaggccagacattcttataatccccattttacagttagggaaatgaggctcagaggcattacatttggttgaggtcacatagctaggaagcggtagagctacaaaatcatattaccctctagtagaaatgtagtcagtaacatcccaagacaggggagagggatcagaattggattacaatagaagactagaaaccaggatggaaacatgggactggtggctgagcaagcagccattactcatagtgactactctctatccttctcatcctgccagccagctgtggtgcatctacagggccaagggtcagcaattcaagtcaagaatggtaagaatcaaaataggctctctcccaaagaggagcttctcccctgcctcctccccagcctccaaataatcacccagcctagttcctcccaggccgctgaggtaccgttggcatacgaagtcattctttgctccatcatgccctctactggctgtcctgagcaattgctggcatcaagaccagttgctacacccaaattgctttagaatcactgatgacggagctgaaagggacttgagacatcatctagcccaggcattctcaggggatggaggttatatcagagccaccatggagatatgtgtagttagattaatattttcacaatacaaattatagaaagtaaaactatgtaaaattaaatttttcttgtctgatctacacaggtgggcagacaggctgcatctctcagggaaggtggggcatgttagaatctccagggaatttaagatgctagtgtctatcaaaaaggagaacatgtttaatggggttaagaaacactgatttgttgtaatccctgcatttaaaagatggggaaacagagtcccagagagattggataataccataataaatcatgctgtctcatatttgtacgatactttagagttctcagcatactttctttgtctttaatttcattcagtcctcacaaccaccctatgaggtaggtatgagctcctttttacaagacagaaagtgaagttcagagagattaattaagtttcccaatatttcttagtcaagttagtttaggagccaggattcaaaactacatctttctgactctttcctctcccctgtgctacttcagtgatatgtatgtacactccactgaatgattaggttcattttcttcccccaaagaaacatgaacattcatgaaagaacagcactttggaataatgtccagtccccagagtgcacaaagcctaaaatgcgtgaacccccaggagccttgggaagcagcaagctagccaagatgccagatgcttacagagcttggggtggaagggaggggttgtgagtacagaaacggtaaaggaaggttaaaaaaaacagctacatggggacagtttctaagaactcagtcagtcctgaactggctgtgctgagtttccttaatgactgtatttagctacttccctgactgccacctccatgtctgacttagtagcctcagaagtgtaaataggaacacaatggcaccaaaacccaattggtcctgctggggaccccaaggccctgagtgggccatgatccccacctgtccagggaggccagagacaggccaaaatagatttgtttggatatctagatggatagtgtttattctgtgctagcagccactgattttgctcccactgccacataataagattgtttccagcccctctgggccaatcctcagaggtggtctgtgctgacctttagtactaccagaagaagtgatgggggtggggtgcagtgactcacacctgtaatcccagcactttgggaggccgaggctggcggatcacatgaggccaaaagtttgagaccagcctggccaacatggtgaaaccccgtctccacaaaaaatacaaaaattagctgggcatagtggcacacacctgtaatcccagctgctcgggaggctgaggcaggagaatcacttgaacccgggaggtggaggttgcagtgagccaagatcacaccactgcactccagccttggtgacagagtgagtgacagtccatctcagaaaaaaaaaaaaaagaagaagaagtgatggggtcaggggttggaggacgtcatgcagagtggtccattgatgggacagagccagggcagctcctagcccatctacttaccacctcaaggaaagatggtcaccttttccagaaaggctgtttcctcacccctcagacaggcaggcctactgaaactggccaaagatggacttataaaatataatttcttgggtgcaggatggatggcttagaggggaaaaggctccctgggcttggatgtcctcctctcatggtgggaaggaacattcctctttctgcaggatggaaagagaagtttttcctccatcctcacacactggcttccgctgtccaaaggagtgtgactgccccctccacccctgcctggggtggggctgagacagatgctttgccaagggtggctcggctcctatcctcccagctggctctattgcagcctgccagtctatccttcactctcataaggatccctctcacctatggggccctggtactagtggtcagtagccccagttaccatggagtctgaatcatctctaatccctaaggttctccagatagacagtgggctgagtggtttcctcccagggaggctttccagaaagctgtgggtgtggaagaaccgtaaaaaagaatctcttaaggagaaagagaaaacccatgaacctatgagatgagagggattcaggagctctggctgggaaagtaaaattgaataataagacctagcctgccactcagtgtctgaattttgcctgtgcaggccccataacaacaaagaaaatagggcagcatgcccactctcatcctccaccggcaaattccagctagaaggtattggttaaagacccttccagatgcaagggtcaagaaaggaaggataaagacagacaggcagagcccaggagccctgaagcaggcctggcagctgctttacaaacagaacagcttctctgctttcaaatgctcttcttaaagtttggccttctaggctaccctggttgcactgggataggggtgggggttgtgaactccttggtatttattttctgttgcctcgattattctgacatgtactgagtgactgcccttctctcatactgagatctttcaggtggagtgctcaatgactggtctcgcatcactatgaaccccaaggtgtttaagctacatccccgcagcggggagctggaggtactggtggacggcacctacttcatctatagtcaggtagaagtgagtacggtcttaggcctaactcttcttatatccagaatgcagatccggtgcaggccacataggggcactgtggagccagccaagaccatccaatggctaacttcctgctttgggtgagggggtggggggaccgcactgggagggagttgaaaggaggaaagagagagggggccagcttcttttgttttgttttgttttgtttttccctagccaaatattattgaaaaactgtgaaaaagacccctcccacaccctgccatctgattccctcctgcagggcctcaggcccctgtttaccctctgagctgtttggctgcactgccaaacttgaacttggtctcagtacattctttgaaagtcagttccagggttactgagaaccctttccctcaacactgctggctcggacgttgtaatgaatagtgctcctgcagactttctttccacctcaaaaagatttctgactgtctttccttcctctttctcccatttgtttccctatctttctattcctctattcttgcctccttcctgctgtcattctcccagccctttctccctctgcttttgtcctcttcctgccctgggcccgctccccaagtccaccagtgtccatctacttccgttcccccattgtttgcctccatgggagtggctccttggagataaaggaagatgagccatgaggttgggatttttgtgggatgggcagcaagcaggcaggtggacagaaggactatggagccaacagatgggtgtcacatgagagcggccagagaaggtgggctaacaagcatctgctaggcacactgagcaccccgctgtagcttgggtcctgacccgtatatggcacccaaatatgctgttcccacctgaagagctgatagagggagtgacctttcataaaatgatttacggtgatatctgagagtcccaacacccatggggcacatgggcataaccctgatgtcctgtgagccaagttccacgtggtgggggtgggcggcagatcaaaacttggtgtgaggtatgatggataagggtagtgaaggatggaaaaattaattttctgagcctaggagagaattgagagtggcccatgcaggctgggaaaatccccatgacattaggccactgagcataagttagtgcttccttctggccacaaagttaggggcctgggcttttccaaattctttgtcttgtttgtggtagctagctctcgatctctctggacctgtttcctcaatcatcaaatgggaggcccaaggggcactgtgaatcagtgaggggagtccaggcccaggggaggggtggtgcaagctgaataagcttctgttaaggagctcaagaaatcacaagttgttacatgccctctctggggaatcagtgacttctaagtttctccacaaatagtccgtggggctcaagaatggaagtcagtttgtgtccacggcactgtgtacacacctgctacgtgcagagcactctgcttcatgtcagggctggggcaggggtgggcgggggaacaggggcacggtgaagctgcaaatagggcatggttcttagccttacagagtttgcgacaagtgtgctgttgtaagaaaagtttgctcagccagctgagccccatggactaggggaagaacaatgcctgtcacctgtcctttcctgttggccagctagcacgccttcacatggcactgccccatccatggggtatactaacagctcatctgagaagattctgtcaattcaccacagggagggccccccaccctctctttcctctcttccccaatcccttcttgttgcctctcactcaggtatactacatcaacttcactgactttgccagctatgaggtggtggtggatgagaagcccttcctgcagtgcacacgcagcatcgagacgggcaagaccaactacaacacttgctataccgcaggcgtctgcctcctcaaggcccggcagaagatcgccgtcaagatggtgcacgctgacatctccatcaacatgagcaagcacaccacgttctttggggccatcaggctgggtgaagcccctgcatcctagattccccccattttgcctctgtccgtgccccttccctgggtttgggagccaggactcccagaacctctaagtgctgctgtggagtgaggtgtattggtgttgcagccgcagagaaatgccccagtgttatttattccccagtgactccagggtgacaaggcctgcttgactttccagaatgaccttgagttaacaggacagttgatggagccccagggtttacatgaagcagaaccttctttggttccatgttgactgacttatggcatgactcttcaaccccgaggtccctgttgtcagatctattgtttgttgcactaaaatgaggatccagggcagcaggccagagaaagcaaaggtgcactccagactctgggggtggacatctgaccccaagggggctgctgctcctctcttgggtagggtagtggctggggtggagtgggaagggagcattgcagcctaagaagaaggccagagagggaaaaggcaggtgcttttggcagagaccataagagaaacctgccaaggagcatccttggcagtgggaatgttctttctgctctatactgtggcctgcaggagggttggagtgctcttcccactccagctgacagccacaccgtggcagcttgctgggctttgggaagtttgctgtgctttggaacaatcacagggaatggccacaaacctgcccgcctaagaccctgaatccgtacttgggtcacatgactctcattttatttacagctgtgctccacactcagaaaattccctggggtcaccttctagttgcccccattcccagcctgactagaactcctgtcttctttctccatggagcctacctctgtctgagacaggtgcctaacctgggacctgtggtcatgtgagtctgggatattctttagcttacctgggcacaaacagaattttccatttattaagcagtacaaatgtttttcatccattcctaatcaaattctgtctggggacgaagggttggacgggatgacctccagaagtcccttcaatttctagtacctgtgactcttagccctcaccacagccttctaaattcccaaatcctagactgctcctgggcattagcaaggcagagcctttttacctggcctagaaagggcaaggggtgaggataggacagagggattttgttcaagtttgctgcaacccaagtggacgttaggccaggccttatctgaaaggccagcagctgatgctgtactaacccagtctttcttcactctggcttcaaaaagccacagcagagcattgtcaccgcaggtgctcatgctgctcccctaaagccaggctcaggagaagccagtgtctaggcactgagcagggatctgccccctagttcaggtccaaattcaccttcccctaaaccccaagcttcccaacagatcatatggtaggaccctcgagagccttacttcaaagtgcctgggctcagcctggtttctgggtgctagatccagcccaaacctgggaaggccagccttgtacagtctgctcctcttgttcctgaaatgtgtttccttttcaggagatggggaataatttccttcaggcagctgaaattcaccaagaacagcgggtacttatttctcagctgtgccttccctttctaagcaaccacactgcttggcccttcaagggtcagggtgagacgtgatgggctaggcctccgttgtctggttgctaatgacagccttgcaacccaaggtgaggtgaactccaggcatgtgtctggccctaactcctataaagtgcctcggacagtccgcagttgtagcagaaaccaacaagaaccactccttcatgtttggaaaataatttctcttgtattatctcctttgaagaaggcaaggctgataatatgacaaacatcattgtttagatgaggctcagagaggtagcactctcagagtgttttgaccagtttaagccgcagacctggagcttcagccaggtctgactccaaagctgttccattacaccacagcattgtgtggaatttgaggtctagagagaaccaataaaagtggtaattgggaactgaaatccttgagagttccggggagaaacccagagatgcctgatttcattcctcgatggtaatacccgtcctctcggctgccaggggctctgtggcaaaaagagtcagacatttctttggaaaacagcgaacagccttagagctcttgtgttcagaagaatcttcctggcacaatgttggagcagcaggcctctgggacccacagaacttgtggcctttatgttctttcacccatcctaggaaccagccaaccatcatgtgtagagcccctactgtgggcaaagtcctcctttcattaccctacagacagcttacaggagccagcctgcttcccacaactactagtgtgactccttatctctttccaccataccttagagactttgatactaccagggtctctcagggatggagggaagacctgaaagagaggactggttctgaggccagaaaggtgtgaggagagaggaggaaaagtcttcctaattgtgcccctaaagagcatcctgataccattctattctccagacatggaggggatgataaaggaaataggatctccactggacccttgattcattctgaaccctccaaaggaactctagagggcgagggatgatgagggaagcaataggtagctggggagccctattgctgctaagtcattggcaaagtgacaaagcaatttactgatgagagaatgtggaaatagatgtgcagtttggaattatgttggtgtgaatttgccagaggaccaatgcttgcatggagaatgggacgaggacatttgtgggcaagcagatgacagaggtttgaaggagaatggcatggcaggagtctctgccagttacttgggcttcaacagccaagctggcacaaaagacagctggcggaggctgctcggctactggttacctggagaagtagtatttgcctatttcccccttcatccatcctgagccaaatttcttttgctgaacaggaaagagctaggaaccctggaggtaaacaaagactttgatccatgtatgagtgtatgtgtttatgtaacttcctgtggatgcaaatagattcagagaaatttagagctaaaaaggcccttagagggaatctagcccaacctacattccaccctgttacttatgtagaaactgaggcccagagagggaagatgacctgccccaagtggtgagcaagcaccaacctccagactcagcagagtgagggggtaaagcagttcctgtcccacatggccatcttctttcttccacccacaaactccaggctggaagtacttggcccccttcaggagcctggccaggcagggagagagtagctgcagccttcatcagaactcttcctcctcccaaggcattctcccagctctagcctctggactggaaagcacaagactggcccagtgccagcaagtccttaggctactgtaatgctgcctcaggacccatccctgcctggaggctcctctaggccctgtgagcacaaagaagaaagctgatttttgtcttttaatccatttcaggactctctccaggagggctcggggtgtgtcatttctatattcctccagctgggattggggggtgggctttgttgtgagaatggcctggagcaggcccaatgctgcttttgggggtcagcatccagtgtgagatactgtgtatataaactatatataatgtatataaactgggatgtaagtttgtgtaaattaatggtttattctttgcaaataaaacgctttccccgtctgttcttgaaatcggcgtgagtacttcctacatgttaggtgcttctttgcaaatgacgccacacatgagctaggggaaggactaaggcacccatttcagaggcagcaacagaaggaagatggtctgaatttcctgttggaacatcccacattctctccatgcctcagaccacactcccacatccccattaccttaggtcagggtgtccaatcttttggcttccctgggccacattggaagaattgtcttgggccacacataaaatacactaacactaacaatagctgatgagctaaaaaaaaaaaaaaaaaaaaaagtcacaaaaaattctcatcatgttttaagaaagtttatgaatttgtgttgggccccattcaaagccatcctggcccacatgtggcccgcaggccacaggttagacaaccttgccttaggtcttctgtgactgtgaccacatgaccggtaggctagatgtcctgccaaaaggaacattgtcctggggcagcaatacacagaactgactcactctcagcttaagaatgtggcatctacaaaagatacttcaggcctgggccccaaatagcctgggtagacccagcctccagctcattttgcagatgaggaaaccaacactttaatttgaatttaagtggctcacccagagttacccaactagtaagtgtgtcaacctggtctgattccttcccagccgaggctgctgttacctgggaaagtagtatttgcctattttcccctccatccatcctgagccaaaatcaataaggaagaggctcacatgaaaaagaccagattgcagctcaagaacacgtagctcaagagaggtcttgcgcttttcacaaccccagcagcctttcccccagccccccgccaatcttttggcttccctgggcccgcccctgtgccatcgtataggtggaacaatgtgcacacagcagaccacgacaaacctgcaatggccaggtgtgcatgggctgggtgttggagcccaggctggtcctatggccaccttagaggtttgtttgtttgttttttaaggaaaccagtcacaggaaagctacagactgtttaaaaacactttatggaagctcagggaaaacgtaatctctggcacaagaagtaacaaagacagcagaaaagcagaagcatgtctttggccactgtatacaaatcatcacatgaggcaggcacccaggatagaggcagcagctcacactgcagtaaacacgcaggatgttgtagaccaaattgaccaacgtaatgcaggtaaatcactggaccaaatggcacccacccaagagggatggaatgagagggatgtgagccaaattttgtagcctgtcattgcaacagccattagaccaagagtctgagagacttgccattcagaaggagagttctttatggctgctaaaagccaggcgcctcattttcatcctgagcaggctggctgactctcaaacaaaggccagaattatagggccacacaagtataggcaagttgctgagggaatgacagagaaaattaggcctgagcccaacccattctgttacagctttgtgaggcagaaactgagtgagggctagtgggtagcagagggtatttcgggcgttgtttgctcagggacaggaaatgggtaaaatggttggagaagaaaatggtgtagctctccagtttataaagttcaatcacatccaatattgtttgatcttcccaacggcctttgaggtaagcaagagacagattgttagtctcattttatagaagaagaaaggaggctcagaggtgactgattgccccaaagtcacatggcttgaagttggtggagcttaaactcaaagcccactggctctcaaggccccagtcctactcctgtaggaagcaggactcaatgccagaagatggggctcaatgccgggagatggggctgtttgacagctagagaaggagagacatgcatcccagagccttcaaaacagagt

SEQ ID NO: 16991 - DNA, 51723 bp, Human; identical to SEQ ID NO: 12152
  misc_feature (1)...(51723): n = A,T,C or G

SEQ ID NO: 16992 - DNA, 18864 bp, Human
  misc_feature (1)...(18864): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnaaagaaagccagaaagaaagaaagaaaggaagaaagagagagaaagaaagaaaggaaaaactccacaggttactcgtttctaccttatcttacatgaagtgccaatttaccgagagcaagacaatacataatcgactattcccctacctgctacttttcccttacaacacgtggattaccatactcttcctctttcccctccagcctgcttttcctctaaatattgaaaccctcaaattcatctttggagaaagtcacagaccacatactgtttctgtgattctgtgttgttttcttccaggcatgtccttaaccttggcaaaataaacttctaaattaattgccacctgtctcagatacccttggttttacagtaagaattcacatgcttacatagtaactattaattttggtttcttagtgtgttacctatatattgtatgcctttgtttctaatgatatttataaagtattgatgccagctcattgttatcacattgccagttaaaaaaaaaactaatttttaacctaaaaattagataagagctggagatggatctgggggtagaacgggggcagtagtaaaagcacgcgtcagagtgggtggggctgtcgaaggtttctgaagaccacagagtgtgataacaaggttttacagtgtcatttccttaagtattaaagtattacagcctgcttcctgagaaggcatttgggaaagagtccccagaaaggggccccaggagagattccagagaaactcgtgttttggagatgttgagggtgaacaaatggtaatgaggatgatgacagaacgcaagaaaagagaactagcattcaccggacacccacgatgtaccaagcactttgctaaccctcatattctcttttactttccaaaaacctgtagtactgtggttctcagccaggggcaattcatcccctggggaacacttgctaatatctgggggcatatttgttttcacaactgggagtgccactggcatctaacaggtagagcccaggagtgctgcggaacatcctacaatgctcagggaaggtcctcacaagaataatttggcccacaatgtccatagtgctcaggctgagaaaccgtgcttaaatggtaggcacaataatcttcacttttacagattggaacctgacactctgagaagccacctggcattcaacccgaaacctaacacagctccaaagcccatgctctttcaccatgccgttgcagtgagaacagggatggaaatgagggtggcaaaaatgaccaagatacaaaaccagggcacagattggtgctcaatagatacttattgggatattcattaaatagaagaatgaataagaaaaagaatgaatgagggcaggggaataatgaggatgagtgtggtcattctattgccatcctgacatacctccttgtccttgttccacaactcagcagtgagtctgggattatgacaatagagaaaattaaatgatggtaggtggcctggagtccccatgctcaatttcaagaagcatccagattccagggcctgggtctccaaatggaagtagaagtactagaagattgctggtgcacgctgtcctgcatcaccctttctcaggaggatagagactgaaacaggaggttctgagctgagttttggtgaccatttccctctttctcccagaggcccaggccagctgtggcctcagaggaagaagaagggagttgtttccctagtttctaaaatttctgtgaatttgaacatgggctacaccagatttattctgggaagctctgaatcttctaggagggaaagactgagaggaaagagggtggaaagggaggagcctgtgataaaacagaacatttctttttcacttcccctttcagactccagaatttgtttgccctctagggtagaatccgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctgggtgagtcagggcccccaggagggagagaggaacgggaacctcagttggggataaccctgggcaaggatgaggggtggcatgggaagaccgtcaggacacccaggggagggaaggcaggctggtgaagatgaaaccctgatgactctgctggctttggaaagtcatccaatgtggcagagttcagggttttttcagtgtctttcacccaatcttactgaacacccagactcttgatgttctgttgctttccacatcagaacccgctctgagaaaagtctagtaacctatacttgaatgataaatgaatggccagagtgtttgccttctttgaaatttatgcttcacaaaagaccaaatcttaggcaggagggccagtgctgcctcgggtaaggggtagggaggaagttgtaagatgcatttttgggaggaggtggcagtggccattctctgtgcccctgaaaccactttgtgtagcagaagcctattgtcttcatgtgtaagaatattcccctaggcagaagcacagggagatctgggttatccagggaaaagggactctgagaatacaaaaacctgggtaagtctggagtcatctgttgtgggaccagagaaatcatgcatgctgcttttgaccacacagaccatgatggggaagtactgcatctgatcagcaagagagacagggtctttggccaaaatggagggctcttttctaaccatgttctcagctgttggataggggacgacgactgattttgctgagtggtttgaaaagcctaggggaggccaagtaggggagacttactgccaggactatctctccaagctcagttcctggggcttccaccctcacattctagaggaaagcatattgccactcagccaagttgtgtgatgtgattactagtgaaacgtgatcagctctgggggccctcggctcttggctgtcaatgcaggatgatactgggctacaggagaaagaggtaaggaagacagagtattcccccatgaataggatggaatggattaaagtagaagagaaagtaaagtgaactacctcatttgtcatgtggggaagttcaggcctagagaggtgatgtgcttctctaccacctgggcaagactcctgggaaagatctttggtattttttcccatttgccttttactaagtcatcaaagatttaccccattttttccattcttattggggctgccacatttacgtcttcatcacttgataactcaatttttatagcaccctctgatggggtcttgattgatcctgtctcccctcccctgcatccatgctgcccaccaaggccacggcatcttcaggtccagctatggctgtgtcagtgcatttaataaatgccttccgtgctgctccattgcccactgcaaaaactctaattctgccctgcacactgtgttctccattgcaccccacatgaatcttcttctacagccaggcagtatgtacactgcactttctgtttttaccacctttgctcctgctgactctccaaattctatgtgcaggcactgttctaggacttggagacttatcagtgaacatgactgacagccttcctgaccggaaatacgaggtcaatgaacttattgtgaagcaataagtacaccgggtgggaggatatttggtatttactactatttattaactgtggaatggatacataattggtgacttctctctcctttcctcatcttttccttttttttctctcgctcttcctcttcttttttactctctctcccactacaccgtcccccttgccaatcctacatactcaggtttttagctaccacttctatgtcaataactcctaaacctatttctcttgcttgcttctgtcaagtataattttatatttccactgctggttggacacctctaaaatgattctccagctcaaaaacaaagcatattcaaaatgcaacttatcatctcctccttacaaatgttctcttcctcctaacatttgtatttgcgtaagcgcagccacccttttcctagttatccaacttaaatcacccccacagtctattaaatgccaacttctctctgccacttaaatttcttctgcatctgtttcctcttcttcacctcctattgtcagtacaactttgggctctcttatctcccacctagattcaaccagtgaatgatttccagagcaatggcacatcaaattaatatggctactgctctctttgaatttatattctactgagggatataaacggtaagtaaacaaacaagaaggcataagtacaaatggaaaagggctatgaagatgtaaacggggtactgtgataagattagttgtggggaagagaagagagcagcccactttaaacaggatgttatgtaaagagttttctgagggggtgacatttaagctgagactttcaacatggtaaggattcagccatttggtgatcaaggacgcatttcagggtagagggattggcatacagaaaatccccaaatttgaagaatgccaggaaggccagtgttaatgaggctcaatgagtaggtgaaaagggatctgagctgaggctggagaaggaagcacggacccaatttgatagggcttgcaggccatttccattttattttaagaccaaagaaaggcaactgaaggcttgtaagttggggagtgatatcatctgatttcgtttttttttttttttttaaggaactagcttctttatggaaaatggattgtagggtgaccataagaagtgaggggacaaattaagatatgggaaaaagctgatggtgacttaaactgagtagtgtctataaagggggtgaagagaagttagtgggtgcaagatctaagttggaagcaggatcaacaagacttcctggtgtggaagggactggattttgggagacagagaggttaaaagatggcttgcaggtttctggcctatgtagctgggtggataacgaagatacatattgacatggggaagacggagagaaacagaatgtgtccacttgctatgacaacatgaagccattggtgattttgacaagaaaagttttagtggactgctgagggccgagtccaaattgcagagaattagacagtgaatgagaggagaagaaatcaggacagcctatgtaagaaaaacaatggagaaatttagttttgaaagggatgagacaggccaggcacagtggctcatgcctgtaatcccaacacttggagaggccgaggtgggtggatcacttaaggtcaggagttcaagaccagcttggccaacatggtgaaacaccatctctactaaaaatacaaaaattagccggatgtggtggtaatacaaaagttagccgggcgtggtggtgcatgcctgtaatcccagctgcttgggaagctgaggcaggagaattgcttgaatctgggaggcggaggtcgtagtgcactgagatggtgccgctgcactccagcctgggtgaagcaaacaacaacaacaacaaaaaccgagagaaatggggcagtagctggaattatatgtggtgtcaaggaaaagtttttttttgttttttgtttttaatggaagatactgaaataaatttaccattgatgggaagatccagctaagagagaaactggtgatgcagaggagaaagtgaataacagaaagggaaatctttgagaggattaaagggaatgggatccagagtacttgctttgagactgaccatagacaggaggagagatgctttctccagtgaaatgcgaggaaggagaagacaggtagagatgcagaaaagactggtagatttagtcgggggacgatgtgagatcttctgtgtaacctcttttgttttctctgtgaaatatgaggaaaggcatcagctaaaaatgagagaggactggaggcagagggtgggatgagaaagcttggggaatgaggaaaagatgagtgtcactactcagagtagcagagcaaatttcttggaaaaaagtgccacaatggcagttcagtgtccttttaaatgcggtgatcgcacttttactgcgtcaacagtttgccttcttgtgtggtaatttcaataacacgcagctgagcaagtaaaggcatggcgaatacaggtgcatttggtagagatagagaaaggcaacgaagttaaggggatttgcaaggaggtaattataatgatgcctcattgaattcaagctagatgggggagggtgggaggtaaaggcaaacatgtgctcaaggataggcagtggtaagatggatgctttggggttcttgataaggtcaaagattattctggtggctgtacttgagcagagaaagttcatctccaaagaaagaaagtttactgatgatgagcagttcagggaatgaagaggccagttgtttgatgggttatccacatattctggatcactacagtcatctcttttttttttctttttctttttctctgacctcattcttccatcacaattagtttctttcttaattaagctctttggcatttgccctgttccaatctatttgacactgcactttcagccccaatttgaaaattctaagtgacttcccactgtatactgaaccaaggagtgaacttataaaaaaaaacttaaatttatttgaaattcaccatgtgtcatgtagcacactaaatgccttctctggattatctcatttaatcctaacaaccaccctatgaggtagatactgctgtcattatcttcatttacaagcaaggaaactgaagcagagaaaagttaagtaatttgtgaaaggtcacttagcagtagcggagtcagcatttaaactcagtatgtgctttcccccactgccacaccacctggcactaggagccctccagagtatgacttctactttgctttcctgctttgtccctcattattggaagtgcttgaggagagaccagaaatcaagtagaagttgggctgcaacttgctgggaatgttgccaagtacttgctgctccttcccatggaataccttttccctctcagccaaaatcctatcagtcctggaaggtccttgatgaacctgaaaggtcccatcttctccataggattcccctccttatgaaccccaaaccctcccaaacacagagccctgggatcttttctttctctgaacctccatagcattttatccaaattcctctaatgtcatctcttttacatcagattacacatgtgcttatctccaccgttagattcttgccttcagtggaagtagggacttaacgttcttttcccttaggtgaactcagcatgcattgcagggcagtaggaagccaatgcaggtttgttgattaattttggatgcaaaggaaggaagtgattggtccaagtatatatttcgagatattggagcatcgggaccagaatccagttctgtaaactttgaagccaacactttctccacattgctccctttttacctcttggttctgattccatttccttccgtacttttgtccctgaaaatatacatgcacttggaagcttcttgactttctctcagcccagatgcaagagaaaaccttcacccatggacagatggacacacacacacatacacacacacacacacacagagctctgattcacctaaggacccagctttgcttctttacccaataacagcacccacaaatctttatctaccctagcccacactttgcctccactacggaagctcttttcttaacccagtggcatccccctacccctgcatgaagtcacagatctagtgcccttttgcagtctcttcttccttttatcagatatttctaatagcaaaaatctggaagacctaaatgccaagcaaaagagttgttaaataaatcacaggacagccaaatagtaggatatagtgtagccatttaaaatgacaacatgggcggggaacggtggctcacacctgtaatcccagaattttgggaggctgaggtgggtagatcacttgaggtcaggagttccagaccagcctggccaacatggtgaaaccccttctctactaaaaatacaaaacttagctgggtgtggtggcgcgggcctgtaatcccagctcttgggaggctgaggcaggtgaatcacttgaacctaggaggcggaggttgcagtgagccaagatcgcgttattgcactccagcctggtgacagagtgagaccctgtccccccacaaaatgaaataaaataaaataaaatgacaacatagaaacagattcatcttctagaacttgcattgctcagtgaaaaatcaggttaaagaacagtttttagagtatatcctcatttacacttatgtatgtctgtatgtgaacagcgtgtgtctgtgtgtgatcacagaaagaaatccaacaggatgtatgccaaggtgataatattttgctcctgcgtattttctatttttctgtagtgatcatggattacctgtgcaatttctaccccctcccaacaaaagaacaaatcttgctctcaggataaactctggcaaaattatttatactgatgcataaatcatatgtaaagcccaacagagacctctttccagaggcatatttattttaatcagtcaagaggggtaagccaaaggaaaatgccacaaaacaggtggaagagggtgttatatacttttatttcatttttgtatgttactgggagttctcagtccttttaaaagtgcagctcatccaggcagtcccaggggatatggccacgagggctgtgctgtaggtgaagggcgctctgggcctgggcagtctctgggccaaagtgggcaggtgtcagttcagacactccactgtgggctgatctttgctttctgtcttacagctcctgttgctgggacacctggtaagtactccacccacagcctttccttccctcgggtccccttttcctctcctcccagtgccctgtctggaggtgctctaaatgcaccagcaactgagcccagtaccaagtcagggccaggaaagggtaattgctcccgaaagatcccctctccctcttccactctcctccttccttttcctccttccacggaggcaagtggtaggcagccacggtgttcaaatgggggagctgtcacagaaaatgagaactctgatctctctctcaactgccttccgctgtccaaataaaaccaagggcttcctctctccaaataaaattcaggcacatgcaaaatcacatggcctgcatatgttgtccccctgtgttgctaaatccttgactgtgcatgtttctgagagctccaaggcctgttccctgacagagtggtctctgcatacctctggctacactttgccgggcacttctgtgtttgtgccactcagcctccaccgctccaggactggccctccggcttttctccctctctctttatccttctgaggccagagaggctcgtgtatgcttgggtgtgaggacgggccatcttgacctcgtttttaaagtatacagaatgacattaggtcagaacggaaacctgatatccaactcccatgcctgccatctccaccagagcccccacttatcttcagccagccccaggggaaatttatccactagtgtctaaatgcctttgtttatcggggagaaaagttagtctcgaaagagtatgtatgtatggggtgtctgtgtgtctgtgctggtggggagaggttggtggggagagagagaaagaactggtgaggatatctcaggtaaagtatatgtatttcgagggtgtttctcttgcctgctccctccttcttccctgttgccctgtcggagtcctgggctccctggggccgttgtggtgggatgtatgagcaaaagcaactgccttcagttgcagaaccattctgggcctggctcggcttttggtgcccctagtaggcctacaggtgcttttttgtctgagattcagggcctctcaagctcctgggcttcctcttcttcatgctacctcctctctctgcccctcagcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctggtcagtggaggaaggccccagggtggacctgggagggccaggacggatgaaatctgctttcaggcagaggtttgcaggaaaggggggtggcctgcttactgggaagtatcgctgtgagttgcctcagcacatatcagtggttgtttttgcctcagttctgattgaacagaagaaggtttcaaggccaaaaacaggcagccaagtgtgagagaagcagaaggaaatccctactgcataaaacccatttccattttaatggcagaattgaaaagcacagaccacaactgaatcctagccctggaaatgactcactatacaacatgatgaattcatttaacccttgagtttccatttcttcacctgctccgtggggcactaacgcctccctcagaggcttctggtgagaatcagtgtttccctgcccccgccccgccctccatgccccttctccacgttctcactgtgctaggtgctcttctctgtctttctcttccaccagcctgtgggaaacctgagatgaaagtcgtgtcttacccatctttgtatttccagcatctgaaactgggcagagcttaataaatattttgctggagaggttgatgatcttacaaagctcccattgaaaggtggctctctgtaaagcaaagttacaatgagattgtgatgaacattgtccttgtggcttttcacttagtcccctcccttcacctgaagagcaaattttcctcaaaagtacacagcaaacgaatgacccactggtgacactgttgcctttagaccctgctggaaagaagctccacatttattaacattcccgaagtaaatttatcaggtagcattcatcaggtaacatttgttgcacattcatgacttttctactgtccacaaaggcatatgtccttatcatatgcggactcctcggtcacactggattcttccttccctcctcgacatggaagagatggcatcttagggtctcttgtgttcttcctgcagaggcctgtcgggcaggaaaaggctgcagctgccttcctgggagaaggaggagatgagtgtatcctgaacacctattatgtgctaggggctattgtagatacatgacactatcatgctcattttcacgaatgaggaaactgaggctcagaagacttaaattatttgcccaagagttcataaatgacagagccagcattagagtccaggactgtctgatttcagacctaagctgttccctctgcacatcgtgtcccaccagtaaggaagatctgggtctcagagctgagccaagacctcccgggtcctctgcggttttttgtgtctttcagagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaaggtatgcggagtctgccaagatgtaaggaggggagaagaggggatggacaagggctgaggtcacatgggcctacatggaggtctgagaaaggccacagcgcaaaattgggcactggagcaaagaggagtggtgtggaggcctggctaagtattgaccaatgagcaggagtaggggccagagcttggagccctcaggtgataggtgaccaggctgttgttccactttgaaatgcaggccccagactaaggacggcagcgaagcagagctccctcgttggtgcagaggttccctaagctcctgggcattcctaagaactgaggtttgcctttattcttctcatggctcatgttacagccattcactccagaaagcctggcacgtcatggaccgttcaaggctgtgctccatagagtaatgatgcctccagctatgcgaggctttgggcccacccttcccactgcccctgagggctaaggggagcccttccttctgctcctgcctgctcaccagtgtgcctttattagttcggtggagaaacctcggtaagcaggaggcataagtccagccacagaaaccctgtgcagatgaggctggggatgtagtgagtgctgcagaagtgagtgactcagacacagaagagcttcgggtgacaagcactaggacatagcattggatgggggggaggtgggacaaggagagtactgcctgtcctgatgtctgtcttccctagctcccagctcttcaccgatggggatcattgtggctgtggtcactgggattgctgtagcggccattgttgctgctgtagtggccttgatctactgcaggaaaaagcggatttcaggtttgtagctcctcccggtcccttttgttatcagtttccacttggcccaggccctaaccccagacattgccagaatccctctctttgggctagatacacattcagatctaggcccgtattgtattatagtcattcattcgtttattagatcattcatttgacaagacttgaacaaactagcttatgtgtcagccaatgcgtgagacatggtgggtgatgccaagagaagtccagtccctgcccttggggagttctcagcattgtgaggaagacagggtcattataataagatgggataagagcaatgatagggacatgaaaagcctaggatagaagtacagaggaggctccatagcccaacaagggctgaggcagttggagaaggtcttggggagagcagtgtagtgtagtgatggagtgcacatagtggggccagactgccttggttcaaatctagttctacagcataccaactatatgacccaagtgagtcactccacctctctgtgcctcagctgtctcatgtggaaaatggggacactaataggacttacctcagagggttgccatggggatgaaagaggctgatgctcttacacagtgcctggtaggcagtaacagcacacaaacagggctgttgccattctggaggaggtggtgtgtgagggcagcgcttagctagggaaggaggaccctccaggcactgggccaaggcagggattgaagccgggtggggctcatatgggtgtcgaagggggagtagagagggtactgcaagccaccaagaaagaaagaatcccgctaacacctcacaaagcacttttcaattggttcatagccaacacctcagttactgatgataagtaaatacagagaaacagagagagagagactgagacacaggggtgtttttaaaaggcagagcaagcctcagacagatgccatggcgtggactttctgacactcctgggcatccccatgggtgagctgaattctgcctctggaccagcccttttccaggcgggagcagcctctgagcaggggagctgggggtgggaggacaggaaacatctgccagagtgaaggcctgagctggtcccatccaaccctggccctggtccttggtcctgaggactcaggccccaccgcctaatcctactaacctcctgtgtgcccctcccagctctcccaggataccctgagtgcagggaaatgggagagaccctccctgagaaaccaggtgagtacaggttgtctcagggattcagtgatggctcaccagggctgccggctggactggagccagggagaaggggcttgtgcaagttcagctgggagccagggagggagcagcagtgggaggatggctggggctcaaatcgcttggtcagctctgagtctaactcctgggcctaaagacgacctctctggagatgagaagagaaacaccagtcccagatacagaagagagggctgtgtccgaatttctggtaccaggaatctggtgatatttccagagcaagaaatcagagatactttggtctttctgtggagctttggcagagctggcaaaggatggggttaggggctgtaagactgaggccaatcggacgtgggaggcaggagtctaaggggaaaggaggaggaggcctggaaaccccttgatttgctgaggaatctgcctctgtggagggatggggtggagtggccaggctcagctgtctgtggaacactaggaggaggtttgggcttgagaaaattctgggggactaggggcactagtgggctctactctgtgggcaaaactcagttctgatgcccatgcactcaaggttgactgaattttggcctggttctgccctcatcacacagtggagccctgagcaagtcagtctccctgatggggttcagtctcctcactgaggaaatgagtgggtggccagggtgacctctcaggtcttctagatttgacattctgagaaccaggggccacccaagccctggcccaggtgggagtgtgtaaaggaacttccaggaggatgccaggcaacttccagactgtagttaaagtcagagcacaaaggaaaccagtgctttctctgggggcttccatgacagtaagaacaggcagaaaaaagaggctgtcaaagaccccacctcagatggctggagtatgattcagagcagagccaacagatttaagagcttgagcaaaatatcacttgttcagctgtgcttgcagcaaggtcgcatgtctgctggccaggcccagtggtgataggggcctgtgttcacaccagggccaaaacagatctggaaaaaacaaagtccaagcaactggattatccatcttgttgtgtggttctgtctgcactggcataagcacatttcacaaggcacttttgcagccaggcattggggctgcataaatggttttttaaaaatcctttcccaaaaggcaaagctgggttgctgggattcttgggaaatgtaatagaatgggaattcagaatgcggtttactgcagaatttacagcatggcaataaaggctctctatgttcagggggtgagagaagagactagatgcattgtctcagatgtctcctgacttcctgagaaatgccactttgcagatatggggctgcttttcacactggctaagtcagttcatggcaaaatatgagggaattcagtgtgtttcagacactaaccaaagtccatccttcctttctccttccgtccctcccttcctccctttctcactcactctctctttctttttaatgccatggagtaccatatttttcaaagttccaacaaagatgcactacatttagacaatgtggaaatggccctcagccttctctccctgaagtctgtggccagcaaaaatctggactttacttcactctgatgctgaacacccccctcccccacctcttccccaatatctcagatcccaagcctccctggtttgcttctaggaaagctcagcaattccctgaaaagaatgcagctcaagtgactgctccactttttcaccttggcctttgcggaaggctgtggctgggctaccctatgcatcgatcaatgaggtcatatttacccagtgcttggcctagaggcccaagacagggtcagcagtgcttgctttggctctagtttgggcgttggttttgcagcctcagcatcagcacaggcaggccctcttctccagcagtgctctggctgatatttcttctttttcccacagccaatcccactaatcctgatgaggctgacaaagttggggtgagtgatcccagccatctccccctcccttctcccctgttgccttttctgttgccttctttcctaggccctctctgtggatccttactgctggtttctgccttctctaggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaatgaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaagttcacgggaagtcaaacttcagatgagccctgagtggagattgctgacatgtcctgctctgctattctcccaatgtagttaccagaaggatgtgaccttctcagagaagtcatctcaggcagattagaaacatgactggcagtctccttgagggtttggtgagtgcccttggagaggcttcattttcctgggactctacgcagtaacatcgtgcaacatttgttgcactttttatggtaggataaaaagtactcactttttatggtcccacaatcagatttcatacacacttattgttttagtaataagggataataattaaaattactgcgttattaaggacttactttgtgccatatagtttgtgccaaactatatgctttagaatttagagaatttacgattagccttttatatttcctcttttgtgagtttcctgtgtatttattctttgcccatttttgtagatacaatgtatgtccctttatttataaattgcatagtagtaacttatttccttttatttatatgtaaattatttcactacactaataatgtattctttttataaaattaagatacagatagggaaaacaaaaaaattagatcgcccataaatccataaaccagaaataattaatgctaacatttaaggatatcaatccatattcctgtctgtggcagtgtgtatttgtgttttaaaaattggatctaatcccagctactcgagaggctgagacaggagaatcgcttgaacctgggaagcagaggttgcagcgagctgagatcgcaccattgcacttcagcctgggcaacaagagtgaaactctgtctcaaaaaaaaaaaaaaattggatcatatcatatattttacatgttaataaatacactcaggcaaaaatgtatgctcattgtaagcatgtaagcccaaataatacagaaagataaggagtaaaaagtagaagttccattttgtcatcagttccctctatcctcttcccttttctttctttctttttttttttttttaagagatagggttgtagtccaggctggagtgcagtggcaggatcacagctcattgcagcctcaaactcctgggctcaagtggtcttcccacctcagccttcctagtagctgggactaccacacctggctaatttttaagaattttttggccgggcatggtggctcacgcctgtaatcccagcactttgggaggccgaggcgggtggatcatgatgtcaggagatcgagaccatcctggctaacacagtgaaaccccgtctctactaaaaaaaatacaaaaaaaaaaaaattagctgggcttggtggcgggtgcctgtatcccagctactcgggaggctgaggcaggagaaggcgtgaacccgggaggcagagct

SEQ ID NO: 16993 - DNA, 18864 bp, Human; identical to SEQ ID NO: 16992
  misc_feature (1)...(18864): n = A,T,C or G

SEQ ID NO: 16994 - DNA, 36755 bp, Human
ttctgcacagcaaaagaaaactaccatcaggagtgaacaggcaacctaaagaatgggagaaaatttttgcaatctactcatctgtccaagggctaatatctagaatctaaaatgaactcaaacaaatttacagaaaaaaacaaacaaccccatcaacaagtgggtgaaggatatgaacagtacacttctcaaaagaagacatttatgcagccaacagacacatgaaaaaatgctcagcatcaccggccatcagagaaatgcaaatcaaaaccacaatgagataccatctcacacaagttagaatggcgatcatcaaaaactcaggaagcaacaggtgctggagaggatgtggagaaataggaacactttgacactgttggtgggactgtaaactagttcaaccattgtggaagtcagtgtggcgattcctcagggatctagacctagaaataccatctgacccagccatcccattattgggtatatacccaaagtattataaatcatgctgctataaagacacatgcacacgtatgtttattgcggcacttttcacaatagcaatgacttggaaccaacccaaatgtccaacaatgatagactggattaagaaaatgtggcacatatacaccatggaatactaggcagccataaaaagaaaatgagttcatgtcctttgtagggacatggatgaagctagaaaccatcattctcagcaaactatcgcaaggacaaaaaaccaaacaccgcatgttctcactcataggtgggaactgaacaatgagaacacttggacacaggaaggggaacatcacacaccggggcctgttgtggggtggggggcgaggggagggatagcattaggggatatacctaatgctaaatgacgagttaatgggtacagcacaccaacatggcacatgtatacatatgtaacaaacctgctcgttgtgcacatgtaccctaaaacttaaagtataataataaaaaaaagatcattctaaaatttatacaagcccttagaacagttaaaaatatcttaccaaaagaagaataaagttggaggaatcactctacctaatataaagtcttactacatagctacagtaattatgacagtgttatattggcagagggataaatacatcaatggcacaaagaatagatagagaaactggaagtagacccaaaacaatatggttaactgacttacgaaaaaatttcagaagccattcagtcgaggaaggatagggtggtattgttgttttttgttttaacaaattgtgctggataaattggacatacctatggaaaaaaaaatgaagtttgacctaaacatcatactttacacaaatattaactcaaaatggagcatgggcataaatctaaaacttcaaactgtaaaacatttagaaaaaaataggaaaaaaaccatcaggatctagtgttagtggaagagttctaaatgtgatccataaaacaaaaacaaataaactggactacatcaaaactaaaaaattctactctgtgaaagacctaattaagaggacaaaagacaagctacaggctggagacaatatatttaatccacgtatctatgaaaggactcatatctagaatatataaacaaccttaagaatctgacagtaaaaaaaaaaaatcagactaactggaccactcatacattgctgatggaaatgtaaagtggtacagccattttggtaaacatcattgctctctgacaaagatacggtgggtcccactgatgaactgtgctgccacagtaaatgtagccactatgcctatctccattctgaagatgtgtcacttcctgtttcagactcaaatcagccacagtggcagaagcccacgaaatcagaggtgaaatttaataatgaccactgcccattctcttcacttgtcccaagaggccattggaaatagtccaaagacccattgagggagatggacattatttcccagaagtaaatacagctcagcttgtactttggtacaactaatcgaccttaccactttcacaatctgctagcaaaggttatgcagcgcgtgaacatgatcatggcagaatcaccaggcctcatcaccatctgccttttaggatatctactcagtgctgaatgtacaggtttgtttccttttttaaaatacattgagtatgcttgccttttagatatagaaatatctgatgctgtcttcttcactaaattttgattacatgatttgacagcaatattgaagagtctaacagccagcacgcaggttggtaagtactggttctttgttagctaggttttcttcttcttcatttttaaaactaaatagatcgacaatgcttatgatgcatttatgtttaataaacactgttcagttcatgatttggtcatgtaattcctgttagaaaacattcatctccttggtttaaaaaaattaaaagtgggaaaacaaagaaatagcagaatatagtgaaaaaaaataaccacattatttttgtttggacttaccactttgaaatcaaaatgggaaacaaaagcacaaacaatggccttatttacacaaaaagtctgattttaagatatatgacatttcaaggtttcagaagtatgtaatgaggtgtgtctctaattttttaaattatatatcttcaatttaaagttttagttaaaacataaagattaacctttcattagcaagctgttagttatcaccaaagcttttcatggattaggaaaaaatcattttgtctctatgtcaaacatcttggagttgatatttggggaaacacaatactcagttgagttccctaggggagaaaagcaagcttaagaattgacataaagagtaggaagttagctaatgcaacatatatcactttgttttttcacaactacagtgactttatgtatttcccagaggaaggcatacagggaagaaattatcccatttggacaaacagcatgttctcacaggaagcatttatcacacttacttgtcaactttctagaatcaaatctagtagctgacagtaccaggatcaggggtgccaaccctaagcacccccagaaagctgactggccctgtggttcccactccagacatgatgtcagctgtgaaatcagactgaaatgctgaaataacgataaaaaaaaatacagaggttaaactagcaaagtgagtaaagtcaagggataaagaaaatttgttggaaaactcacaaagcaggacataaagcaaggccattagatatatctcattagtgtgacatctgggaggacaaagcatccaaaccctttcttctatataagtggtgagatgatgaaggttgtaagagggcttctgcccccttgaagacttcagatgctggggaaaggatagataagaataaggatgaaccaggcttttggagcctgggaaataatgactagcgataaacctgaagggaagttaagtatacgatccccagataatactaaggagaaaggcaatgtgattctgcagccattgtagccagagataataagcccttgaggaaggggccaggggaatttttctaaggatagacagtattaatgcagcactctcttctgctattaaactctcattggcttctaaaaggagtttcggtgagtgatttgctgagatgttgcattttcatggctgctgcctttaggtattattgcaacagtttggaattttgaaattaaaacagttctgtaaaaccagtttagttttgtaaagtgtatgcatcaaagatgtccttcattcagacattactgagttacaactacggtgccaggtactgtgtcagggtactaggggtatggggataaaccagactccctctttgatctaaagcagcatgaggccaggtgagaggtttcaatataatgtgataaaatgtgcactaggtactaagggatcatagagaaaggaacacattaaatggggaaacaattgatagagagagaatattttcatctgggtcttaaaagatgagtaggcgttctctctctttaaatgtctgatataagggcattttatgcaaagaggatcactcgtgcaaagactcagatttgcaagaacgtgaggtatttcaggagttttgtatggttccatatggactatgacaagtgagacaggtaaactaggcagagctggtcatcagataatgaagtcattaacctaaggagattggacaataaaatgcaatatggaggtatcgaagtataaacataaggagtaccactgatggctgatttaggatgcccagtctggcaacacgctaatgaaatgatagtgggggagggggccgtaccaagactaggagagagcagtcctgagactattgcaattatctgcgggagacataaaggctagaacctgaacagtagcagtacaaaaaaagaggggagttcaaatgatattaaggaagtagaagtggtatgacttaaccatctgggtatggaaggggaaatggctagagtcttggggactttgtgtttgatgtgattatggaccacagaataatgtctaagagaactggctctttagtctgactgccagagtctgaatcctgaatgttttagtatgttaccttgggcaaagcccttagcctctatgaatctatcttcctcatttataaaaataagatgacagtgcctatctcgtgggacttttgtgaggatgaagtgagataatggatgcaaagttactgagcacagtgtccaacacagcagaagcattacatatacattagctattactggctacattatgatatacagttagggagttggaaagataatctgaaattcaggagacgtatctgactataggtgagtatttggaactcattgttctgtaaacagtagttacagccacgtgtgtgggcatctggagagtgagcatggatattgtgatacctagtacagtgcctggcagtagtggttgtatgctcagtaaattttgttgacagggtcagggccggactagactgtggtaagcaaggcctgtagggcataaatatacttgtatgccccgagaagtgaggacctcttaaatattgtgccctacatgccttgtttggttcactcttgtcccagccctagcaagtatatataaggtgaaaaaggaaaaagctgaggctggagcctgggagaaccctggacatttaagggccatggagaggaacaggagttaatcaattcaagtgctggatggataacaggagttagagcaaagcggggaaccagaatagagtgattattataaaaagagtttcctaaaaagggagagatcaacaattagaaattatttagagcagccagtaaatacataaactcaaaattattctttaggtcattcctgattgtgacaatagtcatttcattatataaatgtgattaaggaaggaaaagagctacacagaagttattaaagagctaaagagaattgagaaatttaaaacagaagaaagtagggccaacatgaaaggagtagggagaaaaagagataaccagcatattgtctcactgatcctgccaacacctgtgagatagatattcttattatactactgttaaacctaatttacatttgacaaagttaaggttcagagcttgtgtgacttgtccaaggtcacaggtctagaggaggcagatacttgattcaaacctatttctgtctgatctgattctaaagtctgttttttcactcaaccacactgtacagtcagctctccttgtgagttccacagccacagattcaattaactgcagatcaaaaatattcaagaaaaaaatggatggttgcatctctactgaacatgtacagactcttttatctttcattattccctaaacaatacagcataacaactatttacatagcatttacattgtattagctattaagagaaacctagagatgatttaaagtacaaaggaggatgtgtttaggttatatgcaaatagtaagccatttttatatcggagacttgagcatccacagatcttgatatttgcagggggtcttgccaccaattttccatggatactgaggaacgactgtaaatggatgcaggcatggatgctatttaggagtgtccagggccaagtaaatgagttgctgagcagagaggtgggtggaggctgtgaggcatcaatatgtggtggcatccatctgcattttggtgatttttttccttcacagtcctcggctgtctgggaagagaaggatgaaggcagatggctgctccaatttaggggctaggattgcagggtgggcacagcattgcaaacgagtgaaggaaattgagaaatatggccaatgaagagttgaagagaggcctggcatggtggctcacacctataatcccagcactttcagaggcccaggcaggcagatcacttgaggtcaggagttcgacaccagcctggccaacaaggtgaaatggtgaaaccccggctttactaaaaatacaaaaattagctgggcatggtggcgggtgcctgtaatcccagctacttgggaggctgaggcaggagaatagcttgaacctgggagatggaggttgcagtgagctgagatcgcaccactgcactccagcctgggcgacagagcaagactctgtcaaaaaaaaaagagttgaagagaaaaagtctaggctaaattcaaagaaaaaaagtgagcccaaaaggaacttgcagagcaagggaaaagcagggatgtcaagggactagaacactccataaagtgaacagctgcaatgaaaataagggaagaaagtttagttcatctccgtttctttcctttcctttttactttcctttctcttcctttttggagttaatcaggaagtagtcccaaataccccagaaagttcatcttataagcccttggtcctcttgagatggtatcagatatattgctagacccttgaagaaaggaacaactccaggcaacttcttgagtccctgttattaattttatacatacacacacatatatgtatatacatgaaaacacacaaacacatgtgtgtgtatacagccatgcattccttaacaatggggatatattctgagaaatgtgtcattaagcaatttcatcattgtgcgaacataatagagtgtacttacctaaacctaaatggtatagcttactacatacctaggttgtattgatgtggcctattgctcctaggctcctgggctgcaaacctgtacagcatgtgactgtactgaacactgtaggcaatggtaacagtggtatttgtgtatctaaacatagaaaaggtacagtgaaaatacagtattataaccttatgggaccactgtcgtataatgtggtccatcattgaccaaaatgtcattgtgcagcaaatgattatctcatatatatatatatatgatatgatatatatgatatatatgtgtgtgtatatatgtatacatatatatgtgtacatatatgtatacatatatacacacacatatatatgtacacacatatatgtatatatatgtacacacatatatgtatatatatatgtacacacacacacatagagagagagagagaggagaggagaggaaggagggagggaaggagaaatatgattcagatagagacatctatcctccagagttcaggagtgtctcttcagactaggtagatgtagcttaaaaaaaacatatcctgaattctagagagatgcttaaatcactgcaattcctataacacttgccaaccaaaggtgctgttgatctgaaattgcttttttaaattaatgcagtgatttttctttaacatctagtgacagacactggggtcacatttgcagctggaccataattaggcttctgttcttcaggagacatttgttcaaagtcatttgggcaaccatattctgaaaacagcccagccagggtgatggatcactttgcaaagatcctcaatgagctattttcaagtgatgacaaagtgtgaagttaaccgctcatttgagaactttctttttcatccaaagtaaattcaaatatgattagaaatctgaccttttattactggaattctcttgactaaaagtaaaattgaattttaattcctaaatctccatgtgtatacagtactgtgggaacatcacagattttggctccatgccctaaagagaaattggctttcagattatttggattaaaaacaaagactttcttaagagatgtaaaattttcatgatgttttcttttttgctaaaactaaagaattattcttttacatttcagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacagtgagtatttccacataatacccttcagatgcagagcatagaatagaaaatctttaaaaagacacttctctttaaaattttaaagcatccatatatatttatgtatgttaaatgttataaaagataggaaatcaataccaaaacactttagatattaccgttaatttgtcttcttttattctttatagactgaattttggaagcagtatgttggtaagcaattcattttatcctctagctaatatatgaaacatatgagaattatgtgggttttttctctgcataaatagataatatattaaactttgtcaaaaggactcagaaagatcagtccaaccctctaacccatattgaatggtgatatactacagggttatgccagtgtgggaactatcgctggtaaataagtttaatcctccctagggcttcacaaagaacattgttccaccccaggagggtggaaggaagaaactgaaatgattgtgtcttagaacctaatgaaagtttgcattcctcagtaaaatcagagactgctgattgacttaaatgtttatagcttcaaagtcctcctcattatcatggcccacaagcccttccatgattgtccttccccaccctccccattacccttcttgcctcctctgctacttctctcctcgcacactgggctccagccaccctggccttcctgtcacttcttgcacactctaggaatgctcccactttggaggctttatctggctgtttctcttatttggctgttcccaacttcctgtgggctgactccctcacctccttcgggtctttgcccaaatgttaccatcttaatgaggcctaccttcaccatctattaatacttcaacctgccccagtagccttaccactctagacacctgtacagaactccactctactttttaacagagcttttcaccatctaatgtatcatataatttcttactcatactatttatcatttattttctcctactccactaaaatgcaagtttcatgttggcagggatattcaattgttttgtttattgatatattcctagcacctagaacagtatctggaaaagaggtactcagtaaatatttatcaaatgaattgaccaaaagaaggaaaactcaaaactttaatgacaactaactttaaagctacaataacttaaaattcagcagtaggattttgagggagggtaagtttcaaagattgacttacctaagactatctgcataaataaaaagaaattaatccagacaacaaattcaccaacttccatcaattggaaatccaattctattttctacagtttatgttctggagacactactggacactcttttactctcataactcataactcctccacttttgtttttaaatcatgagagaaaaagagttgactctgttatattgttttatctacctttccttgatcttagaaacgaatactaccataccagcttctactgaggtgccccctaaagttagtccaaataggtctttgcaatctccattcccgcagaatttagaactttgaatcacatgatttatttctaaaagtaaatccatgccgattttccccaccaaaaaattcctgactattaaactcctacaatcccttcattgctcactccccacccccaggatcatattttaaagttgggcccttgccttttgggtcacataggtacactgtttgctataccacaggtatagctatctggaaaacatggagggtattattctgttactactgcttcgtcaaccaaaaaataaaacaaaacaagaacaaaaaagaaacaaactccctgcctcttttcacttgcagtcaaggttcctaaccactacaaaattagcctatgtttcttcttgcacatagtagaaacccaagcttctcactgctgtgctattctgtaccatcaactcatcacataaagagcctggttgaagaatgattgtccaaccacattactagcatctgtcaagactttccagtttacaaaaggcctatcacatttaaccctcacaccatccttgtgaccaaagcattattaactccattttacaggagagtaaactgaagcttagggaagttaaaagaactgccaaaggtctcccagttggggagtcatgaagcccagaagagaagccaaattctctgctgctcaaccccttgctttcactattacacctcagggccttcaaatctaaatgcagttattcattaaacaggaacctggtagtcttaaacaggaatctctcacttggtaagatcttgtctcttgttgtatttgaccccaactgtctatggctttgcctgaacccaaagtacacacagcctagaaaccaaaggagaaccaaatgtgggataaaatgacactcattttaacgacatgtctcagcaaatgagttcctgtgtagctggctgaaagcccagaccctttcagtaaaacatcctgaataattcacatttgttggtctataatataaagggcaaatgtagctcatttttagaccagttctgaacatcaatagtaacaaaccagagataaccgattttgttttcatagaattggaacaaattagagtatctgtgcaaaagcatatcagatctaggagcagaggggacaaggtctaatttttaaataagcaaattttccagggagggactacttatgataaagggatattagtctcttagtcaacggaacctggatacacgcttctgacagagaagagggagaataggcaggaatctacacaccagatgtcaaggagatttgctttaaaatacgactgataattagaaatttctcagtttcccccttttccctcattctttgattcttattgttatctttatctcttactcctttgtttctcatatattgagtcttacagatcaagctcccatttttttcttcaggggtatttttctagttcaaagtgcctaccatctcccttctggttctattcatccttctctcccaaagctcctttagaagtgtggattaaggcagagcactaagaaaccagacttaaagattcccttctcattctgacttttctcctttcacctattccttcctcctgttttcttaccatcagtgtcttcaaaggctttcaagtacacggtaaatgcagaaacttcaagaaaggcagaatggaaacataaccaatgcatacataaataaagcacactgtagaatctttttaaattctgtatgatatatcgaatgctgtctctcacattacctagaccatttgaaaccgaatttgtaaaacatagactatctttaagtagtaacagatgcttctgacatgttttctattgtcttgaaccattactgcatatgatacatcaaagttaagtgacaatacaagaaagcagattcatttgctccctgcctaggccgtcagttcctaaagtggaaacgccatatattatctagctcagtttgctctacaagacctgcaatagagccttgtgtgacatagagataatatttgttgaagcaattaaatttgacttggaattaactctgccatcattctataaggaaggattgaaaatccttctcaccctgtgctgatatagtacctttctatacaaaaacgtccttctccctcttcccttggattgcataaactatgtacatgccttcctcagggcacttttctaggacagtgtcagcctaaggatctttgtttgggtggcttttagaaactcaggaagacaggagcatcatatgcctataggcagctggcttccaggtcagtagttttgctctgaccctaaaatcagactcccatcccaatgagtatctacaggggaggaccgggcattctaagcagtttacgtgccaattcaatttcttaacctatctcaaagatggagatcagtgtgagtccaatccatgtttaaatggcggcagttgcaaggatgacattaattcctatgaatgttggtgtccctttggatttgaaggaaagaactgtgaattaggtaagtaactattttttgaatactcatggttcaaagtttccctctgaaacaagttgaaactggaaaatgcaatattggtgtatcataatttttcttaaaaacatacctttgatgcttataaacatttcatttgtagtgatagttttcaggatatgagttcaagaagctacattaaaatcaataacaatatttggtaactaatattaagtaataatgatgttccactcacttattaatctttaatacaaccgtatgtggttagtactatcattatgcgcattctatgcagatgagaaaaccgcaactccaacggccaaaaattacagaggcataaatggtttagacaggacttaaacttcagtgtgaccaaaacccatgcttctaactactatattcaaaactcagagaaaactgaacccagaaaattgaaatcatgactaaattgctatcaacataggtagtgaaagtcaattaagtacagaactggagtatgactggccaattatcccatataatgggaattctccacatgtacaaaccacttcatatgctaaacttgttgacaacattcaaagctcatccctgaatttgactatattgattacatcaaaaatgttacatagcaaccttagaatccttgtgtaccttttcttctcaaagcctagattatttctttttccgacgtttcagtaattggagcagtaaaccccagtgtcccttacctacttgtttattacctccagatgcaatattactggtactgtgattgagaaacgcacacagtgctaatgaggaattcactttctactctgacactctggaagaatagagatgcaatcctaaggaagaatttaacaccacaggctacatgactaaggataaagagtagaaaattagcaggactctattaaggcattacagcaatccacctgacagatgaaaaaggcatgaaatgaaatgaaatgtagcagctacactcgtcctattgagaaaggaaaaaagtcacctgtaatgttgttcagaaatcctttcagtactaaaaaattcattgaccatcttcctttagtctcgaaaatttcttagaaggtaaaaaaaggaaaaggtgacagggcaaagacatttgaaaagaaagaaaagagtgaatgaacttgcacacctggcttggactcccattcccttaggtttccattgtgggggacaaactaatgcctgggttacctttcttgagagtgtgttaattgattcaatatctctgaagtgctactttcatctgaaaggttataatttgaaattcagatttacctggataaatttgatcttgctattatggaaacctctagaaatccttggagtagttactcattatcagcttaaataatatagccggtggagctgagggaatgagtaactcaattagtctcagttacaactgaagggcacattgttgtaaactataattgaaaacataaatatctttacctagtttaaaaataaagatgctttaaaaggaggaagggaatagccctgaggaatgtaaatataagcacaaaacttctacaacagagtttgctacgtgtgtggctgtgttccacccagcaaaaatgctaagtctacaactgacacaacttggatactctcatgttcccacattttggtttggtcaaggctgtgcagttgtactgcagccaccaccactcctggcctctacagtatattgatctgacccaccaatctgatcaaggtttagaaaaatattttcagcccagttagctcacaaacaaaatgagaattcccacaaattgctctttatctcagacaacagaggaaagctacagcaaaagcataaacaaattaccatttaagtttgttgcttcaaattaaagactaattgcaacagctactagatagcacagtttatggggcatctcggccccaagtcttttgtcttataaggtcttgaaaaaaagaaaggagattttcatcaataagagttttttgttatctttttcccttgttcatcaggcccttcactgcgagagagaggtgtaaacgttcagggcatgcattctagttaaagaatattaattggctattgggtccctttggttagaataaagacctctgtatgatgtccctagctgtacatcaaacccaaatatctctcagataaatgaaggtctgtaagaatttggtcattcctgtctcttctaaagagtaacagaggcattttcccgcagtaaagtagaatggaaagaaaacaaaaatcacaagcctataaacaccttcttcaattttcccagcatgtcacagacactactgtcttatttactacgtatttctgaggagtaaaaaaaggaaatatgttgagtttagctgaagcacagcatattttgtggtaaacttgttaaataaaacatcttttgtccaagctttggttgtcacacaagtggatatatcaggaaatataaaggcagaataaactaaagcagaacatactaacatttgtagtaggcatgaagggaattagaaagtgtttgtgttaacatggagggagggagaacagatgctttgagatgttcttcaacagatattctaggcactgagacccccttcgggaccagagagagcccatatccaccacagtacctgacacataaatgctcagtaattgataaatgagtcccattctaactgttccttagccctgctctatggaactctcccctggaattccttgtgccattattttatttctggaatcttcagccttttagctgagggcaaaagattgctgattaggaagcaatatttcccacctcctgcgcaaaacaagccaaagatcaacagcagcagcaacatactgagccctaaagggcaatgacaaatgtggagaatgatacagaggtctggttacttcttagccaatgacacagaatcacaattgagaaaacacagagtttattcattcccattgtgcatgccctggacaaaccaagctgcacctttcgtaacttatcacaatctcatattgacggaacactttctacaggtaatgtttgatttggctgaacactttagcattgcttcgtagcaacaaaatgatagctagtaacagaaaaagatccagggatattaccactgttagtgaggagaaaggccttttaattaattaattaattaattaataggaccaagtgccatctttttggatcatgcccttagtggattattggtagcaaaggttaaagctcaagctggttcctttgtccccctggcaacagttgatttgcctccctttatctcctgaagtatccgtaaggactaagagccaattattacatttggctatgctagcatatgtaaaatagagtttaaaagtttagattcatcactcaaaaattcatattctccaaaaccatacagtcactctgttagcctgtgttcccccagaaaaaaagtcacaagcttatttattaacatgtgcaatcccagggggcaagagaaaggaactgaagagtgaggcagaaaggaaaagaaagccaataagaggatgagttatcaaactactcgtttctaacagcaactgattgcttaacttcctgggactgtctccaataagtcaaattggcctcaggttagtccacctgagtgggaagaagcggtgaaagaatttgtctgtcagtatctgtctctcattggttagaagttcgacttatggggaattaactccctcacatttcctagttggatatgcttgggtacccagagggtcatatggcatccatgcctcagcatgaacagggaagcttcaaggcaaaagacacatagtgcagctatgagccaaggcaattcaaggatacacccataggaggctggttgacatccacccagagctaatcaccaccatgctggaaaaagacacaggtgaagctgagaagaatgaaggtggtgcataggaggtatctaatacagtcactcattttcaaactttccatgttatgattgcactgaccactgaggatttctattgaaagttttactgttgtcaaacacgtacacaaggggaaaggtgtcttacattgtttatgttcctgtgctgctctagaaacagaaataggctcaagagcagagcctgtttttcttaattcagcaggtctaagctaacaagtcctgaaacatggtacttcctgttattggtattgcataggagaaacaaagggaaagcacagtaattagaaaatacaaaacaagatggcaggaataagccaaaaatatcaggaaacacaattattgtgaattgggattaaactaatctattaataatgacaactttcagcttggagttaaaaatttaattgtatactgttaacgaaagtgatacctaaaataaaattacactgggaggccaaaatgaagggatgtgaaaagaactatcaggtaaaaactaacaaaaagaaactagcaaagcaatcttaatatcagacaaaatagaatccaagaggaaaatcatttcaaaagacaagagattttttttattaataaggggaattgcataggagagtaaagaaaatgtgggccactggaatgcttagcactaatgacatattggtctttggtcttcagttaccttacaggaccctatttcattctcttatgtttgatatgtaaccacctcagccagcttcaagttgctttttggccctaatggacttcctagcactataatttcttttttttaaatgttttattttaggtttaggggtacatgtgaaggtttgttacatagataaacatgtgtcacaggggtttgttgtacatattattacatgacgcagatattcagctcagtaccaaatagtgatcttttctgctcctctgcctcatcccaccctcctccctcaagtagactccagtatctgttgtttccttctttgtgtttataagttcttaacacttagctcccgcttacaagtgagaacctgcagtatttgatttttgttcctacgctagtttcctaaggatgatagcctccagctccattcatattcccacaaaagacataatctccttcttttctatggctgcataatattccatggtatatatgaaccacattttctttatccggtctgtcattgatgggcatttaggttgattccatgtctgctattctaacactgtaatttctaaagacttccagattctacttttataggtaacctgttaaacagtctagctctggaagccaagcaatttctagaataactaagcaatagaaattacacttcaatgcagaaaggcagtatctacatgagattatgaaattgcggttgctttttgtgttcactgaaaaaaataagtaaaactgtaactttcagaaaaaatgattgtacatatagaaaacccaaagcatctaaacaattaaaataaataagtatagaaagattactggatacagagtcaacatacaaatatcaattgtatgtctatataccagcaacgattcaaaaatgatttttataatagcattaaaaattagacgcttagtaataaatgtgagaaagatgtgcaagaactctacataaaaaattatgagacgttattgagaaaaattaaggaaaacctaaataaatgaatgaataggcaatgtttatcaattaaaggatacaatatagtaaatatatcaaatgtttactaatggattcaatgcaataccaaagtgcccagcaggctttttttggtggtgggaggtcgggcaggattcataagctaattataaaatgcatatggaaatgcaaagagccaaggatagccaagacagttttgaggaagaataaacttgtactacttacactaccagatgtcaagacttattatcgagttacatttattaagacagtgtggtactgacacaaggatagacaaatagatcagtgaaacacactagagtgctcagaagcacacctgtacatatataaaggcttgatttatgatagaggtgccagtgcagtagagaaggaaattattggtgttttcaataaaaagtgataggtcaattagatattcatatggcatgaagtatgaaacaataacaatttatattcataacttgcagaaagcaaaaatttcttaaaatacaaaaagtgatcaccataaaggaaaagattgataaactggactatattaaaactaaggactcctgttcagcaaaagacactacttcgactgaaaagacaagtcacagagtgagacaagatatctgcaatacagatacctaataactgaaccccatacagtgatggtgggaatttaagttcgtacaatcattttagaaaattgcttggcagtatctactagatctgaacatgtgatccagtaattacactcataattataagccagtaaaaaggcatgtttatgtcaccaaaagatatatacaagaatgttcattacactattatacataagagccaaaaactggaaacaaaccaaatatccattaacagtagaatgaataaataaaagctgtaatagtaatacagtggaatactacacagcaatgtaaatgaactactgctgtacaaaacaacatggtttaatctcacagacaaaatgttaaatgaaagacacagacgagtacatattgcgaacttctgtttataattcaagaactggcaagaactgtttactgtgttagaagtccaggtaatggtaacctataaaaaggaaaaagggtggaatgattgggagggggcatcttctggggtattgataatgtgctatgtattggtcagtttagtgtttaaacaggctcatttactttgtgaaaacttacactaaaattgtgtgtattttttgaatatatgttatacattaataaatagggtttttaaacctgtagttcataatttagtgaaagtagaatatccaaacatttagttttaaaccaatcaattatagtgctaccatcatttttatgcattattgagaagtttattttacctttctttccactcttatttcaaggctccaaaatttctctccccaacgtatattgggggcaacatgaatgcccccaatgtatatttgacccatacatgagtcagtagttccatgtactttttagaaatgcatgttaaatgatgctgttactgtctattttgcttcttttagatgtaacatgtaacattaagaatggcagatgcgagcagttttgtaaaaatagtgctgataacaaggtggtttgctcctgtactgagggatatcgacttgcagaaaaccagaagtcctgtgaaccagcaggtcataatctgaataagattttttaaagaaaatctgtatctgaaacttcagcattttaacaaacctacataattttaattcctacttgaatctgcttccttttgaaatcatagaaaatatcagtagcttgaattagaccaattaattttctagattgcatcatattttaaatataaactatgtaatcatctacaacctgaattctttctgtgtccaatttgtccaatttttttctctaacatttatatcacaaagcaattaatttgtgtgatttctgcatatgtatttgtaattcatcaagtcaaatcaatgtagtaatactatatcataaaatatacacaaataattgagtgataggcttctagtataaggacggtaagtttgaagcatgattctatctgggctggctagtttactctgagaaagttattttttattgttgggtcttaagctgagtttacacacttggtgtcagaatgattccggcaatgaactgttttatgttctgctaggctgatcagcacaatctatatggctgtgaacaaaacaatgtttcccagtcataccaaccatgccaccattttaacagctgattagtgtattcagaacatctccactccatgttcgtatggctgttatctaaagatgaaagcagtagacacttttattttttgaaaaatttaggctctgcagggtcaattatatttgataaatgaggggcttttttgaagcaaactagatataatttcttttgcatttctaaagcctgatatcttattaattggtacattaaattgtgcaccatttctctgtaactgtttcagtacctgtctcagcactataccaggcagaagaaattaaagaaagaaccagtgccgagatcagcttggtcagggagaccctaatcctgcggcactagaggaattaaagacacacacacagaaatatagagtatggagtgggaaatcaggggtctcacagccttcagagctgagagccccgaacagagatttacccacatatttattgacagcaagccagtcataagatttactgaaagtattccttatgggaaataaagggatgagtctggctagttatctgcagcaggaacatgtccttaaggcacaaatcacttatgcaattgtctgtggtttaagaacacctttaagcagttttccgccctgggtgggccaggtgttccttgccctcattctggtaaacccacaaccttccagtgtggatatcaaggccatcacgagcatatcacagtgctgcagagattttgtttatggccagttttggggccagtttatggccagatttggaggcctgttcccaacaaaccagaagctaggaatatatatcctgcaaataaaatgaagaatctctaaggcttcagggcctgcccacttgttcttctgcctggttcttcacatacactgtctcaaagctagtctaccttgagaggagcatgaatatgtgtgtgggtgtgtgtctgtgtattttaaccttaaaaacctaacttccagtatagacagatggcatactagctaaacccttacaagttcttctatgctataaaagagaaacagaattgagaaccacctccaactattaagtgttatatttgaatatagccttagctttagcagaataagtaggccaaacttaaaataagcttttctgccttttcaatgataaaggtcccttttctgtagccattgttgattgtgtacacttatacataagtattttgaactaatttcctgttttctcaaccacttgctgtcttcatgatactttgtcgcagctggttgctatagaaatgtctgttacaaggaatgtggcttgaaggaaagtgataaatgaaaatgaaatgtgaagtgactttgtttgactacaaattcccattctggtagtccccagtgtatcaatacattatttttctttagaaaataaaccaacccaaggaaaaatggtgggcaggtcctggtgaatatggctgtgataattatattagcaatctctttggctaatatttgaagcccaaataattgaatcacaatgatctctccccagaaaatatataaaatgcaccttggaatctagaaggccttttagtctgcaaaagaaaccttcttaatcataagcagcagaagtcccatttaccaaattggaaagttaaagttacaaagcatcaatcataagacttccattcagggatggcaattgggagtaagactttttagtaaagaaactaaacacaaagtcattagactctgtaaaagtcttaccaaatttgattctggaacacctattctatttccgtaaagatgatgaattccggagccaaatgttcttttcatgaaggatttgaaaactgtccatgaaaataacgcaatcaaccttttagcttgagactctattcactgattagatttttttaaatactgatgggcctgcttctcagaagtgacaaggatgggcctcaatctcaatttttgtaatacatgttccatttgccaatgagaaatatcaggttactaatttttcttctatttttctagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggtactttatactgatggtgtgtcaaaactggagctcagctggcaagacacaggccaggtgggagactgaggctattttactagacagacctattgggatgtgagaagtatttaggcaagtttcagcactaaccaatgtgagaaggcctccagagatgagcagttggtgaaagagaggctcaaaaccagctaccatacaggtcaagaagaatttggcattaaggaaacagcatagcaggattccagacaggcaactggtcaacaacatgaaggtctggaagaaaggtcgcaggtactcaggttcagggcactacttcagcttcagcccttgcaaaaactggtgagagttggaaagtctttaggctaagaaaaattggattatttaaaagggggtaaagaaagggactcaaggaggaaggattaaggcaagaactaggttccaagaaacagggcatgagagagagtcttgatctaccactatagttctcgtggtagcatcagaatcacctgggaacgtagaaatgcaaattctcctgctctacactagacctaccaaatcagaatatctagggggtggggcccagcagtctgtgcgcaaacaagcactgcaggtgattttgatgcacattatagtttgaaaactaggccaggtgcagtggctcatgccaataatcccagcactttgggagactgagacgggaggattgcttaaacccaggagtttgagaccagcctgggcaacacggcgaaaccccacctctaattaaaaaaaatacaaaaattagctaggtgtgatggctcccacctgtgctcccagctattcaggaggctgaggtgggagaatcacctgagcctggaaagtcgaggctgcagtgaattgtgatcacaccactgcacttcagcctgagtgacagagtaagaccctatctcaaaaaacagaaaaagaaaaacactggcccaaaggaaatgaacttgttacagaagccggggttcaaaacaccaaataatgcacttgtacctagtccttcccgggtgctctgcagacatttctccaagcgtagtctgcaaacaacctacatatgtagaattacctatgcacatttttcatttaacaaccaagagctacatttgtagcaaaatctgggttgtaacttagcctacagctgaagcctaagagattccgtctgtgagaagaaataacccacctctttggcccccctccccaggcaggaagccaggatggtccttatataaagttgtgctgtccaataggtaaccactagccacatatggctatttaaatttaaattaactacaattaagagaaattaaaaattcaattcctcaattgcacctgccaaattttaagcacataacaaccacatgtggctagtaactactgtattggagagtgcaagcggagatagaacactctattactgcagaaatttctattggatagcacttataatagtttagtgtaacttaaaactccctagttgccacagtcatgatttagtagtaatttcatggatttctctactgaggttagaatctctgccattagagactgataaatttaaagtttgcaattatcaaactggtgacaatttaagccagaatcaggtaaatgtcctcagttttaacagcattggaattttctgggactagctgtgtatctatccaggattcttgagaatgcctgccatttttcaacataatggatgtaaggtattacacatatacctggggatggggtggtaggtataattgcacaagcattgtggagaatggtatcaaagagtggcagaacatcacaatcaaggttttccctttcttttacctttgctttttaaaaagacaatatttgctggacctgatcttataactcataaatgggacactgtatgttcctttttacctcctctgtttctacttaattgcaccctatgaggactgcttcccttacctaccataaccccttccttcactcatccatatctttactcttcttcacaactctgtaatattgaccttctttatgaacctttcctggaacaatccctcttaagtgcaagcactgttattatgccttcaatgtatttaatatccatgtatctattctctctaattttgtcattttgtgttctcatgtattttcattcattatgtgtccaacttccatggataacatggttacaacaaaagatcctactttatgacaattatcttccttgggtttgtgggacatagaacagtgctcagagtaggggatccaagaacccaggagaatatattagctaagaagataacttccgtttttaaaagtccaagattcaggagatcaaaaccatcctggctaacatagtgaaaccccgtctcttccaaaaatacaaaaaattagcccggcgtggtggcaggcgcctatagtcccagctacacgggaggctgaggcaggagaatggcgtgaaccggggaggcggagctggcagtgagccgagatcccgccactgcactccagcctgggcgacagagcgagactccgtctcaaaaaaaaaaaaaaaaaaaaagtccaagattaaaaaaaaaaaaaaaaaaggatgtctgctttgtgagtttagcattgtctccttgtcattccagaaatgaaatggcaaatacatttaaatcagaactaaaaaggggaacagggtataaaggctcaatttagtcacatcatttccgtttctcacccaccccctttaaaccagatgtttgccaatgcattaacaatgcagatgtttcctgaaagaaagtttagtaactcaagcagacaccttattttcttttcaagcagaaaagactatgagatggtggttgtggttgttccgggagggagaagatataaatgatacacattatttcaaatcatttcatgacctcactgcacacttatagttattgtacctgttgtctttttgctgtcaagcctagctaagatcatttggaatgttcaagatcactcatacatgcatgtgcacacatacacatgcacatatgttcactccctatttcatccacatgaactaagattactgatgtgtacagattcaaagcacttttattcttttccaaaggcaagaagctgagctactttccagaatagttgtgaaagaccctgtcatacttctgcattgtttcctccacaccacctccatccagttccttatgaatggttactggttttcaaaaatatgagataaattgagtgtataaaagtcatttttagacaaaatgaaacaggaaatgaaagaaaccagaatctctcctcatttgtggatgggccagctccaccatgtcatggttaatctgcagggaggaaatactagatttgattgcagatcagactgcagcaaacctgctgtgactaaggcatcaagagaaagcaagcaacagctggggcttcagtggtgaaaacattatatatctagctttgaaatatgaaatactgtttagcagtgtcacctagaaaagagtgtttcaaaatgctgatgcttcataagaacctttctcttcagagttgtttcttttatctttcaaattagccagggtgggaaataaagtgatcacttggtgaagaaatctcacaaagaagaacatagagagttcactttcatctggagtaatgaacagattgaacaaactagaaatggttagtctgttaaagaaaaggtgtaggtgagctgtttgcaagagccacaagggaaaggggaagacaacttctttgtggacttaagggtgaaagttgcaagcaggcaagacgattctgacctccattaagaaagccctttccaaccaacaaccactgggttggttacgcaggttgggcagcattgggagcaaatgttgattgaacaaatgtttgtcggaattgttgacttaaagagctgttctgtcactggggacagcagcggctagatagccccattcagggagagggcatttgttcacctggccagagatcagagcaggctaagggactgctgggatcctgtccagctttgagaccctacagagccatgttcacctagcacgtatcccgtctgcggtcacgctcatttcttaccttattccagggctttcacctcagcttgccaggctggagccaagggccaacgcagccgcgccttgttcgcgatggtagcttcccaggagccccctatggttccggaacggcgctgccggccccatcctgtttgctacctcctaaagccaaaggcactggcgggccgggccagcttctaaagtcgcgcaaggttagaaggttccggacaggaacggcgtgaggccaatggaaggaggtacttcagtttccctccagatgcccagcgatgggctcagagctccttgagaactcgggaaaggaagcagggtctctgaagaaatacttcaggagtagaaagaggaagctagagggttaaatgcactacacaggaacagaaatgagtttttcttagagttagtatatgtctagaggtgtagtaaactaaaacaagtcttgaattgcataccgccacgtagggaagaaatgaaaacctttgaatattagtgaaaaaagggaaactgcaacgcctgtattactagatagctttcatcaacagctcaaaaccgacagatttaaagaagcaacaccgcattttggctttctaaagctttaatttggtttggatcccatgcccatgaccctgccagctgacaattctaagcatgcgcaaactggccccaaaaattcctcccacatttccgaagaactatttggccctttatgtgaagtacctggtttttccattttctgttttaccataggcctcagttcggtgtgtggcgtatttattctacatttaacaatttgaagatcattctattagattaaaaaaaaagaatacaatggaagccaagtgattaagctttccttatgcttatattaagttgtagcatatgcatttaccgatagttaaccgtattaacctacagaaaatgtccagggaaatggtctatttcttattctatttttgacctaaagaaaatctttaaaatgtcttagcattttccccagtctccatccactttcctcagctttggcctgaagctatctttaaaggtaccctgtacagctcttgccctgtacagctagctacagagattcaatcctttctgttcgattaggacacatctcagtggcagataacatgcaaagttattatatgtatgaaccagaacttgtttttccttaggggccaggatgttacactaaggtcttaagactatagtaatatcttcacttgaaaaagccctctattattcctatctcagatgataaaaattcaattaagagaaataagaacgtgacatgtgtaatcgcacctggctctacaaagctagtctggacagacatttaaacaattatcctctaagattatttgatgaaatgcatttcaatgactagttaaccattaaaaaccaaagtgagcatcccatctgttcccagtcaaatgacctagagcaaaggactaggcaaaccacatctgtgggcatagcaagctgtacatcacaaacaaatgaatttgctttgtatatgagtgagagcaaacactctttattgtacaacttgggtgggtaagtagggagaataatggttttactgaaatcgcaggtaacggttacgttggagttaaaggttaggaagaaaaccaaagggtaagagctgttgttctgggctggcattgtcaatgaagagcataaattcagatgtgaatgtatattttgtagaagcatgtgtgttgttggtttttgtgtatgtgtgagtctgaaagagggaaaacaggctcccattagactatgactaacaaaaatgtttgacagattataactcagatgtcttactcagagcatatgccttcccattttccccattattccccaacatgatgtctttaagaacttgtccttgaccgagcagacatctcataccccaaatagctaatattttgatagctatgatcctgaacggccaaacattccaaaaccaagtagtttgtaatatctttaaatgcaaatatattttaggccttttccttggcaaggatgtttggtcaggggttggcaaaaataatgctcttcagacttaaaagaacacaaccatatttcttagccatccaccagaaagtagtagaagctccaggaagcaagtctttgtcaggagtcagactagctacatcataatctctctgcccaggggctgtggatgtcatccatcctggcctaactagcctactgagctgagagatgtccaatttccccccaatacactaaccagaggagaaggaccgtgatatcattgcatgtgaattcttaattccaattgcttaaacaaatatgttcagttgtaactatcaataccagtatataacagtgttggccaagttttattgatgctgacaatcaattggagttacagccagacacatggtcttatgaccggcgtacttacgcagggctttgcactgagacaggtcgtgcatctgaggtttactgctttgcatttttgttttgtaactgaagtctgatgagacagccagagcatgtgctacctagggacttgaatccctgcagccccatttcacttctcaccaccttccggggtggtttctcgacctcccactcccctaccacctggtgccttagccagccctggctctccctccaaacacctgcccaatgagcactgccaccccatggtgcccagacatgctctccctcctcatccctacctagctaccattgccactcccctcccccagcggggacatgggcataggagcagggagagttaaggttggtcaggtgcacgtgccctatgctatcttggaagggggcttggccatgtggcatctctggaccaagaatgcgccacagcacatttggagggtgaatggtgggggcacaccccttgtccacctctatttcaggcatggaacacatcctggcatgaaagttgcagtcccttgggaatcacctctccaccttgattgccacagtaggccagtgacaagggaagattgacacatcatcccctgctggggcccagtgtcctgtggctggcaggcaggggatcctaaggacatgtgggtgttaaattgtagggtgcacttcctgggcacctttgagggtctgcactgccccagcaaatatccccatgctagaaggagcaaaatattaaatggcaaattttaaaaatgtaacaagatgggttgcaaaagagactacagaggaaagcaaaagttttgtattttagtatcttccatggcacttttcttcctagcttttgaacaaggggccccacatttttatttctcactgagccccacaaagtatgtagccattcctgcccggagtgaggacttttaaaacataaagattatcaagtcttggaaattctgattcagtagatatataacaggtctcaaacttaattatgtaaagaatattctggagagcttccttttacccagtcccacccaccaaatattctgataaattaagcttcgattagcccccagatctgcattttataaggatccccagatgattctactgcaattggtccacagaccatgcctggaccgaatttgggtgcttaggagcacaaattctggagccgggcagacttgagtttgcttcctagctttaccaactgatctcaggggagttaatgtttacctctaaactttagctcatgcatctataaataaatatattaatatcatgtcataaggatattatgttgtattaaatgtctttaaaacaccacaatgattagcccaaagtaaacactcaataaatgttcaaaaatttaggaaaattgttaagactgggttgtatgcacactggtgtttattatattatgtagttttttctgtatttttacaacatttcagaattaaaagcaacagctagaaaaagagggaaatggccgggtgcagtggctcacgcctgtaatcccagcactttgggaggccaaggcgggcggatcacgaggttgagagatcgagaccatcctggccaacatggtgaaaccccatctctactaaaaatacaaaaattaactgggcatggtggcatgcgcctgtagtcccaggagaattgcttgaacctgggaggcggaggttgcagtgagccaagatctcaccactgctctccagcctggtgacagggcaagactccgtcaaaaaaaaaaaagagagggagagccagagtatgaaaaaggaagtcagagccctttaatgagtcagctttgtaggtctccaggtaggaggctagtgcttcagtgtctaggacatagtaggtgttcagtaaattaaattcaggacaaaaagaacatgccccaaggaccatctgatatccacttaaagtgatggactacctcgtttcccttgtttatgaatgggttcatgcctaagactgtgtgcactttaatacaagggcagtcgttcagaactagtcaggtcctgaaaaggatttaccaaatgttgagtgtgccctctagtgttcacacttcccagctttcttcctataaaggtggatcaaggcacttgcttacaactggaactgaaatcctccaagtcgatctagacattgagatggagaaaatattcattgtcgactgtaattatgcaacgaatatccagttgagataatggacttgcctcttatctaataatacccaggctcaatgcgtcactgctttgtccactttgcccaaaattcaagcacagctaagttgatattttaggacaaaggcagcttactatccagccagaggggagtagaatatggttaagagagagtggaaagaatgaatgagccctgctattcctcactgcctggatggctataagcacagcccttatggaggccttaggtcttgcttcataatattccagtttgaaaagggtttgaaaagacctcctagaaaaatcagtagtttttctcttttgagtaacatgtagcaaaaaaaatttcatcatgtaggtacagggaacaccctaataactattaatctcaaggagtcaagccagtgtgtttcctaatgtatctgctgtatccccatgaagcaaattttgccatcagagaaactgactcatggggaaaaaatccaaggacctcaaatcaccaaaagaagccattcctcagatttgcctaagcttaagcttccctgtctctcattgtgtgttgctttcaatgcagttacataaatggcttttttgtttatgcaccaaaaacactaattcatctgcaaagctcacatttccagaaacattccatttctgccagcacctagaagccaatattttgcctattcctgtaaccagcacacatatttatttttttctagatcaaatgtattatgcagtaagagtcttaattttgttttcacaggttgttttgaatggtaaagttgatgcattctgtggaggctctatcgttaatgaaaaatggattgtaactgctgcccactgtgttgaaactggtgttaaaattacagttgtcgcaggtaaatacacagaaagaataataatctgcagcaccactagctctttaatatgattggtacaccatattttactaaggtctaataaaattgttgttgaataaattgggctaaaggcagaagggtcataatttcagaacccacgtcgcaccgtcctccaagcatccatagttcttttgatatacccctattatcactcatttcagtgaggtacaattagttcttgatgtagccatttccataccagaaggccttcccaaaaatcagtgtcatgtcaccgatccttttatctctggtgcttggcacaacctgtagcaggtcctcagaaaacaaacatttgaattaatggccaaatgagtttgtgctcaaaaaaggggtgaggatacttgaaatttggaaaatctaggataattcatgactagtggattcattatcaccaatgaaaggcttataacagcatgagtgaacagaaccatctctatgatagtcctgaatggctttttggtctgaaaaatatgcattggctctcattacatttaaccaaaattatcacaatataagaatgagatctttaacattgccaattaggtcagtggtcccaagtagtcacttagaaaatctgtgtatgtgaaatactgtttgtgacttaaaatgaaatttatttttaataggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccgtagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcataccttggctttttgtggattccattgatgtgaatcagtcaccctgtatttgatgatgcatgggactactgacaaaatcactctgaccccgccaagctgctgccttctcctgccccaacctcacccccagccaggcctcactcttgctagttcctttagttcttttagtcaatatatttttgtcttcgcatataagtataaataaacatatttttaaatttcttggctgggcccagtggctcacgcctataatcccagcacttctggaggccaaggtgggcggatcacctgaggttaggagtttcaggccagcctggccaacatggtgaaaccctgtctctactaaaaatagaacaattagctgggcttggtaatgtgcacctataatcccagctactggggaggctgaggcaggagaatcacttgagcctggggagcagggggtgcgggaggttgcagtgagacaagatcgcaccagtgcactccccatcctgggtgacagagtgagactctgtctcaaagaaaataaataaataaatacatttcttgaggcgtttcttgttaaatcattcatggagaggcatcccaaacactacattcaacaaaacactctgaaaaatgttttcaaatgcaatataacacagcagagatttgatgctctgttatccagttttcatataaggcagtgtgagctgtgtcccagagaggacagtggtctgaatccacctgagacagaattgggtctaactaactgtgagtatggccttcaataagtcactctccatttgggaatttgatttctccacttctataatgagagtatttgacaggatgctctcccaaatcccttgcaattttgttagtctgtgatttcatgtttttatttttattccttcatccaacaaatagtcaaggagtaattgctgtctgccaaataccaacagtattcattaaattgtaattcagattttatatatatataaataatgtataatgtgtataaattgctttgtgagtgcctactacactgctagacagtagttgctcaataattgttagctgaatcagaatccatgtttatcccagagtagcaattagtcttgcatcgagtatcgtgaaagaaggccacgcttaaataagaataatgcctggggtttaggttttatgaaaaaatgaaaggaaattagttctgcttttgttgactaaaggaagggaagagagaagagactataattgtctgcctcagatttaaggaggaggctaattcatgcattaaacacgttacttcaaatttgaatgaccaaaggtctgtagcctcagcacttcaaaattggtaaaagtaagacactctggccttgtttccatagagaccaccccttacaaaggcaccaatgggaaactggcctcaggactcctgttattggtcttctctgtggcagagaaaggagctcttggacccataaatctctgagccacagttctttttgccatgggctcaaaaatgattgaattcatcatgagccacctgtggcatattgccaccactaaacatgtggggcctttaagctcactaagagccaatgtcttcagagccagccctggcttgattctacctagggcatttgcagttgccatataagaatcattagtgctttcaaaattactgtagatactttgcctaaatagactaaaacatgctgccgtcatattggaagtgacagattaaaatagaactcttgccaagtgaaggaaagtgtgctaatataatgcagtcattttaacttgctgtttaagtgtgattgtttttagttcttttgaatattatttgttttatactgacaggaacgaagtactgtccaattttctctgccaaggaaaaaagaaaaggtgttcttccttacttacctgaaccaaaacagaccagtttacaaaattgcctaattataattgctaaacaagttccgaatgcttacagtctaatccaagaatgtcagagctgcaa

SEQ ID NO: 16995 - DNA, 83665 bp, Human
tggatacttgaatagacttgaggtgttaaaactctcgtctaccttgtcctcccttttcatttgggaaagccaaaagcacaaaagagtaggtagaaaatgtcagaccctttggcatcattctcctgtaactatcagtctcaacccactgcaacctttaccccagtctgccttgcagacacacagtggtgcttctgatggagcaagagacatttcaagattggagagaagtggaaggaggggtagcaacagcttcccctgtgaagcaatggaatctacagaagggtccggtgattcagctcttatgggctaagaagcctgaaagcatttcagtgttgctgagtccgagcttgtttgttgggtagtcaggcaaggaaaaaagggctagagtctgaagataagctgagcatctggttttgcatctacattagttctgaaaagaggtgatgggggtgccatgtaggagtccagtaaagacggtgtagggctgccaggtagtagagctgctctattttgcttcctagttggcctcagaaatcaagtaaaatagtcaaataattgtgtctgtttgaaggtagggatgtagacaggccatttctctttgctgcatttctggcctcaaaacctcttctttcttttcctccagaataaaatataacacagggagaggacagaacttgttaatagactgaggccagcaaaaagccagactggttcctgaattggagggaaggaggctgcctgactttggaggagcagaaaaaaataagttaggagattagagatgggccacagcttaaatagagaggttcgactctgcatttcccaaatacgtaatgcttacggtacacgacccaagctctctgcttgaatcccaaatctgagcggacagatgagggggcgcagaggaaaaacaggttttggaccctacaaattggcttgaaatgaaaagtcagcaaaaaccactgggtggcagcgtggtgtgcgggcgcagctctgcagtgtctgcttctgctgctaccgctggggctgaacccgtctggggactctggcctcctcccctgaatggctacaagtgtcgccaagcaaaatacctctgcgcgggtgggtgagggttctccgggttgttggtgcgtccaagcctgaggcagggatctggcgaacttctgaggggctccagcccgagcacaatctggtcagctcaaacactgaggaaacacccccaccactccatcccccaatgccgagcaaacccccgctccgtcagcccaactacctcatctcagttcctcctccatcactgtttcctcccgaagctcctttcgggaaaaggaggggagaaggatttggacgactggggcagtgcggaagcccctacaggtgttagccggaacgggcggccggggacttgggggggtgggggtgggggtgggggtgggaggggcggcctgcggctccgagcctacgggctcagccccgggagggaggggccgtcgcgggagggggctgcaaggaggctgtcgcgctgttccggagggtgcctgcggcggctgaattcctgtgctgcgactgtgccgcgcccagagcagcagcaacagcgaagatgcgaggccattacctgtttgatccctgtcggaaacctggcacgggccaacttttcccgattatcacgccaagaagttgcaaggactagtcgaagactcggaggggccagggcgagggcgcgctcccccgcgcgctgcctcgtccctcctccgtccggccgcccgagctcccggcctctctcccgcccgcgctcactccctccgcccgcctccctcctctggcccccatcagaagggcaacagggcgagggggtccggcgaaattcggaccggagcagctggacatgcacggtgtccgccgggcgcaggggccgaccacacgcagtcgcgcagttcagcatccgcgtgccagtctcgcccgcgatcccgggcccggggctgtggcgtcgactccgacccaggcagccagcagcccgcgcgggagccggaccgccgccggaggagctcggacggcatgctgagccccctccttggctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccaggtcggaaagggcttttgctttcttttccccatactttacgagtgaggtgggggcggtggggagcaggtatgtagcataggtgagtttgttggtggcccatcttgtgcagaagaggccacctagcctgtgtgcgtgcgtgggaaggcgctggctttcttgcctccgtaacagtaacacgcttgctgcattgcaactgccctgggacaggcgcagagcctgggggcatactctgccctgggtggcttgccctcagcttcggacatgtcacatatgtgcatgcccggtgggctctgggcaggcgtgacccagacatggctgtgatatgtatggcgtggaaattgcaggcgcagagctgggcagacaccatcctcccgtccccaggagagcctggggaatccctctcttgcttttatctctgcctcagacccttcccctccagcttccacctccaagggatgtgggcttctgctgtctaggcattgcgtttctttgatgacttttaagctttttgggacagacttgacttgtggtgcagcttcgaaatgtttgctggggcggggggaggggggatttctagaaccttgttgcaaagagctgagagatttggttagacttagtgtaatcggttacatgctactaaaatgcggtgttgaagaggggatttaagctcatacccagactgtggtgcttttgaacattttcagtggtaggagtagcgcgatattccagcgactggaaattcagctctaggtgtcaggttgcgtcaaggcagaccttcaggcgagcatgcagtttatttgccattcttaaccaaatgaatcttttacactcttttctgccttttactagataaatattacaaaaaaaataagagtcaccgatctgttatttctccatttatgtgtgctacaccctgggatggaaaagcagacataacgttttctgtttgcacaaagtttttaatgcattaactgtaaattaggcttgtttcaaaaaggcttaagtggttgcaaagcatgcttatgtggctcgaataatcacataaatattatttcagcgcaggagtctatattcagtaaaagaaaattttggataacatggctgttattggtaaatgagacacttgattgatctatggttattcataattgaaaatcattttaattaagaactcatatttttgataatcatacttctgatatgaaatttgaaaaattagtatgcactgattttttccttcctaccaacaaaaaccctgctcttttcacacacattttcactaatgataattaatatgacaagatttgttaatggtggttgtatctccctcctcccttttttggtataaaaggctcaattttccaaatacagtttccttaatggggttccacgttatttatgcattttctaccttcttagaataaaggagattatttattcaaattgtggtcattctgaaggaaatctttgctagtgggtttttggtccttggtcggttggcagacaactctgaattatctttctatttctccttttcctttcacatgaaaagtagcacaatttcaaaaggcagaatagccatttgccaacccattacaaatactcagtgagatagagttccactctgtaaaccaaaggacaggttatcagaaactatagacactttcagaagctttaccaatgtttccagatagaaataaaatgtttctttagtttgaaaatttattctgaaactcagagtttgttttctttcttccagacaccttaaaagtgtagtttgactttttccattaagatttgtaaatgaaattagaaattgaaattcctagtcttttcaactacataggcacaatttatcaattgatccaaatcattgttctctttgcagagcctcagcttaagggtatagttaccaagctatacagccgacaaggctaccacttgcagctgcaggcggatggaaccattgatggcaccaaagatgaggacagcacttacagtaagtgactgcaaaataaatagtatatgccagcatgttgttaacattctgtttttatttattttaaaaataaatacgctttcctaaatcctgaattaaatgcaaaatatattcacactacataatcctgtttacacaggttaacctaaaggaagttgaatatgagtctgtctaagatagtaaactagggcaaataatgttgacaccatctgaagaataatccaaatgtcatctccatggaaatctagatagatttatggctatcctttggattttattacttttttcccacagaaaatttactcacccacacactgatccagaaatagcatgttatctctactcttaagaaccggtcttaacccaagagagaggagtggtttcataccatgaaaattcatcattacaagctttcacttctgctccctgctccacacacacactgataactctgagactagtggaattttaacattgagatacctccgcaggtgggtaaagggatttcttttagttctttctttttaaccatggtttcagaccaaattggagactataatggtgagcctaaaaaagaaacacataaaaaataattaggttttatttccaattactgaaagaaggtgattccaagatgttacgtaacctttaattacatgttttatttattaggagtaataaaaatataaactcacaaatagtgcaggcttctcctcaatgatgattgatgttttcttgcaatttacagatttctggagacttactaaatgttccacaaggctaaaacacttagttctcacaattttttttgttttctccaatttctactgaatttctctcaaaccctttgataatttcgcattaatattccaattgtcggctgagaaaataaccaaggaaactaggtctgaatgctaagcagtatactctgcagctttttaagagttgtatggctacagcaatgccattgacgagggtctcaataagtgtaaagagtttcccaccttttaggaatgcttcgtgggctgatggccgatctataacctcgagaggaagtcacttttaattaccattgaagaaagctttgttggtatggaggatgaaaaaacctcatactgaatggttcttcactgttttgcaaaagttctatgtcactgttgtgatattaaagttttatagtaaatcctagttgttcttttatgcatagtcttctatttgaaactattaggcaagtgtaactagagggctttactgtaatcaaataacagacattagtgtatagtgatcatctgcaataaaacattcccataagttattgtgcaaattgatatttggggaaggaattaggggatgtaagctgccctgctttccagagtgcctcaggaaaatgggtctgttgagcattattgaaggcaagttcatgattagctgccagtgagcctatccagtcacgtttctttcccctttttaacatctccgggtacaaatcagagaagaaatattttggatctggtgttcacatgtgtttcctgaaaagaaataaaaaaaaagtagataattcatgtgctgtgtcctatgaacagcaatataccaaattcatcgagatcacattctaagtaatcattttaagagatacacacacacacaccacacacgcatatatcaaggctccatttcttactgtggagctttaaatcatacagtaggttttactcttcagttcctacatatgcatagcttctgcctttggttgtcttataactgactgatacgcatggcatttctgtgtactactaatgatattgaaagaccattaaagaacatagcctgataacaggaatctgtatttaggcagattaaaatagagaggtaagtcaactaaaggtaagtattgtcataacctgatgcatacaaatggaaagtatctcaatagaaatagcaagtcagtagagcttggatctgctcctgatgttaagagtgaccagaagctagtgagctagctcagctttgccattgaggatattgtggggcataagccatcatgaaacaagaaggtttaatgattaaactggtatatcatgaaggccagctatccaaatgtattctttttttttccttaaaaccaagccgttttattggtattaattgtttaattgtgcataacgagaatacaagttgtttttttcaactatcactcatgtatataatatttccctaatatgtattcgtgatactatgtttatatttttcttactcttcttatttttattaaccttcattattttcagcatattttctcatttagtttaatttgattgaattgcgttatttttattcagacatagtaagcaatgtcctgataaatcagttcacatttatccagatatatccatttctgaaaacatatgtttgatattatgcatttcaccttaccttacgtagatttattacaatgataaatgtcagttcaataaaatctcatcatgaggaaatcagccattgtaaattatgtattttcccttgaaaaggaaaagatgatagacattccatggcagtaattttattatgtctgccctgggtgcaaggaaggacattttaaaagactagttttccctttctcttcaaactcaggtagcattatcagttcaacatgttgcctttccaacctacgttaatatatactttcattaattattctcttttgagaaattgaccttggccaactgatgaagaagcatggcttcagtgttgccttcagcaaacactgggtgccaactaggtacatggctctgattaagtggcccttcaaatagaaggtgtttgtttttatgcagacataacagagaacaaacaagaaacacaggcacatttatgttttaaaagcttcttcaaaactttcactgaaatggaagaagagattttaggtatttaatgaatgtgttttaaatccataaatgaagtcaactgttttcttctcatgtttatagtatttttatcctgatcaaaataatatattaaatccatgaggaaaggtaccagatatagagaaacaaaagcacataggaggatatttatttggtttaagctcacccctgatataatttctttgcatttttatctgggcagactgtccctttagacatattttaaacaaacccggtttatgatctatcttgaatgtttaaagaaatgaaaagatcgtagtagtatgatcagtcaatccctagattcgctactctcaacaagtttttattttggggtgatgttttttgttttttaatcaggcttcatggaaatttaaagtacatagtgaaaagtacatagttttgctatatagttaataccattattcaagattaaataatcacaggaatgtactgctgatgtttttttcttctattcctccttctgttttctgatgtttgaaatttagacatttcattgctcattaaaacctgagtcagagtgattggagaacacggtgaaaatcaaatcagttttttttagtctctctctgtttctttcttgtgcttgttataagctgcattaagagaactaagaaagttcataatattattttaaaaactgaagttctataaataattctgaatttcatttatcattctctgtcatttattactatgactaaactaggtgtcaagcatatactgatattatagttgtcaagtggtatgtagtgatatggcttttaaaccaaccccatgttggaagttttgctttagttttttagatctcagattttttgaagtatgagcttttatataaatgggattgtggtctcttacttttcaaaaacatagtatcatattttcaccatacagattgctatcaatccacaaatgggtgttgaacacctgctgtgaacaagacatcgtcaacagaaagggatatgacaaacatgacatgctcagagatgtcagacttcttgcctgtgtattgcattgtcaaatatagcatgagatcttggcttgcaatctgtgcaattacattcctttacctcacataacagaagggcacagcttttaatttgatgagtattgaatgaagtgccatcagtggcatgtggtaggaacacttgtcttttgaaccgtacaatatgtcctagctcctctttggtaacaccctggttttaaaggaacgatacgttgtaggctcaccaaggaatatttaggtcttcattagtatttctcatccatattaccccacctactgcagcagaatgtatatgcacagagataaacgatcccagaaaaactattcttacccacagggtgactcctttacattcttgttcacagaaaccataacagactgatttattatcctcaataaacttacaaaacaaggcaaaatcatcaacattggtctacgactcctgagagaaaggtgcacaggctattttcaaaagatgtgtgtggcaagcactacgttttaaaaatgtactgttttatttttattcacagtgtgggagggagtagacagctggtagtgggaggacacccactagttgtctccagtgagtggtgtgtggttgtgaggaaagcctgggtgtaagtttcacgcagtcagatcttcaaatggagaaatgaagtcctcactggcaccaactggctgcccacttgcaactattttgctaaaataataataataaaataataaaataaacctctttcaagttcattatttttattcctatgtcctttgttcttggagactaaaagctaggagccctctcaactctaatcttggaaaatgttggtcctttaagaaatactactctgaagccgggcatggtggctcacgcctgtaatcccagcactttgggaggccgaggcaggcagatcacctgaggtcaggagttcgagaccagcctgaccaacatggagaaaccccgtctctactaaaaatacaaaattagccgggcgtggtggcacatgcttgtaatcccagccactagggaggctaagacaggagaatcacttgaacccaggaggtggaggttgtggtgagccgagatcgggccattgcactccagcctgggaaacaagagcgaaactctgtctcaaaaaatgaaaaaaggaaatactactctggaaacataggactacaaaatgactttttctttttacaagacctgaatttattttggagttcttgtatttggaataacacagataatttagatgagggcattggactcttctaaaagtctaggactctctacccaacaggtagattttaaatatgactgtgagaatttcagcagttatcttggggagcagtttaaaaccttaatttgttgagaatgacactatttaatgtacagaacaattcttgggactgtatctttccagaagcatcaagattccccacctccaacactgtaaaaaccatgaaattgtgaccaaaagccttccattttctccaggctgttaaataatatgtagttacagctccagttacctggctgcaaccatgaaattaaatacactaaaaggtagaatgagacctatctgtctgcctcggggtatgtgtgggtgtgtttgtgggggtctgtatgtgtatgcatgtctacataaacagacatatatgcataccctcaccaactacacactacttttggaggaccaggcagtcctgctggaaacattgaaaagttctgaaattcagaattgtaacactgttttcattttcttttttaatttcagctctgtttaacctcatccctgtgggtctgcgagtggtggctatccaaggagttcaaaccaagctgtacttggcaatgaacagtgagggatacttgtacacctcggtaagcttttgactgtgtgcatgttttgactattctagttttcatccaatatgaaagaaaatgtgctttatatgtgttatcattacagatttctgtgatgaggagaagaatgttgatggaaatatttcattgaaaggacagattaactttctgtgaaaaatatatctattactaatcagttatttgaagcaagcattttagtatataatcaaagattcactgaacattttttaatacagtgtcatttgggtcatcttatgtagcatataatggtctgtcttgctgccttgctttgcagctgtgggaaacaaagtcatttctataactcagttgaacatatatttatccaggtttactcctaaaaaaacatgagatctctccctcagatcagctcgaggacatgaaaaccagttcttgaagggtttctagagttctatttcttatcttcagtttaattgaacaggattcctgattgcttctgctttaaatataagcactatttaacctttccttacctataaattcctgcttgtctttttcttgtaactttggagtgaacagaatgaaaaatggaactttttctcagatgaatgtataaacaatgtagattacaattcaatatggaacatggggccaaattaaactttaaaaaaagttaacatttagatataagcaaaatgatacagtattagggttaagattttattcttattggcagatctagtttcagattataagagactatttgatatatgaatttttattttaacttaattaattaattaatttatttatttatttatttgagatagaatcttgctctgtggcccaggctggagtgccgtggtgacactccatatttttagcagagatgggtttcaccacgttggccaggctagtctcgaactcctggtctcgaatgatccgcctgccatggcctcccaagttgctgggattacaggcgtgagccaccgtgcccagcgtaatatatgagtattttttaaatctttgttttgaattcatgtattttaataaaggaaaagaatgtttaaaatggagaaaattgcttgtcgaacttcttactagcaagtcttgaagcaggttgttagtataacaataaaaatctgttcctcaaacttcaggtgaaacactacctttaaccactcttgcttgcttgtttcctgaatttctttcaaagccaggtgtgcaggaagactcttggcagatatggtggaaaccatatgataaccctgttttgcagaggccaagatgggaaagaggtgggaatagagtaaggccccagagggcctgtttatttggtaaatcaggtagtttgtttcatatgatgagaaaagattatgaaaaaaagagaattatcagcatatacctcaaaccctggtcactatcagttttcctatcaggcaatttcagtggtctggttgcttaataaatatgggggtttgctctttttactaaatgaaaaatgtgattttatggcaaagttcatgaaatacgtcattttattactagagtgctactataaaagataggaaaggggattttattttagatttgtgtactaaggtaagataatttaataatgaaggattttaagtaatttcctttagatcaacagactgcctcagcaggaccagatacaaaggtaggttttttaataaaatagacgctttctgaaaatattgtgaaggcatgataaggaaacggaatatactgggcatacttttgagaaagcacatgccagatatcatatgaaataattactgataaatcatccagaatttcaatgggttgcagtcaccgttatggtgccctgatgagaaaagctaactaaatataaattttgcaacatcacaattgaagaacgtactttggaaataatatttaagtaagaatgtggaaaattatttaacttgggttatatgtcaggtgcccccactcaagaaaattagggcactcagcattacacttaaggaaccagcgttgaaaatgcatagcctaccattcaaattaatcattattccagcaaactggtaaatgtcaatgtgagctcatttctagaaaggcttcccagggaaatgaggactgtagattggtgaacttcctttccgtgatgggtgggccaatatacatccaaatgtggcacatcttgtatgtatttcctattaagaaaaaagaagccttaagtaagtgtttctattagagaaaaggaactatgtttttgttaaggaggaaatatgcctgcttgatgatcctggagttcatatatggaaagaatatccaaattagtctgctccaggaaataaatcagaatcctctttagaattaattttccaattcttccaattactccttattaattgtggctgggaatccattcaccaagttgatcaccatcctcagtgggcacttcattttgttgtcatcttatttaaagtgtggtgcccagattacttaggatggagttctatcctaataacttcagcaacttatattgctgagatcaaaagcttaatgaaatatcatgtttcatcaagaagagacagcaaccaaagaggaaggatcactcttcccttgcgtaaaaccatggcacttctactacaaaatgctatatgcaattttgcaaagtgcctcttagcaaagagaagacagaacaggacaatgacctaaagagaaagcaaaagtaagcaaaggaggtaaggggctactgatgtgggcaagttaaaaaaaattggtgagggatgactacagtctgcttaaaaagcagttgcagtgggaatggctaaaaggagatggattgctgagatattttagaggtagaatcatcaggatttggtggctgattggatttggaaggaaagcaggaccaccatacatggttaaacatgtatggttgccattcactgcacagatgagaatgaggtgtcttcaggtaagaattaaaaaaaaaaccttcacagaagtcagaagtgctcagtggattatcaggcgtcatgagggagagggggaattttgcctctggcatttaggctgaataaagcgggaaaaagcagatttgaggaagttacctgagtatagctttcaagggatatttgaaaatatgaacctagcacttgagaaagggacatgaactagaaataaaactcgggagttatcacatgtaggtagcagtccatgccatggaaatagttatgaaaatatgtagcataagaagaggagagagcttgtcaaataatgttagaaaataacagcatgaaagtgaccagcagaggaagaataactaattatggcagatatagtggtattgcaaaagctaaatggggaaggagttttaagaagagtcagcaatgtgaaatgtttcatatgttgtgggtgatcttaacaaaaacagttttggtggaatattgggaacagaagccagattctagtggcttgaggagtaaatgggatgagaggaagtagaggcaacaggtatagaatttctaagggaagggaagggaagggtgggtgtgtatttagggcagaacacagggttgaggaagactgaggattctttggttaaggatgtcacttgaacatatttgttaagtaaaagaaatgaacaaatagaaagggagtgattacagacataagaaatggtattctttatggagtcgagctgcagaagagatggaagggtgatggaattaagtataagtgaaagaattacattcatcttgaaaagaagggacactgaatctctaataggagacaaagagatgaggacagatgcagacataggtttactgagtctgcaagtaatagacaaggaagtagaagaattttctaccagatgatctgcatttttccattaaagtagaataagaggtcacctactgaaagtcaaaggtatgggggtaaccacaggtaaacaggggtgggaacaactgttttgggcaaggggaatggaaacagtttaataaacaggagtaggtaagctaaggccgtgggtcaaatccagcccactacctgtttatgaaaataaagttttattggaacgcagccacacccattcatttacttattgtctacggctgcttttgcactgcaacagcagagttgaatagttgcaacagagcccttatggcccacaaagcctaaattatttactaaataacttgtcccctttacctcccagaaagtttgctgacccctagattgtaatcagataatgattctcagccttaggtacccatcagaattacctgaggaactttaagaaattccattctttgtgttacatttggaccaattatatcaatatccaagggtgggatctacgcatgaatattttcgaaagctccccagctaatgcttatgaaaaccactgatctgagcttaagaaaaatggttgttgaatagcactgaggcactgaggacacgccactgaagtcagaaaccatgagtttatatgcacttaatcatttgttccaaattcctgataccaatgtttttctgttcttgcaagcaaattgcctttacatttttgaaggaatatttcttgagatgatggaaaatgctgatccctggaagagcgttcttattttatctctttttctttattctaccttcttttgcatttctacttctatatccctcaattttgggggggttgaattcaactttatagtttttgccatttattttctcccttttgtccattaaataaagaaacgacacctccacattgttattgttacagagatagcaatttactttccatgattaatctcagaattcttgcactgcaccctcccttccccgccctttttttttcttgttgccatgggggacagacttgatgtaggcacatctgtggcacagagaatcataattagccattatttcataacatatttacttttgtccatgatatatgctgagtctttctgggactgcaagaaagttgttatttgttgtgcagagataattttgttcttacctttggttttctttagcaataataaggagttgtacacaagcttttgagagttcctcaaaacttcacagtatgaatatttaataacataaagctatttgtaataaatgttttaaaactgcttgaaataaataatcattgactatagaaagtcaagtgtcttaaatataaaaaaaattcccgttctatgtctactttaataagaaataacagatattagaaacaggatagcaaaaactcaaagttaaaccaaaagcattactattattttttttattttggaatgttctagaactcattagcagcagttctacccatataattacttacctttcaaaaaattctagttttcctttttcacaatacacagtattgcttgggttgaagttggggcagacaaaacgtatagacaagtagaaatcctttgacaagcctttttcattcatggatttccagggaaaacttgtaggagtgattttactgtcacgttttgtagtcctgggactaccatagcaaactagatgcaagaccagaaagcagtcctctttctgagagtcagcttgatgccatgggaatgagacagcttgtgttactgatcccaacggctcagtcagattgcaatctgaactaaggggacatatttttcttctctactggattattttcacataccttaaatttaccgtttcttctctcattacatagagttgttcttacctatcactcagaacatctcataatacaatctcctttgaaggagtcactatcagaaatagtgacaaatgaaacaataccagccccttagcagttgtgacaccttagcttcacttgttttattctttgacaacttagatttgctttcctttaagaatgttacatgcctaagttaatatttaggttatatttaatgcatttagcttggtttttaaaattttataatttttcaacacatattgcaaatttttggccattgtaaaatcagttaagaattactgttttaaacaaactaaatatgagaaatataaatattaaatggaaaaattcttcatttgaccatgcctctaaacacgttacatttagagagatgcatttgattactgaggtgtgtgatatatgaatacatgcataaatattcttagaatgcttttgctgatgaatagggaaaagcccgagatggcagcccaagatgcagcatttgctacagataattcaattagtaagtgttttgtcattttccttgttctcaaagacactgacattgagtttgtcagtcatatgttaacattcttggtaacttcagaatccctgagatgacccgtccaacaaaactggtctcaagttctgtgaccttttttagctgtaaggatatttttctattcctcagccttatcaatctcatggccatactcttggaccttttcatattccagactattgaccgcttttccattatctattacctccttctttttttaaacagcttgaatgagatatagttcacagatcttaaatttatccatttaaagtgtgtacaattcagttgtttttagtatatttcacaaggctgtccaaccatcaccactgtgtaattctagaatacttttatcacgctaaatgaagaaattataccaattagtagacacaccttatcccgttccccagtctcaggcaagcactaatttactttgtctctctatggatttgcctatttggaacatttcatacaaaaggaatacaatatatggccttttatgactgtctcctttcacttagcataaagtttagaagactcttacatgttgtagcatgaatcagtacttcattccatctgatggctgagtaatattccattgtatgttcctacattggtttattcattgtcagttgatggacatttggattgtttcccccaaatacctgcatagctgcttccttctttgttcacgtctcaactggaatgacattctttagaaaggccatctctgaccaccttaactaaagcagtacattcactatctgtattatccacatttatcttcttcaaggcattatcactatttaaaattattattttgtgtgtttttcatcttccccaactagaatttaacatgttgacagcatatattccatttttcttatacactactatatccccagtgccttgattaatgcatgctgttgttttctcaatacatatttactgactttgttgtcttcaaaagggaaagcaaatatgtacttatagtccgattttagttgcgttgcttaaaattttttatttggaaacaacttcaaacttatagaaagtttgcaagaataacactagtacaaatgactccatatatcctatcctccgattcattttgctccatttgctttatcatttgttctttctttcccacacacacacagttttctgagccatttgagagtatgtaccctggcactttacacctatttcctaagaatagggatattttcttatatactgacagtaatgaactgcagtaaatgtaacattaatacaatactttagctaatctactgtccatattccaattttttaagtaaaaaatatgttcattttttccttccgtagagaatccagtctagggtcagttacagcattggcatgtcttcttagtctcttttaatctagaacatttccagagactttctttgtgttttatgacattagaatttttgaagacaagagtccactttctaattttaaaataagcattcacaattttgggtttgcttgatggtttttcttaattcaattgagattaagcattttagccagagtactgcttaggtgatagtatgtccttcttagggtatcacatctggaggtatgcagtatccatttgcccctcattggacgttaattttgatgataaaatcaaggtgttttctcattttcccctgtataactcttggttttctgggtttgtgtgtgtgtgtgtgtgtgtgtgtgtgtgtgtgtgtgtgtgtgtgtttcaactagtaaataatccactgggagacactttgagaccatgtaaatatcctactcctaagatcccagtttttaatgttatgttttcagcaatcccaaacctctttagaaaagtaaaataattagtccataaattgagaaataaccagtgattcccagatatgtcatataagtttactgatagctaaactgaggtagaaaaaattaacatggccgggcacggtggctcacgcctgtaatcccagcactatgggaggccaaggtgggtggatcaccaggtcaggagatcgagaccatcctggctaacacggtgaaaccttgtctctactgataaaaaatttaaaaaaataaaaataaataaaaaaaaaattagccgggcttggtggcaggcgcctgtagtcccagctactggggaggctgaggcaggagaatggcatgaacccaggaggcggagcttgcagtgagccaagattgcgccactgcactccagcctgggtgacagagcgagactccatctcaaaaaaaaaaaaaaaaagaaaagaaaagaaaaaagaaaaaattaacatgtatttccaaaaaataaaaaatgtcataaaaaatatgatctggcagcaatttctggattccgcattctagtcactgggcttaaatacaattaatggaaaggttgtttgcattgtttaggtgcaataaaatcgattctgatatatgttttaatttcataccatgagtagggggttggttcatgttaagatgcctcagatgttcagtatgtttacctgtcaaatgcagggttacacttttgctgatttgtttacttcctgtgattttaatgtgtgacaatcgaagacctaattttcaatggtatggctttgcatctttagctcttattctaatacagaaaggatgtcaaactttagatgaactcattgatcaatttacagtgatgaatgtacttctagcaaatatttgtagcatgtaaaatgtttgaattatattagatggtatatcagcaagtacatctaatttaaattctagggttactttttagaggcttaaaaatctaatagaattaaatggagagctttgtttaataatgaaaactctttaggaaagtgatatggactcaattattgaaggaaattgatctaaaataaacacaagcagcatcacatccaatattgaagaaaatgatcattatcaaataaaatcaaaaagcataggcacaaaggtattttaacttcagattaaaacttttgcttattgatatatatcagttaattaacaaattgttgaatttggtttatttaaaattggaaaagtgtttactatcaaaacttaggttcctaattttggtgtgtagtatacatttgataaacttttttgatgaatcatttagttttatgggattaaacatttctgatgaatgttttcagttcacactaatggtttgtatgggtaattatacaaacacatatatttctgaatgctatcactagaaatggaaaatatagaaagttaaatttttacaggaaaaaagcagagaaaataagcaaattttatttattaccaaatggatctgctagctcaaagagctagattttatgttttaaagaggtgtccagctattgagttggtgttattaagatgaaagtctttaaaattattgcagtgaaaaatatacagaagtagcagtattcatcttagattttacttccaaacacaagtaaatcagcttaattttcaaggccaaaaaacatttcctacatcacagattatttcacgtttattattctttgcaattaatgtaagtttcactaaaatatgaagaaaacctagcttggcattatttgtatgtgaaattgcataagtctggttgcttgtacctattttctctttatggactctaagaaaataacaaaaatgggtaaagtattcagggtgatggtctagtgttttaggtgtaagaatgactgagaatggtactttctgggaaatcagggagactattggttgtagctaaatagaatgtgactggctctgtattctgtttttgaggccaagttgacaaaaaaaatccaaattagaggtcatggagcacatatttaacagagtgtttcatgattttaactctgaagctaaattcatatttgtgggaaaaagccagactcttgaagctaaacaataaaataattggcaagaaagactaagaggaattttagcaagtaaagccagatgtaaggggatttacacacacacacacacatacacacatgcacacacacatataagaaagacaaatggaaaaatgtaatgttatattcattgctctgttgctataacggcactagttattttggaattcctaaaataattctaagttttaaatacataacctacactgaacatttggaaattgctctagcaacatatttggtaatgctaagtacctttatgaaagagagcaaatatgactttttagctttattttatgtgattacccagtgattctcatgtcttggtgaagacgttgtttttagtctctatctcctcgtttgtataatgttaatccacaacatgatagaaaaaaaaaaaaaaacagctcaacaaaacatttttccccatcaaccttgtgcattgaaatagtttgcctacaaaatcctatgctcattaattagtaactgatttgttttctctctacttcccccttagtcatagagcagcctagcaaaagtatgtttttaacacatatttattgaaataattaatagagatgtatataataaagcataaagactgatgatattgtttctgtcaggcctattgaatattttaaataagttacagagaccaattatgaacttttgtgggtcctctgaagtgttaacatttcaaaattacataagaaagtgaattactgagacacaagaaaaaaaattggaagctacagcactggtttcagtgactacaccacttaaagggaattgtgacttctgaacagggaagttttgaatgaaagcattttctgatcattataatagctgtaaccaaggttaataacgggcaagcccctgaataatacagttaatatgttttgtccagctgaatgtgtgagtagataacacatctatgctatcattctgattaagttattcatcagataatctgatgctaactacttttgacagttctggaaatagaactactgtgaaaacctcaattgatttcttggatatataacacctccttttaaaagggcctcagatgtgtataggaattctggcatatcatataacaaaagtaattaaaattaggtgtgatgttcatttttacccaagaaaaaatgtcctataaagatttggaagagtcaaatgtaaataacaaccccaaagtattataacttagactgtaataatacgaagagtgaaaaatgtctgatagaaagagatgtgagtcattccataatactttcataattgtcaatgagataccaggaaatgaaagtcatagctttcagaaatgaaattcgaaaaggtaaaaacttcattgtgtatagtaaatactataacaaaaaagcctgtgtgtaacaaatctactgctatatcctggccacaaaatcagcaaggctacaacaacaaaagtcctctttagagtgcttggtggttgatctgattaaagacttcttaaaaatatttaaagtattcccgggctccttcccatgtcataacagtgattcactgtaattaacgtgttaatgaaagagcctctttgcagtgttattttcactgaggaagatagagcctatgggagacctgaagctgagagcttttatattgtatcataacctttgaagcagaaatttcctgaaaactcccttcattgctcttcaagtctcagagagcccagtcacacatctaatctcccagggaagtcgaagcataaaatggtccacaagctttgccaaccaattgattagcatatacctgttgaatatccataagatactaggcaccccaaaccatgatcatgttgatccattcatactgtcaatgtctggaatttatagtatacataaggagattcatcccaaattcagatctgtaattgttaatagttgatctactacaggatcagcataaactgtttcatcctgacttctgcagcttggcaatgctatttttagcccagaactcactgtaagaagattccatatagggaaacaatttgaatgccttgggatgggggtgggtgagagtgcatcattatggaaatttaccagttatatcaaacaatatatattggttgcttggcaccacagactttagcagatcacactaagatcatgcttctatgccatgaggaggtaaaattgaatacactggacaatggttttcaattatatcaagaaatgatgtaggataaaatgctttaaaatttttatatatgtgtgactcagaaaaaaaaaaggctcccacttgcccagcacaagtggattacagtagattcaaccaaccaaagcttttagatgtatcaaagtccacctcacatgtttggccaatgacacagggatatatttccctccatttttctataatttcaagttccaatagtaggcataacaaagagaaacaatgctgacccatagagatataatttcctgaagctataacatgcaatatatattaacacctgatattttgaggaacagaaagtgcttatttctctaaaaaaaagagttatcattttctactattgactttcatgagtgatgaggaaagagcaaagttttgaccctcctatctcctccttctttgagatccccattactcatttaccccttctctgtgattagatgggtggttaacactagaagcaataagtggatacaaaacacatgtattaaagctcttcattacatttatgttcctcatatctttaccagtaagggaagcgacctggccaactcattatgtttctctgtactcctctagtcccaaaaataattatttgcttgaacaaaaaagttctgctttcagtagggctgtcaaaaaatcaaagctcatgtacattacaagggtatttcagtcaaacgattattaaatttcacataagaaaatacactcaacagacactttaactgctatctctgatcaaggcatgaaactgttcaaacaaataattaaacttgaaaatagggtgtcaacagaaccatgatgggtggttttgctgagttattttctttgctgtggaactcggccttaaatgtccacatggagagcaaatagagcagcattttattttatgttctcttttccaataccctacttacttgaggtatgctttctcttcagattttgaggttagacttttcttctctataactcatctttttgcctcctctgctcagcggcagctatcttgaacctcagaagccttggtgagactaggagtttcagcatcaagagaggtgtttggtttggtttggttcatttgtttttcagtatctgtaacacattctagtgatgcctgtcagtttgctggaaccactcatggtccttgctgtcagaggcaagggctctgccacttggggcgtgagtgtaggtgtagacccatggagaaagttgttttgcaacaaactgcctggatagtagtgttgctttgtaattatgtaaaatcaaaacattcaaaagatgctggcagataaatgagagataataatagtaaagaaatgagaattccagaaatgtaaaacaattctgaattagatttatttcagacttagctacctttctttttggcagacagagcaccattcttgggagtttcagggaatcaaaatgaaaatgaaaggcagtttcttccacaaggtttttagtattctctgaaattctgactagcctctgccctcagggttcaacagtgtgagagctcttggtccagatgcccagtaatctctgtatcacctctgtagtaagaaatacagtataaaaaggagtaaattcagttatttagtagtggaaattacatgatgacagatattttcaaagatgcttatcattgattttctctccatctgtgctaatattcacatgcatacctatgcaaataggctttaaatgatttgatttcatacccaaaagtcagattctcctgttgttcatttagcatttttctattaggatatttgaaaaaagtattttttatggtaaatatagaagcatttgagcagtcttctttttatatggtcagttttccattttgaaggggaaacacttgtccttgtcagaattattgtgaactgccttagtttaaaaattggaaccaaaatgagatttgattgttactggggtaggtttttttttaagttttttactgatatgtaataattgtacatatttagggggtacacgtggtattttaatacatgtattcaatgtgtaattatcaaatcagggtaactgggacatctgtcacttcagacatttctctattctttgtgttgggaatgtttcaaatcttttcttctagctattttgaaagatacaataaatttttgtaaactataatctccctactgtactgtcaaatactagaatgtattccttctatctaactgtatttttgtacccatgaaccaactttgctgcattccccctcccacctacttttcccagactctggtaaccatcattctactctctacctccataagatccaatttttggggccgggcgaggtggctcatgcctgtaatcccagcactttgagaggcccaggtgggcagatcacaaggtcaggagatcgagaccatcctggctaacatggtgaaatcccgtctctactaaaaaaaaaaaaatacaaaaaattagccgggcatggtggcacgcacctgtagtcccagctacttgggaggctgaggcaggagaattacttgaacccgggaggtggaggttacagtgagctgacatcgtgccactcactgcactccagtctgggcaacagagcaagactccgtctcaaaaaaaaaaaaaaaatccaattttttagttcccatatgcgagtgagaacatgcagtatttgtctccctgtgtctggcttatttcacttagcataatgacctccagttccatccaggttgctgcaaatgacatgattttattcttttttgtggctgaataatattgcattgtgtatatgtaccacattttctttattcgttcatttgttgatggacacttaggttgattccatatcacggctattgtgaatagtgctgcagtaaacatgagaatgcagatatctctttgatatgctgatttcctttcttttggatatatacccagtagtgggattgctggatcatatggtagttttatttttagtattttgaggaacctccatactgtcttccataatagctgtactaatttacattcccaacagtgtacaaggattctccttccttcacatccgtacccagcaactgttattttttgtttgttttatattagccattttaacagagttgagatgctatctcattattttgatttgcattttcctgatgattagttatgttgagcatatttttcatgtgtctgttgaagagttgtatgtcttcctttgagaaatgtctattcaagtcctttgcccaatttttaattggatttatttatttatttatttatttttgctattgagttgtgttcattatatatgctgcttattaatcccttgttaggtggacagtatgcaaatattttctcccattctgtaggttgtctcttccctctgttgattgtttccctgctgtgcaggaactttttagcttcatgtattgtctattttttaaattttgttttctgtgcttttaaggttttacccaaaaaatctttgccaagaccaatgtcctgtagcattttctggatgttttcttctatttcacagtttcaggacttacatttagatctttaatacattttgggttgatttttgtatatgttgaatgtggtaggttattgtactagtgaaatgctgacaaaagcatgctgaaggaagatagatcattattttgttttggattcttacattgctttaaccacccgtgcttaattgttttattattatttcctgaaatattattatgcatcattgaatactaagtcagcctttaagaggctttatatatacacattctaggctttttctaagtataactaatcatcaagtataggtgtcatttacacagtttgtttgagtcactcctttaatatgatataattttcttagctgacattgtatagattttatcaaacctaaaattgagtaatacaagaaattctaccaagacatcagtgtcatttgcatagaggcgtaagtatattaagatctctgtatgaaatgtgttgtaagagtatgaaatattatcctactgatttattgaataaataacatgtattaatagttaaatcttgctttttatatgtctcagagccctgaaccttacagatctcaaacttcatatagtatttgcaagtcaagaaaaatgaaaattgggcacattgtgaaaaatcctggaatgtattaccaacaaattgttcatttctggcacattaattatttcacaaattgttcgtcatgttcccatttcacttttataagcacagtaacactctcttttacagaatgttgccaacatttaatttcttaatgaatcaatgactctttcatacattataaataagaatataggttcaccttaccaagtggctaaacagcattctctaatatttgttggagcattagggaaaagctgatggcaaccagtatcagttttgcataaatagtatttttttcccttagaacgtaagattaaccttttttcttaaaagttagcagcaagatgttaaaacgtaatattattcataggaagtttaagtacagccatagtaaagaatttttcttttttattagattttattgaacgtttatttgctgttactgtggtcacgcaacctgttaccgtctcatcacaaacagcatttcatttagtatattgagaaaagtgctgtttcaggaagccacatgcagtgctactagatcagaatacattgagggtcaaaagtttatagggacccttgataaaaaaaataataaatgttctcactctatatagggggatctcatctgagggaatttagtttgtaacatgccaaataaactttgctataaaaatagtttccatttaaattgcttctaggattctaagagtaggattatagagacagctcagtgtaataatattaaaatacatacttttaagtatggcaattcatacttttaaagccctattgcctgcattatcttacatcatactgtgtgcacttgtcaagtgatcgagaaaagctgctgtatttgggttgctattttgaactgttgaattaaatataaagtccaagtaaatatatttgtaacagtaagtaaatcgtgataatgtgcaattcatcattttgtccatttttttttcatttatgacagtttttttatggtgtagggtcacactgaaagggttatttcattctagaagttgtagatgaagtacctttatttgttaggggtgctggccaagaaaccattaattggctttcttgcaagatacaataacttttctttagttgtttgatgagtctcaatctcgtgtagaattctcaaatcactgcccctggtatgatcttgtggcagatttgtatagattccggaagtcttagaaagtttctcttgctgttacgacattgctggtggtccccaaggcaattatgctcctttagtggtcatcccacttaattaaagggagaagtgttgctctagatagttttattatatctccttgtggttgctaaacgaagcataccagctcaacagtacttcctgcttttaattgaagtttcgttttctaagaatatttagtagttcattttcctttcaggtgtaacattctaaattcaaatgagttaggatcttcttttggtttgtttttgctttattgtttgttgttctctgcaattattccctttcttgaattgtttatggaaggactcactgccttcatatttttatttagcaaaaaatctcttgagtagaagaagttggattgcatgcccatgagaccacataccctgtttgggcttcattaagtccgttgtaaatacagatattagagataagtaatattggctaatatcaggctattttcttgtgatgttacaacctcataaaaagcctgcagaggcatcactgtgcctcattttgtgttcttgacgcacaatgtgtgtaatattttctcatatctcctttatttccaaatgtttgttgcatgtaaatctgatatttcccaaaccatattttaacctatttgaatataagaatggtgccttccccatcttttatatttcccaccataccaaattcattactaaataccaagtaaatattttaccaatatttagtaaataaatgatagaagataattttactatgtacgaagccaaagacagaaaaaaaatgagtgatttttctctttcacataataagagatgactggatcaaaatgatacactttagtaaggaagaatttggaggttcaaattatgtgtgtttcacaatatgggcacaccgaattagaaatacaggagtgcagtttctaacccctgttcaaatgaatgtatgaacttgagcagctcccttcctttgtcaggttatcaattaccttaaatatcaaatgatagtgtataatatatttctttgacctcttaagtctattttgcaagtaataaatcccttaactttgcatgcattattaaatttttaataaaatctacagcaatgaggttatgtagaatatagatctaatgagtgctctttagtactgagtagccaggggatcatatttgaaatagatgggatatacctagggaaatgaacagttatttcctgctcgtgattacaacagtggacataggtttctaatgagtctttcatgacagcattcttttattttcctctgcctttcattatttggtttatttatataaaagtaacagaattccactggggcataactggacttgaccaataaaggatgactctttgtgccttctatttgcctccacttaattgtcctgctcgtcatcccgctgaattatggaaaatgtcacatttccttggcctatgactcatataacaaatgaatgtgtgaatagtgtcaaaatacagcaatttgctctatgtaaagggaggtagacagcttttgaaaatggtaaggtatataactagatatttctaaactgaagaaaattctcatttgggcttagacgtgtgcatctatggtgcaattagttgttaaatcatttaattgagggctcacttgcctagtctgtatacttgcctcactgatagtgactcaggaagcaaatcaagtggacttaaaactaaaatatcaataccctatacaacaagagaagagacatgatttctttattaacattggagctgtgtgtgtgtgtgtgtgtgtgtgagagagagagagagagtgtgtttgtgtgtgtgtgttagtttgtttagcttccatccaagcactgatggtcctgcaaattaagtggattcagaatcttcatagttcctgaccgataatccccatcttcaaacatttttttgcaggaggaacttggaatcattgatcttactgtgtttctctaaaatataataatttgtgcataaataggaattttatgacatactctatgtcctctaatagttttgtgtaatttcattgccatttagtgatcaacaaaaggagtttgtaaactataaactagctttttcctggctcgcttatgagggaataggacagaactccttgggtttaattttcagaaatcctaaatatcaacattttttatacttgatagagttaaatataaaggaataaataagcaaaactaaggccaaccttgtgcattagcccttccactcacttcagatcaccagagcttggatgtttcatctgctaacaattcctctgaagcattctcaagcatgttttcttgccagcaaaagtaatataagtcctaggcaataatagcttgataaattcatagaagatagaagattcctatgaatataagcttgctgacattttacagtaatacaaataaaacctgttaacatagtaaataacaggtactttcgggggggtaaaattattttaatttgacctatgattacatgtcttgtctattctgctatgcccagagatcctttctgatgaagatcaacttttctaatactattttactgagtttggaatggaactatagattggataattaccatccgagggagtaaagcctctaactaccacaattactcacatttattcacatgacatgaaaataaaaataacaaatggtttggaagactgcactgtagggggcaaattaaacaaaggtgcgcacacgcacgcacacacacacacacacccctctgatattaacagaggaaaggaacttattcaatgatgtagctttccactattggcactttttgttttctgttttagagacatagctcacctgaatggcacaacttgtgtgggtactgtaaatatttcctagacatggcaatgcattatattttccatttcaaaatatacttatagacagctatgggaaagaattacagtggtagctacacacagccttgttttccttgtatacagagttagaaaatagagatataggggaatccactcctgataccaaatatagccaccataagcatgtacaggcataccttgtcttattatgctttgcagatattgcagtttttacaaatcaaagtttgtggcaaccctgcatcaagaaaatctatcagcgccattttttccaacagcatgtgctcactttatgtctccaggtaacatttggtaattcttgaagtatttcacattttttcattattgttgtatctgttatgggtgatcttgtgtaatcagtgatctttgatgttactcttataattgttttggggcaccacagatcatggccatataagatggcaaacttaattgataaatattgtgtgtgtgctgactgctctactgacaggccattcccccatctctctgtttctacttaggcctccccattccctgaaacacaatattgaaattaggccaactagtgactatacagtggcctctaagtgttcaagtgaaagtaagagttgcacttctcttactttaaatcaaaaactagaaatggttacacttagcaggaagggcatgtcaaaagctgaaataagccaaaaactaggcctcttgcaccagctaaccaagttgtaaatgcaaaggaaaagttattgaaggaaagtaaaagtgctacaccagtgaacacataaatgataagaaagaaatagccttacggctgatatggagaaaggtttaattgtctggatagaagatagaaccagccataccattcccttaagccaaaggctaatctagggcaaggctctaactctcttcaattctgtgaaggctgagagagatgaggaagctgcagaagaaaagttgcaagctagaggtggcttcatgatgcttaaggaaagccatctctgtaacataaaagtgcaaggtgaagcagcaagtgctgataacagaagctacagcaagttatccagaagatttagctaagatcattgatgaaggtggctacacaaaacaacagattttctttttttctgattttttttttttttttttttggtctcactctgttgcccaggctggagtgcagtggcataatattggctcgctgcaacctctgcctcccgggttcaagagattctcctgcctcagcctctgaagtagctgggattacaggtgcctgccaccacgccaggctaatttttttgtatttttagtagagacagggtttcaccatgttggccaggctggtctcaaactcctgactttaagtgatctgcctgcttcagcctcccaaactgctgggattacaggggtgagccaccacgctcggccatacagattttcaatgtagatgaagtagccttctattggaaggagatgccacccaggggtttcgtggctagagacaagtcaatatctggcttcaaagcttcaaaggagaggctgactctcatgttaggagctagtgtagctgcagccaatgctcatttaccattccaaaaatcctagggcacttaagaattatgactctacttctaatctataaatggaaaaacaaagcctggatgacagcaaatctgttttcagcatagtttattgcatattttaagcctacttttgagacttactgctggggggaaaaaaagattcttttcaaaatattactgcttgatgacaatgcacctagtcacctaagagttctaatggagatgtacaaagagattaaagttgttttcatggccactagcacaacatccattttgcagcccatggatcaaggagtaattttgattttcaagtcttcctatttaagaaatacttttcataaggccatagctgccatagatagtgattcttctgatggatccaggcaaagcaaattgaaaacctgaaaaggattcatcattctagatgttattaaggcattcatgattcataggtggaggtcaaaatattaacaggactttgaaagaagttgattccaatcctcctgatgactttgatgggtttagggcttcattagaaaaagtaactgcagatgtcatggaagcagctagagaactagaattaaaagtagggcctgaaaatgtgacagaattgctgcaatctcatgataaaactcatgacaaaatggatgaagagttgtttcttgtggatgagcaaagaatttcttaggatggatctattcttgaatggtgacgatgctatgaaaatttttgaaattacaacaaatgatgtagaatattccaaaaacttagttgataaatcatatacagggtttgagaggatataatccgattttgaaataagtttttccgtgggtaaagtcatatcatacagtatcacctgctacagagaaatctttcatgaaaggaagagtccattgatgcagcaaacttcattattgtcacagaaattgccagaatcatcctgaccttaaatagccaccatcctgatcaatcagcagcaattaacatccaggcaaaaccctcaagtaggactaaagatatgacttgccaaaggctcagatgatcattggcatattttaacaatgaaatatttttaaactaaggtatatgcactgaatgtttagacataatgctgttgcacactttatagaccataatatagtgtaagcctactttttaaatgcactgggaaagcaaaattcatgtgacacactttattgcaatattcactttattgagatactcactttattgcagtagtctggaactgaacctgtaatatctccaaggtatgcctgtatattctatcactcccaagctgtgtgctcttgggaaagttacctaatagaatccttaataaaaaatggagtatggggctgggtgtggtggctcgtgcctgtagccccagcagtttgggtggctgaggtggaaggatcacttgatcccatgagttcaagaccagcctcggcaacatagcgagaccctgtctctacaaaaagaaaaaaaaaattagcggggtgtggtggcatgtgcttgtagtcccaactactcaggaaactgaggtgggaggattgcttgagcccaggagattgaggctgcattgatctgtgatcatgtcacagcactgtagcctgggtgattgatagagtgagaccctgcctctaaaaataaaatggagcattatctattcatggggttatgtgagattatttgtgtgaattgttagtcatatatatttgccaaataaatgtttgcatcccatcaccgtggctgaatgagcatcggactaaggctaccttcttctatgcgccaaaagttttggatacatttcttgaggctcatgtagttgtagaatctaaaatctaattttagcttagaagtgcaacttgaggaaaagcaatcaggatttttgaacttttaatgaaacattttataaagaaaaacatctcttgtgagtgctttgttccctgtttaatttggttgagggtactttgttcagtagaggccaaaagcctataagttaaataagctgagactatcagtggaaaaagaaacactacattcattcaagttcatgttatataagtttgccatcatttcaaagcaaagattttacatggctcacctgtgtaacaataaaaaaatctacggttcagttgtaaatgtgcacaaatagggcatgatgataggctcacagttgtagcttcctctaacttggtcatggactcaagatcaatgtgaatgccatatatcagaaaggagcaaagagtgctttaaaactacaataagaaagattggcatgcgtgaatctaacggtttagttatccattttgagggataatttatttggaatgctactttatttctttattttattttattattattatactttaagttttagggaacatgtgcacaatgtgcaggttagttacatatgtatacatgtgccatgctggtatggtgcacccattaacttgtcatttagcattaggtatatctcccagtgctatccctccccactctccccaccccacaacagtccccagagtgtgatggggactccccacaccacaacagtccccagagtgtgatgttccccttcctgtgtccatgtgttctcattgttcaattcccacctatgagtgagaacatgcggtgtttggttttttgtccttgcgatagtttactgagaatgatgatttctaatttcatccatgtccctacaaaggacatgaactcatcatttcttatggctgcatagtattccatggtgtatatgtgccacattttcttaatccagtctatcattgttggacatttgggttggttccaagtctttgctattgtgaatagtgccgcaataaacgtacgtgtgcatgtgtctttatagcagcatgatttatagtcctttgggtatatacccagtaatgggatggctggatcaaatggtatttctagttctagatccctgaggaatcaccacactgacttccacaatggttgaactagtttacagtcccaccaatagtgtaaaagtgttcctatttctccacatcgtctccagcacctgttgtttcctgactttttaatgattgccattctaactggtgtgggatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgttttttttcttgtacatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtaatacctaggttttcttctagggttttcatggttttaggtctaacgtttatttcttaagctaccatcccacaattcatcactattcctgatggtctgttttacagaaattttctgtcagcacataactataatagatagtacataatatagtgaaatatgaaaatctctgtgaaaggatcaacgaaatttgaagagagagctagtttgaaatacgaatcatattctcaaccttttaaatttctgattgaatgatttatgggaaacattctgtagcaatgtgaattccttataaggaaatagtgactgtgtccataaggatgatgtactctataattcagataatataaccatttatgctttgtagcaggagttccccaacctctgtaccaattcatggcctgtcaggaacctggctgcacagcaggacctgagcgatgggggagcaaacattaccacctgagctccgcctcctgtcagatcagcagcagcattagattctcatagaagcctgaaccttattgtgagctgcacatgtggaggatctaggttgtgtattccttatgagaatcgaatgcctgatgatatgaggtgggatagtttcatcacgaaaccctcaccgcttccaccacccccatccgtggaaaaattttctcccatgaaatcagtccctggtgccaaatagcttggggaccactgttttatagggtccgtatttcatagattgaaagactgaggacacagttaaggcattatgaagtcaatgagacatagtggtgaagaaaagataaattcttaaagataaatctttactggacatttaagtgggttttccaagtccattaatcccattcatgttttaacatgtctttgaaccctgaatggcccctaaacttagcctgtaccttagttccaactcacccagttttcttagtgtgcctacaaggctaacagaccttgtaggcttggtggggccaggcatgaggtagctgtggattcactgtgctattacaagtctaaaatatggaagtgtttttcagctttttttccttatgtctttttctgctgactctaatctttagttgcttttccccctttggttttactgcagattgaaaatgtttccattcattcaaaacaactatttcttgtttaaagtaaaactgttagttaataataatgatgctttagcaactatcatttttctcgatgatttagcagaacactgaattactgcgaaatgcaaacagtgagagggtataacagcaacaaaaatatatcttggaagactcaggtctcatctcttaggtctccttccctaccaaagatgaacattccccaaaaagattcaaaatggctgtcaccacatggtggaatcatatgtgattcttacgtttatgcccgtatgcaagtttctaaattagttttattacctttgttaaagaaaaaaaaagcagaagaatggaccctttagacagtgtctaacttatctcaattttccactcccctttgtgtaggcattgatttaatttgtggcatcgtttttaagatgcatattagattatcagaattgcatcaatgtgaaaaaaggagtaaaattaagaataataaatcaaaatagaataaatatgaaaataatagtaaatagaatttgtaatattttatagatgttattcatacttattttataacatttatataataaatacaaaaattagcaaaagaatttttctttcacagaattattattgcatgtaatatacaatgtagagttaaaaatgtggcagatgaatattatgatttctcaagattttcataataaaattatgaatgtttcaaatgtcaaagatctagattccatttatcctttgccttgcagttgagtaaatcctatttcttcggctaggttaccaggactttaaagaaaaatatttttctaacaaatatttctgtttggagctttttacaacaaatgagctctgcgtttgcatcgtacaaagtctagcttgcttcattgggaagaaaatggcatgagaaacagtatccatagatttaacaagctcatgacaacataagttatcaagtagcaaactgatagaaacgtaaactgattacttgggaaagcggcaagagtttggggtgctcatcagagccataaccatgagaactgccaaatgtttgtccttaactattagtttaccttatactgtacacgactctttagttctcccttgattgcacctcctgtaaaggggagataaaactctttgggagcctttcctgtgtttgattatcattctctccaacaccactatcaattgcccttgacaattttgtcacaccctccagcattactcttgctataaatcttgataattttagtatccatatagatgattcttaagtgctctgccatctcagttccttgaacttttgtcctccaatgatcttgtccaccctatctcagccatccactctaatggaaaaccttagactgtcatcatcagtaacctctgccctctgccccatctccatttcaagcatcccactgtttgactgttaccttctacatttacagattattccttcttgttctcagacttcaaatttcttgaccccacagagagatagtatatttaccctaacaccttttctcagttcctcaacctccactccctctttcagcttgcttccatgtcttcacttctctctttcctcatcttaggtgatgcagacctcataataatcacactttcagatattgattcaattttctgtttctcccaccgtaattaatcaactggcaatactccagcccttgttcaatccacatctgtgctaattcagcatctatactagttctgctggaggaaaatacaaccatgctgattggttttgcttaaacttaatgaccatcagtgcagaccaataagtcttctactcaaatgagttactgactttactttgttctctcatctataatatggggataataatagaaaactatagtcatagagttgagggatttaagtgtattcccatatacaaagaacctgacaatagtgcctggtacctagtaagggctcaatttattctacttctccccctcctctctccctccttctccctctcctcttccaccttctcctttttagtagtactacattagaattcccctagttaaattacctttataccaacctaattaattattttgaactttatttctcctgaaatcctgaatgcctccctctccccctcctaaggctaaggcttttaattcgcagagaaaacagaaagtcagaacaaaatggcctcatacctccaccaccatatctactcacccacttctagctgtgacccatattctgtctttttctttgttactatggatccttttccttgttcttatataaggccagctcttacagtcatgcagtatattcaactccatatttcatactcaaatttctcagtctagaaattgttcttttctttctttctctctctctcatgtcttcgtatccctctccaccatatcaaccccatcagcatacaatcattactgttatttatcccatttgatttaggcaaataaaaagaaaaaggggtccttaaaaggttttttgcagttccaagtaatttcttgtctagcataaaatccctggctcttaaacccaaactgacagtctttaatatgcaaatccaagccaagaaaaactgggtccacccaacatggcaattcccaccgttgtccccttgcccttgcccccacatgtgcttggcagcatggctactcccacatatccccatgtgtgtaaaacatcatggctccctgcatttccatattaaaagactagggtggaagagtcagtttttccgcgggctacgtaaataacatgcctggtcaaaccaatcccctgagccctatgcaaatcaaacaccacctcctccagccatcgcatgtaactggctggtatcccctaaacacaaggtctcctctttcagcttcatttaaatgagaaaaaatattcctttattgcatatcccttaccagctaccattccatttaccagtttccctttacagcaaaatccctgaaagtattgtatatcattgtgtccacttcatctcttcccattctgtctatttaaacctattccaatcaggtttttacccctccccgcattattctacccaattactcttcctaaagtcaccagttacctccaccttcccaaatatggtgtcttgtcctcaatatctgcttccttgacctaaacagtggtggttgatgcagttcatcattccttcctcctgaaaacattttcttcacttggcttcaggacaccacactcgcttagcttttcttctacctcactgactgatccttctaagtctcctttattggttctttttcatcttcctaacctgtaaactttggtgggctccaggactcatccttgaacttggtcttttctctgtgcacactcaccctctttgtgtattactctcatgacttcaaacactgtctacatactggtgattccccaaattctccagcctggcattcttatttaaagttcaggcatatttccaactgcttccttgacttctccatgtagatgcctgattatcgtatttcggttaacaagtcccaaatagaaatattcatgtcacttccctaaatattatatgttcacagtcttctccatctcaataagcggcaaccccatccttccatttgcttaggtcaacatccttggagttttccttgccttctctctgtctctgacatgacacatcaatgcaccacaaatctttggctttctttcagaatatatgcactccagaactaaaccaactctcatcacttccacttctaccttctacatctaccctctcacacctgagttattgttatagtctcctcattagcatccctgcttccatccttatgcctccccactttgtgctccacagttatcctgttcatagtaagtcagataatgtgacaactcctctgttcagatttctccaatggattcttcaacgtccaaaatccttagtatggaatttaatgccctctgtgacatggcctaggggactatctttctgacctcatctccctaacccttactagctccttacttaccactcactgtgctccagtcatatcagttttcctgccgtttcttcacatcatgacaaacccacccctgctttagagcctttgcactggctgtttcttctgcttggactgctctttcccagattccccattgctcactccctcactaccttcaggtctctattcatatatgactttttcacagaggcttccctgactacttaatttaaaatagcattttgtcaccataatttcctatctcccattatctattatttatatatccattttatgcatccataatttatacagcacatttaaataaatcaagtcatgttaaatatgttaaatgtacatttattgaataaaatgcctatttgtatattgtttgtgtatgcacagtagagtataaattttttggcggtcaggatttttgttttgctcactgttttttgttgaatgaatcaatacgtacttgcttatttgtttattgtcttcctctactagaatgtcagctccttgagggcagggtctttattttgcttagtgatctttcccgagtacctggaacagagtctggaatatactaggtactcaataaatgttgcctacaatatttaattaattgattagttagttcagacattgaaagagcttccaagagtaatgtttaaactcaatcaatgtaatggataaatatccaagtactgtatgaggaaaagatattgataaacgttgcctgtatttataagattcataattttactcaactctttgatgaggaaatgttgacttgtccaaaagcaggtaaatataaatagaaaaaccggaggtttttcttgataagagtatccctctatatgaagcagagacgtaattcagcctaatttatattgaactcctatagtccaactattgattccttatcacttgctgacatttgttgctagggagcattgtgagtatttgaaatatacatttatttccactaagagttatgtaatcaattttaatatattttaaatatactttatgatgatgtagattaataatggaaatgatgatggcggtggtggtggtggcgatggtgatggtcatgtgtgtttgtcatagctaaagaacagcattgaaacttttccagtgcacacaacacacacaaaatccacttataactaaaaattaattatgaagtaggtcagtcttataaaggatttttaaggaaacataattacatgaattttctagattaactcaaactatgctaactcttgtcctcagatgacttgaattaatgaaatgatatataattagtgtttcagttgtttacatgtaaatataagttgagtattccagaaaagtttgttcgtaggcactttttcatctctagtttttattttatactgaaacaaaaagaaataaaacatcaccccaaactcactacacagatatttcagtgtctatcacctgtatgcctccctgtgtatatatacacatatatctacttgattgtatgtaaatgagataactttatatgacctgttctgtaacttgcttttttacgcacatcttgtgcatgtatttctatgtcaataaatgtacatccacattattgttttaaaagatgaataacattctgttgtatgtatgtaccataatctgctcatccagtcctctgctgatgcatttttttctttgttgctgttacaaaataatgttatggtaaacattcttatgcatgcatcatctttataatttgacttgcaagtatttttaaagtttctttctcagtgtcattattttgttctatacgtataaagggatctctaaacaaaatcaagtttcttccctattctgtttttaaattattgtaaatttcaaagtagcgaaattggaataaatgagattttactgtgtactttgcctggagccctctcttgaagtgtattcaaagggaattaaagggcttattaacggataggactatttgtgttaaagatgaagtctgttgaacattttcacctaaatataccaatctgatattcttgacgtttttttgttaaatttgatgctgacaataaaaactttggaataagctataatttctgcatccatgcatattcaggtctgaaaatgaaagaagagtgtgacaggtttgcatgtagaacttcccacccactcatttctttcctttctgcttctgacacttcagcctttgaaacagtttcccatgagcaatactgagattcagactatttagatctaaaggaaaaaatgcaagctcttctacagcttgtatctagcacctggaaacgtcttagaagaagtgctaaaatgtaaataatgctgttatttgttatgcacataggagaaatcctaaaggtattttagggaagagatggaatccagagatattaagaacaaggtgtgggggccaggggagaaggggagaggcagaaggatcctatccacattattaaagtgaaatatttccagtatactcttatcaactgacatgtagactgcatgccgctttcatgcaaaggtatcacatttcaaacttagcatttaaaagaagccagacaagaaaggaaaagagacagttatttgttgaaaaaagtctgggtttagcatcaggcacaggggttattggtagttgtctgaagtacactggagccttgtaacattgttttgtgccatgtattgccagcctgataccactggagtacatcctctgtctagttttccagaactcactacaataactgtaggatttttccatcctttatgaaattgcatcagtattgtgaagggccttaaaagccattcagttcaacaaccatctcccaaaagaaaagttcctcttctttttccatttattttatctcttcccaaagccatggggacctagatacatcaattatcctttgtcctgtaccttcactacctcctggactactaccttttttccactggcatacagatcatttcaagacttctcatcctaaaaagtccctcctaagtttctctttcagactgtctctttcctttgataggcaagagctttcttcattttctcgcctatttttaaattattcagcttcacctttgcttttattttctcatctaattcttaattattcagccctccgcattctatcttctgcccacattgccatccatgaactcctcctgctaatgtcgctagtgactgccaactaaaatccatttctcccttcagtccttaccttatttctcctttctacagcacttgaccaggttggtcaactttttcattgaaaccatctcttctgtgggctttcacaacactgctttttctctgttctacaccatcactatttttcttttaatttttacacttccctcgtcttttctgaaatgtttgatgtcctccccacccccagtttccagcctcagtagttgtcttgtattctgcttgtgttctctagattattaaatgtattcttgtggtttcagttaccatccatatgcagacacctttcatcttgagagccaggcttatatatacaaatggctgctgcacattaacctatcactaatggctctttaaactcaaaataaccaacaatggagtcattgtctctatctctgaaatagaacacactaccctcccccacttcttcccctttttaccctgtggcaacaaccttttgctatcctgattttaagcaggctgcagcatcataataaatgatacataatatctgcctttaaaatgcctgtagtggttaagagggagggctctgacattacatggatttgaaacacaattcaaatgcttataaggtttatgatttggggcaaaggaattattaatccatctgtcctttagtttcctcatctataaaatggaggtaatagtagtatagacctcatagggttcttaagaggattaaatggaatgataatacatgcacagcattttacagtgttaagttcattaagttaacaaatgcttcatattatttgccgttacagtccatataataacatgctgccttcaggccaatatatataagcctataattcttggaagactatggaaatcctatcatatattaaattgtcattttttttaagactaagaaaaatttatgtaaagtccaaaagtacagctgtttacaggggacgaactgatccacaaggccacagtctaccctcatcagttagtgtccatcactgaagtggaataactcaaaaggaaaaggtaactcaacgagccatccatttcccacatagaatcacaacagaagacagaaaatatggagtggaatgttgaatcagctgctgttgggagaccctggtctgcactctatctgtattcttactgaagggagtgcagggcagggtttcccatacagagggcacagactaccaccgtatggcaaatgttgactggaactcaacttcaaagccatttcacctggaatcttaccccaccaccccaatgcttcatgaaaattcaactgatcctcttctatgaagaaactcaatcctgataagtctctttagtagttattgaaatgtctttgtaactctcttatagtcaggttcagtaagaatgttaagtttctaattgagcttttctttctgaacagttattttgtgtatgtttattttctgtttaccaatgtaatatatgttctttgcagaaaaattggaaaatacaaaaaggtatctacaaagtcccccaaccaagagaaaaccaatattaatgttctgttatagatccttgtagtggctagctggaattcgtgtatatctctctctctctgtctttgtctttctttctctctctctctctatatatatacatatattccaaatatacatttttatgtaatatatatgtatattatatatgtatacatatattccaaatatacatatatatcttcatgtaatatatacgtattttatatatatgtataaatacataatatacatatataacctaatatatgatatagcataatatatgtatacacatatatgtgtacatatataaaatacatatatattacataaagatatatatgtacatttggaataactatgcataccatgtttcaaacctgctgtttactcgttattatgactattcctctatatattaaaatattattcttaatctacattttagtggttgaatagtaataatctatttagtttgttctctgtttatttgtttttgtttttgggaacaaggaactgttcacacctaaatgtgtacaacctttatgtctagatcaggcacttgaattcttaaaaaagtgttaggaaatggaataatgatcttttatttataagttgtatatgtttctgtattctgttcatatatgataattgaaatagacctatatctaacactttaaaatttatagtattttcatctttatttcctcatttgatccctgctacaccttgtgagatagagaagggcttattattctgtccttatagataaggaaacttatgtccagaaagatgaagtggttttccaaaagacacgtagctaataaataattgacaacattggaatttggaattagaaagcaagtcttgtgactcctaaccaatactctttccagtacactttgccatgtcccaacttcactttctttaagtgcttctttctagcacctcttattcaattattgtcatacgtactttttggatcataccttaggagaatgtagctttctcatgaatttcctcattagctgacaactgaatatggctagattttaacaataaaaacacatttttttcttttcaggaatgcaaatacacagtgtattatatgtagaaaaaactctcagatattggatccttattgatgaggcttatgagataatatagcaactcagacttttctcaggaagaagaaaatccatgtcttttgttggacagtttagagagtctagactaccatcattcagcatttgaacattttgatttcaaaatgtagacaattgaagaaatacaatgtaaatgccagggaattaaatcataggacaaaaactccctatgaaaacatcttagtgatagcatacatgttaaaatttttgaaaacactgggaatggtttcacttctcatctgagtatctgagaaacagatgattatgtacctcccagccctgtgtcagccctaatttagttgatggcattattgctccctgctttcttttttttctctttatagcagattgctattcttttttactttaaaatagcaccttttgctgccctgtcttatccttgtgctcttttaaaaagtggtcaggcacacacttttgtcactagttttacatgagggtaggggctttctcttttcttttcaaaaattaagtgccactacatctcagttaaactgccttcatctgacaagcacttacagaatactgaaatataatctactgcaaaaaatctacatgtttttcataaatacgaatgaaatgcttttaatattatccctgtgttcagagttaatgcttaggcattaactaaagtacgctagacgcttttgatatatttccaaaggcccagccagaaagatatattgcagatacacatattctaagtgtttacaaaatcttccaaaattattttgcctgtgtctgcttaaaaggcacaggaaacagctcccctactatctcctctatccagtcaggaacacttgcagtaaggacactggttgttcagtgcacaaggattaaagtaacttaattacacagtcaaatcaataataaattgagatcattagagccttggctcgagctgaaccccaggtagccgtggaatccctatgatacttgaagaagaattgacacagattctaaggcctcacaggttcaaggagaagcagacagcctcactttgttccttcaaattagttttgagtggaggaatcttaggtttaagtgagacctggatcttgttttggggtgatctctggaaactgggatataatctactctccagggtagaagactatgaagggactaaaggagcaaactctaggtcactgagaacccctttcctacaaacaaagatcttggttgtgttccctcacttccagagagctcattggaccgagcatacccttgagtattaaggtcagtgcatactgagtttaaaaacaacataggtataaaattgaatggagcagtggtgaggaaggtggaaaaggatgagaagggaacttcctttggacttctttgagccaaaataagtagtatgtttcctaaattcttgtaatcagaccattgttggctattggtagagggaggttcagattttccatctctatcttttttcttctgtttcttggtccttctgccactgcttcttttaaaaagaaataaactcatttttttctcagccttatgtgggaaaccctcttggcattttctaactgccaagtgttctataactagccatctgtggaatatttttttgttaagttaattttttaaattaattcatttcccttttctctctctctctctctctctcacacatgcaaactagtgtttgaagatcaatgagcaaatgatctttcttgtaacaacttccctttttcagctgatcgcttttctgaattttatctcctaaaatcacttaaataatttcactgaaacaaaggaatgattggtcttttaaagactcgtacatgtattgaatataacatttccgacctgactaataatttgaagtaactttgagcttttcgagggccctagccaaaacaaaatgttagatggcctttaacatttatgtcttcaagggactgtgctagccaaagtttcctcccaatctggaggcagctttgtgccatagcaattttcaggcttcattgcatcaatcaaacaaattgttcttgtagtgcttacttactggggaattcaccagctggaagattgtaccattgagccaaaacaggccactggaacagccatactctttacttcatttatggagccatttaagaagatgctgtagtggcagctgcctgtttgtcagaacagccttggaggtgtgctgaatgaaacctaatttagactagtagatgatcagatgacaaagaataccagagatacaggtgaatcacaaaagaagatgctgtgagactttctgtaaggaattccccaccatgactttagaaaaactaaagtttcagctgcagttatgttgagtgaagtgtaaagccttgaaaacatagactaaaatggtccccctcctctctctcttatcatataaacacaccccaaccctataatttttctgatacaaattgtatttggattttgcatagatggccagtttacttttaaataagaattatatgcctgtttatttgaatgtctgttcctaagattatccacaaccacaactccatttattatatgtttacataatgttgggtgagggagagtagtcaatgatgattcatttgggactagatacagaattaaaatataaaacaaatattatcattctcaaggttttaatagatggctgaacacaaggtatgagtttagaaattgtcatcctggattatggtgtggattttatgtgcaccttttcatgatgggcatcagctgctttgtatattttgttcccaaatcttgttagtcaactttcaactatctgtgtatataaataatcaaggtgatgttaactgctttatggattttcttgagcaatttaacacaagattgattagtgatttctgtctgtagaaaatgtttgattccaggctggcttagcctcaccacacttctgactgcctcctccctatctgaggaggctcagaaaatacacaatcatttcaatattcacctaagcaaaataaaataggaagataaatttctgccctgaatactgtgatgcgtaatattaatacaaaactccaagagaaatacatttgaggtaattttttttttaacttggataacttaactgtgagtagaggcctgtgattccacaacttcactaatgtggaattttttctttctttccattagtccagactctagactttgagggtggagggggaactagtcttgttcaagctggagttccttattaatgagagatagtttagaaatcctgaataaggctttggaccagacaataaaaaaggaaatgtgaaagctcagagccttctagaacaaagaaacaccccaaatcttatgcctgtcagctggatggtgacagtacccagtagctctgcagtaggcaccagagcatctgaagtacaactggtggacctcgagagaatgggagctagctgaaaaccattctctccttcttaatgattatccattagcacaccatgtttttattgcagaatagattagaaacaattagcaaatggaaaattgaagaggcccttgctgcttttagtgtttagatgtaacttttgaacagaatcaaaatgctctttttggagtcagatttgccattttacctgaattccattttatgcgtctgccatgggttacatgcttcattccatttaaaaacggaaattttctggatgtagattcagtatgtcttgctgattgctgcatttatttcagatgctctttagaaagcattgtttagtaagctaactttttcatgctgagcattaaagtgatggttgaagcatattccaaagtcatcttttaactcacaagaatatggaaccatattgacttctaccaagacagtttaatcattcattgttaacaaagaacattatcatttttattgtacttgtcattacctattactgtactcttgtctgaaaaggcactatggtataagaaaaaataatgaaattaaacgaacaatggatctgattttgtcaatgctcaggaagtgaatcactcaatgccagtcctatagaattcagggaaacatcattagggcttcaggaatttcgactttactaatgtggattttgttatatttctcacatagacttggatgaagctttatgtgaatgcaaattttctcatttcttatattgatgcattgtttatttgcatttttattgtaactcctccaaagagaagaaaatcttggttaatatgcagattagaatttttattgaggattgtgttttattgttcttaaagactaaggtggtaaagaaggttagaaccccctgatgaaatctgcatcacattcaaagaaatagtacttagtgagattttgtcatgaacactttcacagcttgattctatttctcattatatcccaattatcaaacgaaataaaacaaagccattcctatagaatgaaacacatgaaaatggcaaactgcctgtaaaaatgaacaaggaaatactgatcttcaactattcctatacccttatttctaacctaatgtaccaactctccttctctcattttcttttaccaaagtactctgaggcagagaaattaaatttctatctaatactattggtgaaaacagaagactatatgagaaacagagaaaatctccaaacaatcatggtgtctcctggacttcctaatatggaagtcatctaatatgattaagtaatgcagcactagtaacatcaccagagttcacagtgaaatgttttcattcatccccactggaactccaaagcaccaagtggacttagcatcagaacttaagaaactgaagccttcgttagccgtaagtctttgcaaagaaatggaatcacagttttgatttatgtaagaggcacaaagcaaaccattactctgtatccacaaatgtcaattgtagaggagcaccaggtatctgagaggaagatctttgagggatatgctgcttcttatacccttttccaagctcttatttgtttagagtacaacaaaaggaaaggctgagtaagagaactgtgatagggtttgggagaaggaaggaaaattccatggacatatactagccaagtaacttacgtagtttgggtcacttgttatctgttaactacccctaactcctctagtgaatgaggagtagtggtagtagatttctgaaaagacaacacagtgtttattacctaaaggagcagacttcctcaaatgtgtttctgttggacctttggattgtataacatactgtttggggacagaaatgaaacttcctagttatatttttcttagatgtatactatagtgggtgtgtattatctgtgtaattcccccaactgtaatatatttcaaatcactttattctaaaaatgaagtacatcttacatagagcaacattcaaataaaatatttgccatagaaaatagagggtacaacgatggttactagaggttggaaagggtgaggcagggagtggggatggttaatgggtacaaaaatatagttagataggataagatctagtgtttcatattcacagggtgactactgtcaccaataatttattgtacattttaaaataactaaaagagtataactggattgtaacacaaagaaagggtaagtgcttgaggtgatggataccccatttactctgatgtgattattacacacagtatacctgtatcaaaatatctcatgtactccataaatatatacacctgctatgtacccacaaacaaatttttaaattcaaatttaaaaaattaaatgtgtgtcatgagaatttctaagaagggcactccaaatcattggtttgccttgctagacaaagtgtaaattattttaacacaatatacagctgggtaaaaggaaaaaaagactgtgacttgtttgccacccacagggctgtcaggaaaggctacaacatttcacttctcaaggagtaagttccttttacagattaaattggaaatacagttacattttatttcatctcaccaatgttgaattaataacctatgtgaaacctttatttagaaatgaacacttcaagcatgcgttaaattagcaactaagtacatagcttataagaccatgaagaatggttatgtttataatgttcatttttaaaaaaaaatattatactttaagttctgggatacatgtgcagaatgtgcaggcttgttacatagttatacatgtgccatggtggtttgttgcacccatcaactcatcatctaggttttaagccccacatgcattagctatttgtcctaaagctctccctccccttgccccccacctgccaacaggccccagtgtgtgatgttcccctgcctgtgtccatgtgttctcattgttcaactcccacttatgaatgaaaacttgtggtgtttggttttctgttcctgtgttagtttgctgcgaatgatggttttcagcttcatctgtgtccctgcaaaggacatgaacgcattcttttttatggctgcatagtattccatggtgtgtatgtgccacattttcttcatccagtctatcattgatgggcatttgggttggttccaagtctttgctattgtgaatagtgccacagtaaacatacatgtgcatgtgtctttatagtagaatgatttataatcctttggttatatacccagtaatgggattggtgggtcaaatggtatttctggttctagatcctcgaggaatggccacactgtcttccacaatggttgaactaatttacacacccaccaacagtgtgaaagcattcctatttctccacatcctctccagcacctgttgtttcctgaatttttaatgatcgccattctaactggcgtgagatggtatctcattgtggttttgatttgcacctaatgttcatttttatacttaattattttagaggcaggttgttgctatgttgtccagactggactccagctcctgggctcaactgatcgccctgcttcagcctcttgagtagctgggactataggcatgcaccattgcacctagccttacttaattaaaaaatatctttctagaacatttttagctcattgcttcagaaggtattaatgtgatggttcagatctgtcattcattttttcaagtcattactcgtgtccttcacatttcagaaggattagagagataagaagatcaactttcaagattatgtaagattgatagaaaaagcaagccagtatttccaccatcagcttgagataagattccatattttgacttatacaggtgatagaggcgaatgtttttcaatttgaggtatttgtcagaataggcaagagatgaggacttacactttaaaaaattcttctttaaagacaagtttgagaataaaatcaagctatgattatgtagcctagtagaaataatatttatcatcccttaacttgtaaatgagaaaggtcagtatcattctttctgttgtataaattttgaagctcaaggctcagagcatttgccagactttagtaagggtcatctttaaaccagtgaccgatccagagattcctctccattagaattcctggatgtaaaagaatgtaactggtcttgaccttaagctactcccgacactcgaatgttcaaatgtctttcagacaaactgaaaagttattttccgtactattatataagaatgattattcttttgcattcatagattgaatttaaatttgtcataattgtaacttttgacttatatacctagcctaaataaataaaaatgtttactttaaaaagtccaattagaatcattggcttaactagttgctttcatttaagtattcatacaaaagaaaagaggttttaaggattagtttctttcatgtgctaggcagtctagctgatagctgttgtagtgaaggcaatttctgttagtaattgctggttgtatttgcttacacctttatttaaaggaaacttgtctgttttgacagtctcacattttttgctcattctgaaaattacttgggaaaattacttgagtgcagaaaagttattttctttgtattgtagaaaaacatccttccctcctgaacacaaatattgtagtcctggtgaaagctaactgctcaacttcacttgttggctttgtttcagtaaggttctgccattacaatggaagcttatttcatagtttccactttcacgactgatcctcaataaaagaaaacaaccagttaagcataataaatatttgatttagtaacttgaacatagtcactttaaaaatcagaagcgactctataaggcaagacctttattagaattctctgctgtcctatgcagtaatggaggaagaaacataattatcaaagatctacatcaatgacatatttcagattgtgatttctgacatcagtgtagtaatcatactgggaattggttgtttttatttctagcaggcagaatctgaattttggttttggattaccagaataattgcttctcggccttttggctaagatcaagtgtggattaccagaataatccttcatagagcccagtagtcagtaaaagatttggtttccttaagtatatagtcaaagccattaagtggaaaattgagataataaaagtaggcaatgtagttccgtcatcacatgcaatatgattgtataatattgtgtcaaaatttcaaaatagtttcaaatagtttatgcatacccatgtggcttgaggcaaaagctcctaatattggctctttagggctaacggcaaatgcccatatttaaatgcttgtgtctataggaagtcagtaattgctaaaggtaattctgtttgcagttctaataagataagtgaataacatggtgattaatgttattttaataatagatggagtcatataaacacctaattcttaagttagtgggttgtgtttgttcatgacaaatgggaccccggaggatcaaaattaaagattcaactaaatattttcattcatttccaagaacctagtacattaccctgcccataggcaatcaataaatatatgccaattaattggctttttttttttaaaattgatttccaataattcctaaagaacaaggtcaaggagaataatatgtaggagtcattttaccaataattgataattgagctcagagtgcacaggggtgatctatgaaacgccatcatgatttctgaaaagctttagcaagggttattaaatataacagattatttcattcagtactatcagtctgattgaaaagttaggccttaatgatgtccatagctggtattttgttcctttctatgtgtagcatttccctggttaagatgcctcacaatgttctcaaattagtatctttcagccttctttgttttttggacattgtgtctgttttttgaggaggagtctgcctgccatttgtttcacactttagtagtacctacctataagattgaaaaggaggttgtgccccctacttttctgacactttaacccaccagcattaagctaataacctactggcgtctgccagaagatttgttagtgttaaacccatatgcttctagtgtttggcaatgtgaaatattataccaagtcttatcattcaccggttatcatgaacccctcaaggtgctatggtctcctcctccaataagctcagttgaactccttgccaaccaagagatactgtgacaggattgttcttatttgctgttgctatcagctttgaggagccactgcagcctagagaaagccttagaaaatttcccaaggcaactctgctattcccccctaacacctactggatttacatacgctatgccattgtattccctatgataatatatgtaaagtcctgtacacattactgacatgctatacgtgttgaataaatgtcagctatttctattattaaatatccattattatgactgagcctctctagtggcccttaggctaaaatgactgttatacctcagtctaggatgctcttactaaacagcagctccttctctgattaaagcaccatgtgttctcaaagttcctatagtgcactatgattactcctactttggtactcatcttgccaaacaatacttgcaacatttatccttcctgtttctctaaccagactgtaaattctgaaaaagcaggaaatagctgtgacttgttcactgtagtatccctagggctttagcatagtgtctacacttttcatgcatgtagtaggtgttcagtaagtgtttattgaattaatgaatgaatgaaaagtatcctagtatcacaggttctgaattattcctacagagaagtccccaaagaagctatgtattctccagttaccctctgaaaccatagggtaagcataatcaacatattttctatgaatagatgcaaagcgttaatattagcaattatgctccaaatactaatctcaggatggatgtaacataataataacactttaatattaattaaaattattttattgcataatattattttaccatcattattcagtatcattactgattggctaaaatctgcttagagtagcagcttcgaaaaggcatttcacctctcaagtaactgtcacccacattcatcaaccctggtagcccctccttagcacatcttaaccctctctcactttttactttgtctacctgttatcaatagtctcaccaaattatatacacaatctaaacttctcttgtttttctttaaccaattagcaagattctgaataaatgtatttttgacctttttatatttactccttctaccatcgtcaagatagcttcctacattatatatttctatcccttcatccatccaaacatttattcactcaacaataatccacagattgtctgatacttgccaaaaacttcctctgccttatctgagcttatcgttaaatgggagaaacagatattgaacagacattgaattaaaagccagtggatactcagggtttccttctttctatgatacggccactcccaaatgaagactaccaggcacagattactgttgcagagcaacagtttgacaatattttagataagggtattaacaaaacaacaagaaaaacctaggaactactatgtagacaagaagaaggtacactagaatgaaatgcatttttaggtggtcactatcaaaatttaagctcttggaattcatttcctggcaatgggaggagcagcctcactcctcaaaagctatggaagagcagaggagtggaaaagcacttgcagagaaatctcctggggatttcttagccagatatttagaaatagggtttaaattcttcaagttggaggattctaacctatgctctaaggatgactgatgaagtacagaaagaaaagcaaagtttaccaaaaaaaatgaggtcacagaatttcattacctgccatcaccccgctatttatgtatgtatgtatgtatgtatgtatgtatgtatgtatttttgagccggagtttcactctgtcacccaggctggagtgcagtggtgcaatcccagctcattgcaacctccgcctcccgggttcaagcgattttcctgcctcagcctcccaagtagctgggattacaggtgagtgccaccacgcccagatgatttctgtatttttagtagagacggggttttactatgttaaccaggctggtcttgaactcctgacctcaagcgatccgcccacctcagcctcccaaagtgttgggattactggcatgagccaccatgcccagcccatcaccccattttgaaaaccaaaagcctaaatcactcaccttgaagcagatttgatgctgactatagacactaattgattgttagtcctgttttggtttatacataggggcagccattactatgctattttattcaggcacgaagtaattgttttatatgaatgcaaacattctaaaatactgccattcattcctcaatttataaacttcttctttaggaaattgtattccttattataggctgggtgaccctttacaaatcttaacttattttatcctcctaacaactttatggagaatgtactatattttccccattttaaagatgaggaaactgaggcatggaggtaacattacttgcccaaagttactaagttagacccgactgggttctaattattgttctgcaacttactgacttaaaaactcaaccagtatgcaaattcaaagcttccttaatacagaatgtaaagtgaagaacaagagtgtacagcacaccaatctgggacgctatttgccattagttcagatttttttaaaggcatgtaatcaccccttatacatttttccttttcccagtgtgccaaaatcagcaagccaagacagttgattgcagtgggcatgtcttaaaaaccagtttccatgaaaggagcgactaaagggcctattgtgcttgttgccttacttttattttgagtccagtatctagtctgttagtttatatacagaagagactatcttgcagggaattcagctaaccctctgcactgctcttaggtcagggccctgaacctttgctcctggctaagccatcccaggtatttgattagatacgttacttctgagttcacttattagcaaggcacactatgatggagtcctgatgtacctacttgccagtgagtagaataaagatacattttgtgtttattgctgttgataaaacacttgtgtaaagtgtaatttataatttaatcacttttaattcaatttttaattaaaaatttaactttttaattttaataattaattactaataattaacttaatcattctttttttctttctccttcactatgcttcctttgaaatcatttccttctctaaacaacattggaagcgtggcactgaagtgatagatttttgtatcccattgtacttaattagcaagttgtggcatgtatttggttaatatttctctttctaaaaagattattatctttgttttggtaaattgaagagaaattgtggtccatggcaaaaagaatgaaccatgaacccatctgtacggtatgtgctcagcctgagatgcccatattctacaaagagcaatttaagcatgagtgatatcaggtgttaagcccccatgaaacatcagagataaatactaggtccctggctaacctgctttcgatgttttactgttcaatctgtaatctgcagtgtattttaattaaatcatcaaaattacagaattttctttggaaagatgtattcttcatttgttgtttggttcaatacaaggagttggcatttctgatatgttgagaagatttcactttcacatattactaggataagtccttgaaatttactagccatcaggatttgctgcttttaatgattaattacctgttggcacacttttcaaaggtattctctttagctgtttcctttcatcttgccctaccttttttgtgaatagcctttcatgtttagctcaaaagagtattcataaaggtttatttcgtttctttgggtagagatgctgatttataattttaatgcagttcgtaacagcagtgaaaattaaagtcctgagaactgtacctcagtagggtcctaaatattttatgacaggtctaattgtttaataattatgcaaagaccttaaaaatttggaataatttgtcccttcactgtaccaggctaccaggattcatctatcccttaatttagtaaatttttatgtcaggaatagagtaccatgtactgttccaaacactggagtacagcaatgagcaaaacataatccttgcccacagggagctcatattatagagagggtagacagactttaaacaaataaagatatagttttctttggagaataaacaagaagggttagaggggtagagagtgcggagagataagggtttctctttcatataggatggtcaggggaagcctctctgttgaggtggtatttgaaggatgagaggggaaggttcaggcggatatctggaggaaaattattcaaggcagaggtgtaagccagttcaaagagtcagaggtggggatatgcttagcatattaaagggacaagcttggaagccagtgtgacatataaaatgaaaaaagaggacaaatgatacataagatcaaagacgtagtagtggtcagatcacagatgatctcataggccaagtcagggactttgtctttgactctgagtgaaatgaaaagctattgggaggtgtagagtagaagaatgacatgatctgctttatattgtaaattaatgttatactacatgtatagtttacatgtatagtggccaactaacagagtgaattagggaatgctatcaaggagtccacaattttccctccaccccatgtggcctcactggctttgctttgttccacagacaaagaatgaacctcagattttaacaaaacattgtggacatttgctctgtaggtcagaatggaattggcaagaaagtataattagctcagcccatcccatctacactgcacaaagaaaataatgagtacactcatttaactcagctatcagcagtgcagcaaaaacaactcccactgaagtgagtcaggagcatcttcataaaccaaggcaagcatattacaccctaaatgatggctcagtggcctcaaggaaataaagtatcttcctaagcacctaatttactaccaggctgtgactcaggctcaggaaaaatcgaatctattattatatattcagaatacagtgagcaactgtggctaaatattgagaatacttaaaagaatggagagttaatattgctaagaaaacaaatgtgtagtctgaaattattttcactgcttatgtgtatgtctgtcttcctgtcactgctgtttacacacccatctctttgcttttttgttggagttgtacacataatttgatgtgcttgcacagagttaaacatccctattctaatggcttcatacctgctaaatttgtctactcctatttccttcaaatgctagaaaattagtgaagtccctggcaactaagtatagtctgcagagcttaccccaaagctatgagatttgaaactctgttagtgtttactcagagtcttcatactatcttttactctggtcacttggcttatggttcccctgttccttcctcctccctatggttttcagcaaatatccagcttctgtaaacattccttcagtagatctgaattgcatagagtataacttcagtgacaccaaagtgtgttttgtagcatgttgtttctgatgattgaagcaatcttcctgtgcagaaaggtgatttaaaaatggagccgccttatacaaaattacagctagataagaggaatgaattctggtgttgtgcagcagtaaagggtgaatatggttaactataatttattatatagtttcaaaaagctagaagagaggatttttgaatggtcacaacacaaagaaatgatgaatgtttaaggtgatggatatgctaattatcctgatatgatcattacaccttgtatacatgtatcgaaacatcactcttatcccattaatatgtacagttattatgtgtaaactaaaaagagaaagaaaaaattgaatcttaatatcttatattggcatagaatgtagtgtattgtttatagttcactatgattaattgactcatatttggctagtcataacatgtacgacttgtatgttcttgtaggaacatgtacgacttgtatgttcttgtaggtactgtcatgatggcaacttgggtcattctgaagtgtgattctgaaagatctggttttaggtttcaacaaaagttatttaaattttaatctgttccttgctctaggataatcacatttttttttagagattggtaagcaattagctgctgccgcttctaatgataatagaatacttaactataacatgaatttaccaaatgaatccttttggaatggaataaatgctcaagcaggttattctagtaggaagagattcatgcaaagtagagttatatcttgtttggccagtgtagactatagaactcagttttggtctgttgtcttcttgctgtaagaatacactttaggatacttcatgagttcaggctgagacctgggaagtgctctttggacaactgtctagagaaggcacatgctattccaaaagtgctaagcaccatggttgtcagaatctagtttaggaaaactagtgcacgtgataggcacttaagaattctttgttgaattgaatgagtaaactcttcattaaatggcatatagaaaaaatggtcttcataagtcagccagaggtgataccacacattctgctaaacaacaaacattatgtgaagatgttgttcagaggagttctgactgtctagggaaatcatgcattgtgattctttacacaaaccactttctttctggaaccagaacttatacctgctttacctagagaacagaatagaatagctaggctcatctgaaaatgttttagttgatataaaccagcacacataattgaatgtcttcttttctgaacaactgacatttgagagtcagtcaaagaacaagtctatgtctcctttccccagtagtgagcttcaaagcagagcaaatggatccatgacagggccgaggagggaagaatcagatgtggagtgcatgcaaccctacccccagagacataacttgggcaggagaggaaaagaatgtatatctggtacaccctgtctcccttacagttatcacctttccatcaactgactgtgtttattttagttggaagtcagcatttaaccagttctgcctgaagcttagtgagggagtttgattctgagaactgtgttctcactgaagggcaatattctctttctcttggggaaggagtgttgtttgtatcctcctgatgttgagggatatagtagccatcatcatgtaatgacataccaaatgtattttatctgagagtttaaaaattagaagcaatccaattgctgatgtgattcatgaatagatgatgcaacttataatgacttggtgataacaatttattgtataccaatcacgtgcactcagaagaacctgtgcatgaaatcaatgtgagcgctaagactaaatgcaaatatattgtggacatttaaagttttagcccccttgattatctttaaggtaatatatacaacatatttgccaatatagatttttcttcaccagccatctggtaaaaattagtatgagataaataatttagcttccttctgttcagatacaacttcattatcctcttccttgatgctgtgaaaagtcttcagaaataatcaatggtaaagtgcatttgcattcctgtcaaagctgagcctggaggtttctgacatgctgacgtttgattctttttctctgtgcgctgtgaaaaggagaggtgcctattatcaactggccccaaagaattgcgtgcatagtggcagccttgcacaagtgcactgcctgctaaatcacagtgtgaggaagcatgacatgacacaactgggatgttcgagaactgcaagtcatttttcaggatttaaaaaaaataatactgcagaacataagaaagagatttaggaggaattagttacatactccttgtgacctaatgattctctctctacccacagagactatcttacccttgaagcacagtaattggtttgtaggagatatttttccattcataagaaaaaaatatctcctacttttcatcctggacttatttctccaatctggcttgagttgaggaatcttatgctagagttgtaggagagcaggtgccagattgtggagggccttgaacgcccggccagggagtttagattttatcctgtaggcagcagagagccattaaaagattttgagcaggaggaatgtaaaaaataggacttgatttggatgcacgcttagtataaaagtgcaatgataagatatattaagggagtgttacggttctgttcacagcatgaatataactgtaggattcatctctactagctgactagttcagtttttatagcatgcaaattttcagagccagctgtaagaggttgatggtaaaagaacaaagtacgaattgatcatgtgaatgtaattgtaaggagggatttttaaatgatcaagatcactggtaacacagaatagtaatcattttaaagggtgactgtagaattatttgttattttgtttgagttatctgaaaccacttctatgctatataattaccttaagttttaagtgctccctgcagggataatttatgcattttgcattctcatgcaaatactttaacagtctacattgttgaaaatagaactgaacattatttcagataggtaatggttgtacaaagcttatgaagtattcatcatttttatatattctcatggtttatattatattactgtgttgtgttttcagctacagtgatacttaggtaacaaatatttgaaaatttaaattgcatgttttgataaagaactgtaatttgccaatttcaaaatttaatgtcatcaaaatccttttaaaatattaatataaaatgttgcagtatttcaggaaatacaaggcaagccaaatttaatttaagctactaggggctcagttatgaattgtagctagatacgtggccaaacactcccgtaaagcattgcatttttaggattcaggcttcaccgcagtggtttctgtagagccataatataagatgataatcataaacagcatcacaggcgatggcagtttagtcgtaaataggaaaccgttgtcttgttcactgcaacatagctacacatgtaagcattatatatcccttgtgaaaatgtgattcactttatgatggtgacattcatatttcaaagtgtcttgttttaatgagctttcacaggatttctttgcaccaatcttgaacttctcaagagtcctggatttccttttttttttttttttttttccccagagatggatgtgcattaagcataggaaaacctccaggaagaaatatgtttactcctctgtttggctcctctatagacactaactttacagaagaactttacttaccttgggcagcctatcggatttcaccctgagctctgagcacagctgggagtttggacagtaaagagatgtcttctccagcaaaggggagacaacttactttccagccttccccgttaaacattcacgggtgagggtggtggatatttctcaaagtccacaggtttatagaattggggaaagcaaatggcccatttttttaactttctgtgttttcactctctgttgtctttctccgctttgtatttctgtgtttcgctctgtctctctcatgtatgtatgcatgtgagtgcacacatacacacacacgaatctgactaaataatttatatatctccttatatgtgttacctgcgtctgtacctgaaaaggcagaagcctaatttcagtaaaggtgctctagggtcatttcctgaatacctctagagtagagttcactggaaataaaaaacccaacatgtgcccaaactcagttgtgagtatttttgcagtagaagagtgaacttttcatgccatgatctaggagaatgttaagtggacagatttatataagataaatggaatgctgctgcccgttgtaatggaaaaagaagcggcctaggggataggctgcctggcttggcttctgctctgtgtcagacctcttcctaccctctggaactcaggatcagttggagctcctggatcttcagtgtcttgcagccccagaaatatcacatgccagtaccagctaccgtaaacagattccagcttcctctagaaggagctgcttccctgcactggattagttctccagcagaaagtgttaatgccaggttccagtgtattagcatctcttgtttcatttctttgactctaaaacaagctctttagagatttttttaaaagtctaccaaaacccattataatcattacttttgttatcattacttttgttaaactgtcccttacctgtcacttgaatgccataactattcaagcagttgtagaaaactttaaatgtaggcactgcttaaacataaaatactgttatatttttcattattgttattagtaatctacattatgaaagtagaactagtaaaacagtggtttggaacaaaagaagtgagataataacattgtagttttgtagcatagtaattaaagtgagatgtgtaaatgtcatctggcctattaatatggaattatttcacaaatccctttattatcatgtggtctcactgatacacattatagtaattctagtattagattcttagaatattttaagcgctaaatcaaaggctcatgcattgtcatccttgaaaaggaatcactactgtaagcatttctcacacatacaattaatgtgtagcattagcccctcacagaaatggaaaggtgcttttcttctctgtttttattgaccaccaccagtttttataccaatttcaagttgcggggtggggagaatactacattttcttatatatcacacaaatggaaagttaaaggaagggaagagatctggtagttgtcgagcatttccacttaagctaactgcttccccatgccttctgtgatcttccgtatgaagcacatgatgctgtccccatcttgcagatgcaggatcagaaaacacacgaattgcctacagtcagaaaacttggaagtggaagaggcaactttgagctgagctcttcaaaagggccagggcacacaaataggagggagggctgagccttcagcaaacgttgaagttgcgcatttagaagggagttggcattacagctgttgtctacccagtgactactctgtgggtgaaaaggtgcacttgcaattgagtttattttaaaaatgacttgttaagggcaccattgctgtgattttctcacctgtgaggtgggaggaactctcctctcaggccagagggaagtaattactgagaggtgccttcaagagtaaagcagattgttatatatttcaaagggggctgtcacagtgcctgggacacagtaggctttcattaaatcctagattagaattaattcttctatttgggtctcaaatgaataaattggctccctccattcagattcgtgacaaatgactgccactagcatcctctcatgtagctcctttcaaggggctgatgagtagaaatgcattcttcataaaaaaggttcctctctttagcacttgttatcctcagcagtcatttgcagatgtaatgtgatgcagcagtttaatagtcctctgcagcaccattctcatccattcaaatccttggtttatagatgaggcctttgcaccttgccctgtgacaccagcttttatgttttgcagcagaaagaatgctatagtgacttccatttgagcagttgctgttggctagcattactttcctacttgttcaagaaagtctcctttcaaagtttttgaagaagcagactcctaattactgtgacacttttcttcagagacaaaccctaccaaatgtaacagagctgctatccaatgtgtgtcaaaagtgtgattctcaaagattcctggccaggtgcggtggctcacacctgtaatcccagcactttgcgaggccaaggcaggtggatcacctgaggtcaggagttcgggaccagcctggccaacatggtaaaaccccgtctctactaaaaaaatacaaaaattagccaggtgtggtggcccttgcctgtaatcccagctacttggaaggctgaggcaggagaatcccttgaacccgggaggtggaggttgcagggagccaagatcatgccattgtactccagcctgggcaacagaacgagactccatctcaaaaaagaaaagaaaaaaaaaatcctgaggtacaagaatataatatgcacccaccttggtatcattttatttttaataggccttgccagagcttttcaattcatctaggaggaaaggacctttgtcttgtgcatgacagttggttggatctctgtgaaaatttttcagagctcctaagctttgaatttttagtcaagtgcttgcaacagctatttaaaaagacacaacctactaagcttgttctcctgataacatgtacttcagaactcatattcttgcagctggatttagatcccactctgaagtcagtacagagaagaggactgccacaaatgagaaagcttcatagtagcagagactatgtatccaataggcacaaattaattacagagaatggctaaaagactagaaggtttgtttttagaaatcatatctgatatttgattcacctttcaaaacacatagatcaacactgccattaaaaaaaccaatatactgaattaatacacataataagcaggttaatagggggttttttagggggttattcaccttagagaagtgttcttcgcttgaaataaaaaattccacagatttctgttaaacagtgagatgccctaataagttttaaaatatacaacagttcacacagtctctctagaacatattttatgtaaaatgaattacaccctctgccacctaattggattgcctaaacaatccgtatccttctgcagggttaaggtcagactaacacagtcttgggccagtcacacagtcttgaagacatatggcctatctctcttctttgtcacgagtctcaacaagctacttccatgtcaaaatgtatttgctgaccagtcttgcaggagagtgaggcgtttggatcatgtaatttttgtatcacgacaaaaataacccatcttagcctctggaagggatgtattgtatttgtttgttctcattctttaacttctagcttatttcagtgtgttttataaaacattgttttggaagaatggagagcctgggtaatccattgtatgacattgctttagagaaatatatgaaaatccagaacaattcagtatagaggactaaatgaactccagggctgaaatatggtcatatctgagtcctagctctgttttcagcagtccattggttgacaggttcctgaatagttttcttatttttgtttgtgaagaactaaggagaaaaagcaacactgtgttgacatattttgtggggccaacataaggtaaattaaaatatctatgaaatatctaggaatatagaaagtcttggtaaagaattcagtgtaaccatatgaggcaaaatagtcccaatgtgcatactcttaattccaatttgcatttctttagaaatcgttgctaattaacctgtgtatttttaagtcattttgtggcatggtatttcatgaagcccttttatttaagcactgcatttctttagtgctatggcttggattactgcagccatttcagcctattgcagacagaaatgaaaaatgaaaggaggcaaaacagttctctgagaaccaagcttgaaggagagtgctgaacacaaagtgtaattcatgtacagtcctaatttttgatagaatttatattcttccatgttaataaaacacatatagccaggccttttttttgtaaattgattccatagtgaaaaagaatcttgaaaagtggatttatttatttggccttgatttctgggcccgtattatcagaagcaatcccacatttcatgtttatggagctttacaatattcagagcttctttcaccctagatcatctcattgcatcctcatacaacaaccagtaagatcagcagaactggtagatttttttcaccattttacaaaaatcggtctaatagaatttaattgaaacacttaactatttgcagacaaaaagaccaggagtatgaggttcttgcctatgtcaggattattaggaatttctttatttttgcttaagtattgttttgcttttgttattctctattcttttcctccttttctccctccctccctccctgcttccctccctcaccctctcccccttttctccatacctcccctccttcccctttctctcatcctttccagttttgaaattgaatttacctctaggccactttcctcctttgatcgcctactttttctgctctcacaggcaagtttctgacttgcctgtatctactttaaaatagtcctctattcattggaaaatgtagtgccacatttaacccttttttggatttacacaagggagcttccaaagtttcttcatatattctatttttaatttatttgtttcactaggtatgtattgataatttactgtatgccagcccttatgttaggagctgccctcaagtatctaatagtccagcagatatttgagtgagcaatccatattctgtttatcgtgaattaataattttgcttagctacagtgcactgggtgagtattgattccctcttccccagtctctcccttcccatgctttgatctcagtaataatgaaattcattcacatcaaatataccctggaagagaacatcaaagccctaaatataataattagtcctggattttgaaatcactggtggaggggaagcctgtatagagaatataggtagttacattgtcacccctatgggcatgatttatgttttaagattctgttgtttcaagttttttaacagagttgaaaatctaattttaatctgcatattaatttcattaggctggggaataattgatgtacacaagtcaaacctgcttaaataacctaacttttaatctggaaaattaattatcatcggaacatggctcagaattagaagagtgacccttgctattggcagtaattgttcaattaattggaatgatcaggctactgaaaatgtgactggaagagaggagaagaagagagaggtgggaatatagaaggaaaaggtagattagttaaaataggtttataaaacctactgaaaagaggaaactgtgtttctaggttcattatgaaacattctttaaatgcctactcataatatctatcaactgtttttctttctgtgttctatggttcttgctttaaaaaatgttacatgtgaattaaacaaaatgtattgagacacattaatctataccaggatgtgtgcacttggcaacactgccatcacaggctttgttcgccaggctgaggacttagtgttcccattttatgtatggacaacttcagtaccctctgttgttctctccagatccaagggaatcagtgcagcccatgtaaaaaaaaaatatgtttttgagagaaatgtgttaaagggaaacatttacagtctgcatggcaatcctcaaagcctcccatcctgctgagatacggacacacatgaaacagtgccaccctatcagttgcactatagctgaaaatacaagagcagggtgaaaaaaaagtatgaaaaacctgttattaaggcctatgtttgccaaattacttatttgcatcaggaaggcatttagtcttggtgtgtatcttttggtattggagatgtgtttaagacgctgaaacaacataaatgttttacagatattttagctctcatcattttggtatggctactgaagatatagctacacaccatctgctgactgacatggtccttacttggctcaattcagggaagccatcatcacagcccactcgtctattaacctggctccagctccgggaggccaaagagatactacactctgtccatactttgccctcggtgccaggggcaagccaggccactattgcttcttctgactgtaacagagaataacaatttatattgctcccaagcctttgttcgggggaaaaaacgttttctggcacacctttgggtcttgcggttatttccatatattcaacataactggttgcactaatgcattctttacttgcctctctaaagtctgtgtggaggtcttaatatgccctgagaagggcagctgatcattaacatctgtggctgtaacaattccccaatatgttatacagatgtggtgtttagggttcaaatgttttattcttgtcagtgatatttcaacctccaaagaattatttcctccttaataatgtgagtacattggtaaaaaggagtattagattttgctcctggatccacctactctctgaatgtagattcctcattccttatccaaaatattatcattatactataatgatactaactgataagaattttttttttttattgagatggagtctcgctatgtcacccaggctggagtgcggtggtgcagtctcggctcactgcagcctctgcctcccaggttcaagtgattctcctgcctcagcctcctgagtagctgggactacaggtgcccaccaccatgcccggctaatttttttttgtatttttggtagagacagggtttcactgtgttagccaggatgctcttgatctcctgacctcaggatccgcctgcctcagcctcccaaagtgctgggattacaggcatgagccaccatgaatttcttaaataaaaggttcagtattcactgagaagaaccaaacattgaactgcaagagaaatagacatgattatacagaggaaagatattagagacagattgattatttcattaactaaaaagttgttatttttctgaaaaaacatagatatgccaaacatacatttcttttaagagaaatcaacacataaaaggtcagaagacttaaagcatcttttattttgtactcatgtcaagtaatttctcagtaactatgcagggaatgcatgacatctttttaactcattcatgcattaatgacaatagcagacatttatccagtgcctgttaaatccagaacacagtgattgctgcctttatttagtgcctctcatgtgtcaagagcgctatggtaccttcttccagggcactagtgagcatcttccagatcagtcaaagtaggttggttccttggcatacatctacttagtctcctctgaacagggatttcgtgggttgggacaaatccaatttctattattcatatgaatcactgcagagacataggggtgaaactgtatccttttggtggacctgcctgtgttgggtgacatgctcacatttttccacatttgataaaaatcaagcctcttctgcctactcaacactggataaaatgacagtgtcatacacagagaacagaacactcctttggttgcttcagcattctttttttggcctcatttttctccctctttactgagtttttgagtccaaatttagtggtgatgactaagaaattgccaggatgtgacagagcattcagttcattgagtccttccttgccatttttcaatagttgtaacaattgccaagattttctcctgatgttataggtgccacgttataggtgccagatactaaattacacttgcagaatctgtccatgcagtgacagcctcattttacatacagctgatttcatgatatggtattaaggaaaatccctgcagactttttactagttgataattctgagtcctagaatttccaatatttaaatctgaatctctgaaattcaaatcacataaacaataatcaagcggtctgccatgtgctaacgtgtcatttttgttgggggaaggtagattggggaaaaaataagacaagttccctaccatctggagctaatcatacagttgtatgagtcacagggccatgctagagatgtagatagagtttatgggagcacagataacaggtgtaatcagttctgattgggagagattatatgtgattctggaaacagtcatatttgagctaggccttggagggttagaggaaagccagtaggtagagaaacaaaggaatgacattctaagcaaaggaaatgaatggcatcagtaaagcgcaaaggcacacatggttctgtggtgaatgacactggaagatgacgctggaaggcatggtagtgactgaattgtggagaatttttaaatgttacatcaagttgtttgttgtttttactataggcaaggtgaaatcatcaaaatttcccaaggaagggaactttgctttaggaaagcaaacctgccagctgaagagaagaaaccagttaggatgttatgacagcagtccagtgaagaggtaataaggcgcaaagtagagcagtggcattgggaatggaaggtgaaggtcatggatcacggactagagggcacaggaatgaaatgaaaggccctctgaagtgttaagtgagcaactgccaggatggtggattccagttactaagacagggaacacaggaaaagtagaggaagtgtggccctgtgcttcaaatattattcttccctgttttctgtattgaaaagctcggctaaaatgataccctctctgtgaatccctccctagtccctcagtcagaattaagtctggctttttctgttttcatacagcacctcctgtaagcctccctttctttccttatggtagcacacattgtatctatgacatttgtgtacatgcttgatacctacaaatatatgataagctgtctgaagccacatattacttacctatgaatatttagcaccgatcaactacataatggatccttagaaaatgtgtattaaatgaatgtatgaatgctgctatcacacaagacattaaatgcagcccatttttgggacctgacttagaatatgcaatgatcccatctcaccattctggagtcagccatacattgtttatgtggctatttggtatcatttgccttgatcatatgcatttttcaccagatatattttcaaaatggtttgattctttatgaaaggaaaatccattctccaatgatgacttttttccgtacagtgatttaattcccaaagaatttcagcaacgttctatgtacttgtcctcatcactaaaggaaatgtggagacttctagtcaaatttcttggtactttcttggctttctctatgttgagaaatcctacaaagaggagttttcacagcccataaatagaacattttggttcctaacatgtgacagttgccttagaagtacattgcttcttgagtaggttgaatttgtgtgaatcctctgaacatctatcgagtgtgcccctaggctgaaataaccccaaaagatacttcagttcgtgcattctgggagccagattgggaagatggggggagattaggcagattactgtgtgaaacactgtttgtagaatcccagaaaaaaggaaaggaaattgcttgagtgcttaaatttcagagaaaagctgccttgcctgaggaatatatccctctttgctgaagtgactgagagggcttcagatgttgctgctcagctagtgtgtattgcttaaaatggtatccaatatgaaaaataaaggaaggtagaaccatggagacattgtttttaaaagactagtgccccagaaagcttgcaatatttgtttgtatacatgtttttggtgatagtaccaagtgtttttcctgataacatctcagcaaattagcaaaaatctgatagtttaattggtgcctctatgacatgtagctcacttagcattttcctaataatcttccactccaagtaggccctttgctactctatggattacttatacattcaaatctactattcatttcatttagcttagaaattatcatttttaatggctgtttattgtacacatagacacgtgtacactcaaacacacaaaaggttttttgttgttgttggtttttttgtttgtttgtttgtttccttgaaatggtctattgagggcaggagcccttcatttgaaaaatccagtctaaagtaaaaatggccaaatgcatgacagaaaaccatattcctgagttcaaagtccactgggctgctctatcgtgtctgctagtaaaattgctgtaaattccttgcttttgtattgatttgcatgtaaatgttactgtaaggcaaggatggggtgaggggggaatttttctttctgtctcaagtcaaggtccaatgatccaaaaaaaatcaatttggtttacctaaaagtaaaaggtaggctttctttgtagcattcttttagaaatataggcagaaagcattgtaacacagatttcagcctgaggcaattgacaaccatagtgtataataactcaagaatccatgaaaattaagtacaaggaccgaatgtttattttctcatattgaaccctgaagggaacaaagctccatgtgtcagttttatgcttgtcttttcaatccttggctcttgtagttgtccaatatatttcacttatgtggcttgttctaatgttcccattacctattacaaagagagctaatcattgatcaatagcactttcacttatgactttttctaaagcatcatgtgaaatgttatatgtagtctgatggtttccaatgatgatagtttatgctattaaaatagagcaccagtcacacgagcttttacaaagtatgtcttaatctcctaaaaggcaataccacatgattctacaggaaattcatagctataaacactgaacttttgtttatttacttttgttgcaggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaaggtacatttgatattgtgggaactatggattatgctactaaatatacttatttatttattaaatttcaatagttttgggggtacaggtggtttttggttacatagacaagctatttagtggtgatttctgaaattttggtgcactcatcacccaagcagtatacactgtacccagtatgtagtgttttatccctcaccccactctcaaccttccccccaaccaagttcccaaagtccattatatcatgcttatgctttatgtcttcatagcttagctcccacttaagtgagaacatacaatatttggctttccattcctgagttacctcacttcgaataatggcgtccagctccatccaagttgctgcaaaagatatcatatcatttctttttatggctgagtagtattccatggtgtatatatataccacatttttttatccactcgttgattgatgggcacttaagttggttccatattttggccattgtgaattgcgctgctataaacatacctgtgcagttgtgtttttcatatgatgacttattttcctttcagtagctagccaggagtgagattgctggatccaatgctacttttagttctttaaggattctccatactgttttccatagtggttgtactgatttacattctcgccagcagtgtaaaagtgttccctttcaccacatccatgccaacatctgttgttttttgacattttaattatagccattcttgcagcagtaaggtggtatctcattgtggttttaatttgcatttccctgatgattagtgatgttgaacatttagaaatagtaatttaaagcagtccttaataatacttttgaaaatgaaacagttgttccacattaagacatttatttaaaaaacttacattttgtaacactcaaaaacatttgctctcctgattttaatttttccatagtgcatgtacatatagtgacactttacttatgtggaagtaacttacatgctaactcaggacagccaagatccccaaattatgctaaaatgttgcctgggcagaaacataggtgttaaaaatgtgtatacacagccgggcacggtggctcacgcctgtaatcccagcactttggggaggccgaggcgggcggatcacgaggtccggagaatggcgtgaacctgggaggcggagcttacagcgagctgagatcgtgccactggactccagcctgggcggcagagtgagactccgtttcaaaaaacaaaagaaaaaaaaaatgtgtgtacacttaacacttaccagaaagctccttgggtcctctctaagggcccaacatattatttcagcaaattttgcttatagttttcccatcattattagcagattaatagcaaattagaaagggtgagggacaagaataggctatggaagatagggaggtaagaaatagtgagatatggtagagaagagacagaaaatgcgggcaaagcagaggaagacttcaaagagattactagcctgaggtaagagtaggggtttagagtagaggcagacactgtgcaattcgaataagcacagcactgtgttttacagcacattttttggagccagactacctaaattcaaggcccaacttcactttttgctaactggatggtcttgaacaggttatttacctgtgtatgcctcaagttcatctgtataatatggataagagtacttataagattctcatagggactaaatgggataatgcatgcaaagaacttagagtagtatctaatgttatgtgttccataactataagctattatgtttatttatagcacaataataaattttaccatttactgtaccaagaattatccaatacttagactcttgaagtgtttcattttaaagtatgatagaaatcagtgttttaaaatattttaaattttaatatttgccttgtacagtatgctatagatcatatttaaacttctaagaggtttattaaatgcattttttattaatcctctcttacataaccatatgtggttgaagttaggcattaaaattctttacacactactacaccaaggctagatttttgcttaatctgaacctgtccactctctactgagtccttgaaagcagtgtttttcatgtctggcttaaggcacagaagcctagtaaccaaaagaaaagttgaggaccagtgtggtaggcccatttttttaatgtattttttttctctttttccttttctgaatttaatttataattgacacaaaaattgtatatatttattatgaacaaggtattttgaaatatgtatacattgtggaatagctaaatcaagctaattaacatatgcattacctcacatacttatcatttaggtgtgtggaatagaacacctacaaactattcttagaaattttcacaattggtatgcccatttgaaggccttttacaccatctttgtgtgcttttcagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttgtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaagaataatcttccaacatgtatttattgagcgtccattatgtgccagtaactgaagtagcaactggaagtaaacattgtataatgcagataaggtcactgtcctcagatagtctacagtctagagagtcatattaacatgaacactttaaagtgtgtttattttactagttactgtacttgcacttcagattggtacaaaggaattcacattcccgttcagtagtcaaattatacaaatgaggcgtttgtgctagtattttctctgccactcacagtgtcatttcccctctctgttgcttatttctctcctctctagagggaatacacaggactaaatagtgtcctttctacctttgagaactgaaggaaaatgtaaatttttttaaatgttgatgacttttctctagctccccaaagctgcattgtctggcaatgaacactttgagaacagtcaatacagatggtctctgacttacagtagttcaacttacattttttcgggggctttacagtggtacagaagcaataggcatttagtagaactcatactttaccatacaaccattttgctttttatttccagtacactattcaataaatgacatgagctattcaacactttttaattacaaaatttgctttgtagtacatgattttgtccaactgtaagctaatataagcgttctaagcacatttaaagtaggctaggctaagctatgatgtttgctaggttaggtgtattaaatgcattttcaacttaagatgggtttattggtatgtgacccccatcgtaagtgaaggatcatctgtatatggagggaagaattgtgaaatacataaaacgtagttgactagtgcttttcagagcatctgcaaataaaattactggggccccaaacagcctgcttttgcaaggaggggagactcctcatttctaagatgtttggaccagattcagcatgagctcctatccctgcccaccccagcccagtctaagtcaccttgtaatttcatgagataagtcctcctcatcctgcttcatcctgcctgagctctaaacacacctacatgaggtacgctcacctgcctagctatcttggatgcaggatcctttgtaccatgttttaaaaatcaggagatgctcactcaaccacctctccctattaactcttactaattttcaatcagtagggaaaagtagtgcattgtctccctctttctctaagaactttaaagtttggtcactgactacttcagttgctggtcttgctttttctgttgttcagaaatagtgtaggtctgctggtagtaagcaaattagcactatgtgggtctcagggatgcctgcgttaataggatggagtcaaaatgcccaggaagaatcctttacccccagcattctttttgagctgccttaaagttgctttaaacagacagtggtgttaaaataaattaataagtaaataaatagtcctcaaaccttcctacaagtgatgatatcaatactttcacacatcttcattacacacacacatacacacacaccctttcccaccccatcccctcatgcacatcctttagtagcattcctcctggcagaaaatactagtcctgccacataactgatgaaagaaaaaaagactctagtcaaatagttgtgggaaacacttcaaatactattgggtctcagatattagctcacatcagaatcacctggaaggcttgtaagactcagatcactggacttcaccttcagagtttctgattgagtgagtcttgtgtgggcccaaaacttggcatttctaacaagtttccaggtgatgctgaggctgttgatcctcgggactttgagaaccactggtattagttcattctcacgctgctataaagatactacctgagactgggtaatttataaaggaaagaggtttaattgactcacagttctgcatggctggggaggcctcaggaaacttaccatcatggcagaagatgaagggga

SEQ ID NO: 16996 - DNA, 5371 bp, Human
  misc_feature (1)...(5371): n = A,T,C or G
agaaagcaagatggagggtgccaggggctggggagagggatagggagtgagtgtttcatggggacagagtttcagtttggaaagaggagaaagttctggagatggacggcagtggtggctacataacaacatgaatgtgcttattgccacagaattgtgctctgaaaaatggttaaaataggctgggcatggtggctcacacctgtaatcccggcactttgggaggctgaggcgggtggatcacttgaggtcaggaatttgagaccagcctggccaacatggtgaaaccccatctctactaaaaatacaaaaaattagccgggcatggtggtgcacgcctgtaatcccagctactcgggaggctgaggcaggagaattgcttgaacccaggaggtggaggttgcagtgagccaagattgagccactgtactccagcctgagcaactgagtgagactctgaaacaaagaaacaaacaaaagcaatggttaaaatggaacaagatggtgcatacctgtagcttcagctactggggagtccaaggtgggaggattacttgaagccaggagtctgacactagcttgggcaacatagcaagaccccgtctcaaaaaaaaaaaaaaaaaggccgggcacggtggttcacgcctgtaatcccagcactttgggaggccaaggcgggcagatcacaaggtcaggggatcgagaccatcctggctaacacggtgaaactccatctctactaaaaaaaaaaaaatacaaaaaattagctgggcgtggtggcaggcgcctgtagtcccagctacttgggaggctgaagcaggagaatggcgtgaacccaggaggcggagcttgtagtgagccgagatcgcgccactgcactccagcctgggcgacagagcaagattccgtctcaaaaaagaaaaaagtaagttataatggtaagttgtatgttatatgtattttaccacaaaaaggcccgttgtactggaaacaaagaacaaataaaaatgtataaccattccaagctcatgggtggtccaagaagaaacatgagctggaccttggcccatgagcaatggctttccaacttctgttgcaggtgatgccattgatggaataaaccatgatttttctttcttctttttgagatggagtcttgctatggtgcccaagctagtcatccaggatggagtgcaggggcacgatctcagtgcactgcaacctccacatcccgggttcaagtgattctcccacctcagcctcccaagtagctgggattacaggcacacgccaccacgcccagttaatttttgtatgtctaatggagacagggtttcatcatgttggccaggttggtctcaagctcctgacctcaagtgatccgcccgccttggcctcccaaagtgctgggattacaggcgtgagccaccggccataaaccatgattttatttaccagttctattgctcatgggcatttgggtatgaatgtggtatgtcattctcacccagagacataattattattactattttagagaagtggtcttgctctgttgcccagactggagtgcagtgctgtgatcataagtcactgtagcttcgaactcccgggctcaagcaattctctcacgtcagcctccttagtagctgggactacaagtgcttgtccgcaccatgcctagcaagaggcattaattttgtcatgtttgcatcagccacccttgcatgcaaaactctgcttgtctacctgttcctcagaccacagcccctggcattatccctggggcaccacctcctgaccagtctctggacatgaagacggaggccctgttggaagtgggaaggctcccttcctcctccagcccttactgtctgctcaggggcttcctcttggccccggatgtgggaccggagggttgggggcccagggacttattagccaagccaggaagccccaccccaagaggcctcaaagaaagagctgcggtgcaggaattcgtgtgccggatttggttagctgagcccaccgagagggtaagtgacagctgctcctgcgcttgccatggcaccagcggggaggctggggtcaaggctgagcctccatccctgtcccccacatggggggacaggggtccaggtccaggggcagatcctactccctccatgggccggatcttccccacagggcagggctgatccagctgtgggtctcttggttccctctttcagcgcctgcaggatgaaagctctctgtctcctcctcctccctgtcctggggctgttggtgtctagcaagaccctgtgctccatggaagaagccatcaatgagaggatccaggaggtcgccggctccctaagtgaggaccccccacttgggcaagctccccaagggtctcagagacctcactgatccctggcacagacctgactccaacccagccccagcgctcaccaaatctcatcctcaaatccaaccagatcataaattcaaccccaactccactcccaacccctccgactgtccccaccttatccacggctccaaacccaatccccgctctcactccaaaccttcccttactccaaaacacccaactcaagacagggtcctggaggccagtgagctcctatgcccacagggacctagctccaaaccaacagggctaggggaggatgggggagggaccgtttggtctcacagctccccctgtctcctttcctcctgccccccagtatttagggcaataagcagcattggcctggagtgccagagcgtcacctccaggggggacctggctacttgcccccgaggtgagtgcaggagactgttgtccaggcgcccatttctgttccaagtcccctgggaatgccccctccccgccacgttccccgtgtccagcctctactcccctaggatcttggtcctgactcccagccttctccgcccaccatctggacactggtgtccaccctcactccctgcctccagtgcccattcagtggttggagcctccagccgtccccgtccccacccccggccccccaacccccctccgcgctccccacccccctcccgctcccaccctcagcctcccagctcagagtccacgctcctgtgttccgggctgcaggcttcgccgtcaccggctgcacttgtggctccgcctgtggctcgtgggatgtgcgcgccgagaccacatgtcactgccagtgcgcgggcatggactggaccggagcgcgctgctgtcgtgtgcagccctgaggtcgcgcgcagcgcgtgcacagcgcgggcggaggcggctccaggtccggaggggttgcgggggagctggaaataaacctggagatgaatgatgatgatgatgatggagcggatctgagccctgcgtggtttctttagtaggcccggagggactgatctagcgtctccaagagagtggggcgcgtagctgctggagggggcggggacaccgcgactttctactgccccatcgcccttcctcctatggggtctccaactgcttcctccgaaaatagggcctgaacttcctctagtgacgtccccacccaaggctcatggctgccttcaagaggtgacgtctcatctttgaggctaccttgacgctcaccctggggtctccgacctccccaggaagtggctgggtccttttcccccagtcctcataatgaggcttcatcgaggacctgggtcagtctgggcagtggacgggaccctccagggccccaagactccaggagccccaggtcagggtggaaccctgaatcatgtctcagcccagagctggaacctgtacccctcacttcctacctgcaaggaggaatccccaaggcacaggcaaagttgggttacggagagtcagggacgcctacctgacgtcacgcatcatcacaagctcacgttttcacacaggcaagtgcagttgtgagtagttagttacaaccagatacacgcagggtgcttaccccttcctggatactagattatgaaaacacagagcaggggacttgtctgctcctagatcccccccagggtttcgtttcttcccttcccttcccctcccctcccctcccctcacatcagaatacacatcatcatacaataataatataaaggaaaaaaagaatataaaaaacgaagcaagaaaacagaggtactcaaacgaataagaagcaggaacgagaaccatgaacctagaaaacaacaacgagctacaacagacaaacagccagagaacacagagacacacagagaaaacaacagacgacaggcgacaccagaaaaacagcaagacaggaagcaagagaaaataacaagaaaaaaaggagaaaaaagaaaggaagaaaaaacaaaaaagccaaaaggaaaagaaagaccagaacagaaaaaaaaaacgaaagaacaagnnnnnnnnnnnnnnnnnnnntgcaatctcggctcaccgcaagcctctgcctcctgggttcaagcgattctcctgcctcagcctcccacgtagctgggactacaggcgctcgccaccatacctggctaatttttgtatttttagtagagaaggagtttcaccatgttggctaggttggtcttgagctcctggcctcaagcgattcacccgcctcagcctcccaaagtgctgggattacatgcatgagccaccgcgcctggcctattttttaatttttattttcgagacaaggtcttactctggcgcccaggctggagtgcagtggcacaatctcggctcactgcaacctctgcctcctgggttcaagtgatattcctgccttagcctctcaagtagctgagattacaggtgcccaccaccatgcccagctaatttgtatttttagtagagagcgggtttcaccatgttggccaggctagtctcaaactcctgacctcaggtgatccacccacctcggccttccaaagtgctgggattacaggcatgagccactgcacccagcgcccccagggtttagaatagagcatggaacacagtagacgttcagtaaatgtctgttgatcagtagccacatgtgcacttagatacagcaccgacgtgcacatactgcacatgcacacacagctatacacagccacgtgcacacacagagtacacaacccacctaccacggccacatggagacaccacatccacagacacacccatgtgcccctagacactcttggacacagaaaggcaccacccccccggccaatgcacggagaatcgcagatttgactatggtgggcagagatgatgcaggacacaaacacacacatgctccaggcagactcttgcatttctgactctagtccccactgcacctggataagtatctgatac

SEQ ID NO: 16997 - DNA, 129415 bp, Human
  misc_feature (1)...(129415): n = A,T,C or G
tacgtcagcaaaattgtgaaccaacaggattaaccttttgccgtcttagtactgcagggaactagctttcagaaaattgtttgggggccgggcatggtggcttgtgcctgtaatcccagcactttgggaggccaaggtgagtggattacctgaggtcaggagtttgagaccagcctgggcaacatgtcgaaaccctgtctctactaaaaatataaaaactagccaggcatgttggcgagtgcctgtaatcccaggtacttgggaagctgaggcatgagaatcgcttgaacccgagaggcggaggttgcagtggctgagatcatggatcgtgtcactgcactccagcctggatgatagaatgagactctgtctcaaaaaaaaaaaatactgtttggggacattttggtcctgttttcttccctgacgctgatgtgatgctgatgatagtgagtgtttcaagaaccaggagaggctggttgttgtaaacattcctataaacgttggctcagagattgttaatgtaagtttttctggagcagtgaggtaagccccaagtagaaaagggcagaagtatagtaaaatttggttgttttgtcaactttgtaagacttcagctgcataccttgttaggaaactagaagccggaggaaagttgtgctgagatgtgtagcatttgttcttgctttgtgtggccattttattcccattaagtactgtatccttcactaaagaaatgggccattcagcagcccgcctgaacactgcggcactgtatattgttatagagagttatatccattcagaggaacacaacagatcagaggaaaggaaagaggtaaccatgtatgcagacgtggaactgtccccaacatgtataatagacaagccaaggtgaaatatatagcatactaatattcaactttttaaatttaaaaaactatgcatctcaaggcatggtggctcacatctataatcccagcactttgtgaggccgaggtgggaggatcgcttgattgcctgaagccaggagttggagaccagcttgggcaacatagcaagacctggtctctacaaaaaatacaaaaattagctgggcatggtggtgtgtgcctgtagtcctagctacttaaaaggccgaggcaaaaggatcacttgagcccgggggttcaaggctgtagtgagctatgatcactccactgcactccagcctgggcaacaaagcaacaccctgtctaaagaatacaacagcaaacaaacaaacaaaaaaccaaaaaccctcaaacactataaatccatagtttttatatatgtgtaaactatttctagaaaattactcaagtaactgataattagttatatctgaaggagggtgatggtgcggtggtaatgagactcacttttcatcatgtggagcagtgattcccagtgtgttctgggattctggggagtccttgagaccctttcaggagatccatagatcaaaattattttaataataatactaagttgtttttattctcattctctcacgagtgtacggtggagttttccagaggctcagtgacatgtgccattgcagcacactgaatccagaagcagatacgataatccaactgtgtctggtcaagccaaatatttaagagattttaaaaaatgtaaaatgatgtcattcttctcatgttgaagataaagttatttttataacaattttgaagataaagttatttttataacaattattattcaacaaaattactattatttaatgagttaatacacaataaatttcaaattctcagttttaatttcttaactgggcaagtatcagtttaggtataaacaacatccctccgagatcctctgggatacatccaattcctttagtgcctggtgtgcttggaaggtttctgttgcacggcgctggacaggagtgccaaagaggaaagaaatgtgaatggaaccaaagtctataataaaatattgctttctctttttcccagcctccatcaagggagacctacaagttgcctggggttcagtgctctagaaagttccaaggtttgtggcttgaattattctaaagaagctgaaataattgaagagaagcagaggccagctgtttttgaggatcctgctccacagagaatgctctgcacccgttgatgtaagtaggtccagtcactgaggctctgttaccacatgagattgggagtggtgtggctcacattgaatccccccacttatcctgcctggtgtcacagggaaagttgaacacttggtttctgtgcctagagctgctatcagatgagaagacaatgtatttgactatataggaaatctgttgtggactgtcaattaactcattttcacttccgttgatttggttgtgaccagccctagattagagggcagttttagagtgtcctggcctagaatgtcttcctcagttttgagtaagccagggtatctggcctctttctgggacttctctgcccttacaggacccactggaatctgtagggttccagcgtcaatctgtgttttctaatattacaatttgtttttattttttatttttaacaattattttataagttgttttcttctgggaataatttgaggtgatttagagtaaaacaatacttaatagaagcactacaaccagaataatagtacaagagtcctgtaattatattttgggggaattaaatgtaagaaaacctagcccagggatactgattgcagattcatacagtgcttagctgggactcaaggcaaaaagagaagcatgctatattgcagaacttttattaggaaaccatttccacatatcaaggtggtctgctgcaggtgaattttggtctgaatgggacttctcagttcatcctttggcaggctaaaatcccactgaggatctagaactgtagcaatttctagattgtgtctgagaccttcccagcctggagctccatatctccttcatgcctgtgcctctagcatctagcacagggtctgacacatggaggatgctcagcgagagccctcagattcaacttaggctttactgtattctgcacagcttctggaatgtgtgctgaatgaatgaatgagtgagtaaataatgtgaatgattattgggataagggtggggctaaagtggtattttcttacattccccagaagatttcttcttcctgtcgagatgctttttggattatctcttcctttctgtttattatctagggaatgcctcgctgctctttagcttcctggtggtaataattcacttcatagtttaatgtcttaggtttccttcttcccacagattgccttcaaatttgccttttcttcctccctccctttcttccttcctccctcctttccttcctcttttccttccttatgatagactcttggtatgggggagttaagaggtcttaacttgagccttcacagtgtatattttagaatgaataattcattgctatgcttcaccaccaaccagaaattattacagggtttctctattacatgagatttttcaaacattatttatctatgatttgttctgctttacctttcagaaactatcactgtggtcttttcttcccctgccactggagttttttttttttttttattttttttgttaacagggttttgctctgtcacccaggctggagagtagcagtgtaatcttgtgcaatcttggctcactgcaacctctgcctccaggctcaaattatcctcccacctcagcctcccaagtagctggaaatacaggcacacggcaccactttgtattttttgtggagatgagggtctcactatgttgtccaggctggtcttgaactcctgagctcaagcaatcctaccaccgtggcctcctaaagtgctgggattacaggcatgagccaccatgcctgggcaccaatcttaaacaatgatttccataaattactattagaatattcaaggcatatgctatatatagccttgtcctgtgaagcctgattttggtgcactcctccacccccactgtcatattatccctggaactatctcaaacaccttggctcctccaggaagagtccttctggtcaccaattcaggctcattctctttctgggaacgatcagactgagtatttcaatctgtttagagatttactaagttttagtttcttgtgtttcttattaatagggagaccaaataattcagcatccaatctggagaactaatgaggacaggagaagttattaataggtaatctggaacataaggcatactctggatgggtagccacctgcttttcaaagatcttgcctctttaatgggtactgagagcagaagggtaacaacagcctttggagattgaactcctgaattctgttcagttgtctggggctagggaactctgacacagatattgtagcactgagtatttctaacaagctgtggggggcctgtcccctagtggatgttagagttcccagagggagaagtcaagaccactgcagcaccgacggccccgtgcttatgagatccagtggtggtacccctagtcagtcttcctccaccctctccttcctcttttcccttctcctccccttcttcccttcccctccccactccccagtctgctcccttctctttttgatccttattctctccctctcccttccaacgcccccacctcggctccctcttgttttgttttctctttccatcgccttctctttctccattttcttctctccctttgccattcacagtgtcttcctttccttttctcttctaaaatggctcttccaaaatcactggagggcagctcaaaagagcaactctgccaatattaatttctccttgaaagggaaaagcctgcatttccaattatgacttagtcttcattagttagaaactgtcttttttccacagcaagtggcctaggaatggtgtgtttctcgcaagtctctggtcggaggtcctggttttatgtattctgctgtgcacgctttctagggcatgaagacagggcaggctgggccattggaggtgggggtggcagtgaggatggcggtctggctgtgacaggaacacacctggaaatgtctgcttgtcacagaatggattgcagctgaagtagacaaaactctgtgatcatgttgctgcataaacctcgatgtctgaaatttgggacgatggctgtgccaggattattttagaaaggcaagctcaggatcagtgttcaactaaccagagaatctacagctgctgtggatgtccctccaccagagagagagagagcctagcagaaactgaggagagaagctcttcaggccgctcaatggctcacgtccgtagtcccagcactttgggaggccgaggaggaaggatcacttgagccaggttggagagcagcttgggcaacgtggcaagaccttgtctgtacaaaaaaaaaaaaaaaaaatgccaggtatgatggggcctgcctgtcgttccagctactggggaggctgaggctgaagaatggtttgagcctgggaggttgaggcatggtaagccctgttcacatcattgcactccagcctgggtgacagaatgagaccctgtctcaaaaataaataaataaataaataaataaataaataaataaataaataaaagttcttcaaagaggaatggaggggaggaaccaagggctgacatggacaattctaggtaaacagggctccagaaacattctgaaaagcataagctgagagcagacttcagtaacatgaagaaagaactggggaggaggggagcggtctagagaataacatgctcttatttgttcatgggattcataaactgtggacaatatttttatttaccaaaaaggtaacaaagtttattgagcacctgtgatgtgtaagggactctggaagtattttgaagggatacaaatataaataagagataactccagccttggtttctcatgggctaataggaaaggaaaggaatgaaaaagagaattacactcaagggaggtaagcatgagtcaggacctgacaaatggttgaaggaaggaaaggacacttgtagctgggatgttcaaggaacacatgctttgaatatggagggtgtggagcttgacctaagccttgggggctaggaaggaatttgatatgcagaaggaaagatgtgggtcattatccttggagctgacctaggcagtgaggacccagagtgatctggcgaacacagactgtgctgggcatgtggagtggaggggaggtaggaaacggctgtctacttggggcagaggattgggttgaggagtggtggaagataatactggaaaggaggacacttgccagaatgtggaaagccctgactgttggctgggctaagacatctggacagtctggacaccattttagggattcagcacgtgcgttttacgtgctctagcagggaaggatgactttactgttagagatgctcatttctgatgtccctctcgctgagtgtgagtgcagtcctgaataagattaaaggtgtcataactataaaccatttggaaaatgtaaaaatatatatgcatgagacacttggagcaaggattttctaaggtctcaatttcttgtttttgctttgattgttatagcttataagagtagatttaagggttagccacaaactctattactgtcagagcagatttgggctgctaggtagaatcttattttcactgtttcaattctcatttctttgtaattttttgtattatactacatattttagccccaaattgtgggctgcaggaacaacgttgttaagtatttcttgctggctgtgttcactgaattgcttcctgagcctgaacttgctcaaacttcctgttttttgggcacagaactcctggtttctccatttatgatggatgagaggggtttggagtctctcttctagactttcatagcatgtttcaggatttctcactgatatctaattgtcttataagagacattaaatttttttcacactcaaaaatccatgatcccctctaggtaaggtctgagtctctgtcaaacattttcgcttttgtgtaacatttagcacagtatttatcaggcattattttgtttgggggtagaggaggtaggcggcggtgggcagttgggaccccccgtacttatgttctgctccaatattaagtcttgtagaaaatggtctaaaatagatctttactatctgaaatatcatctagtgagagcattggcatcatcaaagagcttgttaaaaatgcaggatctagaacctcagactaaatcagaatctgtaatttgattggcctttgagacttgctggtctccagatgtaatgtatacacatcacctagggatcatgttaaatgcaggttctgacactcaattacttaggtaatgatcaaacaaccagatcttgaagttttctaacatcaaagcagcaacttcctttctagagttgtcaccggacaccttccctcctgagagtgacacttctgcgcagaacagatggtttatgacaggagttggaaaactgtggcctgctggtggcatccagcctgccgcctctttttgcaaagaaagttttattagatcacagtgacgctcatgtatttacatattgtctgtggcttcttttgtgctgtactgactgagttgaatagttgtaaaagagactgcatgacacacaaagccaaaagtatttactatctgggactttatagaaaacagtttgctgaccctggcttatgtgagtgactctaaatatttccttaaagaatcaaatagctatactctcttgccccagtggcaaacttcgcaagcccatctgaatccatggctattcatagagaagctgaaccataaaccgtcattcccaggcaacctacaaagggtcttgagcctaaaattggtctggataatggtaccacagagcctgtgactttccaacatccatttaatatgtccctcctcaaagaaatggttataattttatataattttattgagctgactccctcctccacaaattgatttcattaattgttcaacataagtctgactttccccaagaattggaatcaaaaggaaattctgagtaaaaatatatctgggaccaaggaaataaaaagacttgtacaagttggttataatacacattttactcctaaaaaggtagcgttggttttggccccactctggcctattcactgggcagactgtatgggcttggagtccttcttttaattcccttggagaatcccaccacctgtctcttatttgggtttttgaattgtgaaatgatggcacacacaagctccaagaatagctgcgtgtgtacaccaagcatacagagacagaaggcagagacttaggccaaggatcaggaaatacagaagagaagctggcatggaggcatctgctccacaaacacagtgaagccggaggttgtaggaggagggaggtgggacccgtgtaatcactggaggatgtgggcactctgctctgctctgcaagtcttggagatcttggttttctttccagaaccaaatttcagaggaggtgggtgtaggagaattgagattctttttcctcatccagagttatctggggccaaagaggtttagggtgagattctgtgggaatctttgctgtagctccagaagctttattcttacttagttccttttccctttgtctgcatagtccaggacactaaaagggtttgtgaagagtccgggtagacataagtggagagtcttctccttaattctagagtctatcttgacttcaaccaattaaagattgtaggagtgaattagagccccttatgttaaaccttgtttcttggaagccctcctggaattccctaagatgcagagctgattagcttagctggtcagaatgtgaaggttttaaagccaaagttattatttgggctgatattttagacattctcttcattggaagaagtacaatgtattcattcattcattcattcactcattcattcattcactcagtgaatatccattgaaaacctattgtgtaacaggatgcaggaaaaacctgaactggagagtcagacacatctgagttcaaattctagtttcttgatctgtgagctaactaacacctcattcagctttccatccaggtgacataaccaccccagcttccttccctgaatctgcaggttaggttggacatttacttctctgcttttgcagcaacttctacaccgtctgttctcataccacattatgtggaaattatccatttgcagtctgtctctctctccagattgtaaagtcattgatagaaaagagcttcatttcacatacttttttacccttagtgcctgacatatattagaaattagacatatgtttattgcactgaaaagaacctaattgtgtggcttaatttccctaaagcatgtgtttctcatctgtaaaatgaaggtgataaaaacatgccttgtgagttttttgtgaagatcaaatcagataatgtttgaatgagtgttttataaatatgaagtgcttgcaaatactaatagttgttctaatatctggattgattgcgattcagtagaaaacaagcagaagagaatcaagaaagtatgtggaggtgtcctagtccactttttctaaactgaataactgaacgagggggatctggagacttcagcttctgaggcacagtttgggtgtgtggggttgacacgggacagaggaccctttccagcaagctcgatgtctctgccattagattatatactcataacagtggggatatgttttattaatttcattgcccctttattcaccctaagcataactaagaaagtgaatatgtaataattggatttcaatgggcattgcaaggccaaagtctcctgccccccaaatctcccagtatccctggcctgtatgtatcttttcttgagaacctgaataatggaaccattagattgaaaacatagattggggagaagagagtgagttgaatttgaaaaatgttgagtgtgacatctggcagtcaaatatgcagggctgactcatttcacttttcatgtgtctgttttagctcacaaactagacatagagctcattgtacagattccatagtgcttaatgcactggctaccccttaaaaaacctatagagcttgctggagggggtcccctatctcatgtcaactcaataaataaatatgtatggatttgttgcaaaatattggattttcttttccatgtaagtaacaaagaactgctgcagatatttgagcagagttgtaaaatgatatgaattttgctgtgagaaaacttgatcttgctgtaatgtatgaaaaagactagaagggaaagaagttgagggtggagagtcttgttaggagggccaggataagagcaggtgggcggtgaaggaggctgcggcagaaccatgccaagcagaatggagtggaggggacttgactacacaagaggctggtgactcagctttctgcctagtattagtcctagagaagtctccctgctctgggaagaccggtgtctagcctcatgtggcttcggaacaaaagccagtgattgcatccaagggaagataatgagaaacacacaggccgtgaaaatcaggaaagcaccactaatctttttgttgcaaaactttacttttcaaagtcctggggaagggtgcagaagcctcagcacgtggacttgagccctgtactcggaaatgcaaaatggaaaccccctaataaatcacagaactgaaaatatccaagagtctgagaggctgggggaggacaggagtgagaaaaggaagggggctggagtactgatcagaagataggagaaagcaacagtgcaaaatgcggggaagggctgagtagacattcaatttaatctggacttttattttgctacaaactaattttatgaagactttttttgcccaaatattaaatatttattaattaaagatattaaaacaggaaaaactgctttcattcaataaaaactctagtaattcttcctaactccagaattgtatgtatatgttttacctattaaataatcagaaatagaaacaaattagacaagatacgtgaataaccttaaaaattttccataatatttgacttaggaactttagttttatgaatgtactctaaggaataccctgaaaaggacaaaatctatacacaaagattatacacaaatttattatagaattatgtactaaaaaaccctaaatgaccagccttgagtatatggttaaatatataagttataagcctttgggttttgagagttttagataacacaagaaggtatttatgatattatattaaatcaagataaaagtcacaatgtaatataaagatatacaatcaatgatgtaaaagtacatagaagaaaactctaatgaaaatatgccaaattgttaactatgatgacttttaggttacggaattatgggaccatttttgtttccttatgcaattgaaaagtcataaatgagcatgcatcactttttcatcagaaaaatatatgagttacatatttttttaaagggaagatattgtaaaggaatatttgttgacagaatgcattaaaaaacctaggtaatttccttatttccctgggattctgagaatttttttactcttgggaatatctttccttgctcttagttattttcatatgttagtcttgttcctggggataaaaaatggtaagtttgctatttgagctctgctcgaacatatggagtagttctctcttacatatacagaattggtttgacattcaaggtctttcagagtcaaatcccaattgatcttcccaatttcacttcccttagtttcctacgtatattttctacacaaatcaaaaaccttttcagacttcctatttcttgtacatgtccataacctcccctttctgaaactctacttgttcctggggacagaatgttcacagagcatgcgttaaacatcataaagtggatcgggagcctcttttaacataaggctgtgtgattttgacaaggcagttagctcaccctctagatctcagatggaacacctgtaaaacaagggactatgttgtagatggttgccaacattccttgcagtgctacagctgagtgaaccttgttccctcatggccctaggtgtgctcattcatctgcctgcaccttgtctcaggttcccactgcatcttaagtggcccctgcccaccccactgtcaaatttgacccttcctagctcatgtaccatttcctttataatgccgtcctcagtgattctgattaacagggacttgcatgtatgatttttttttttttttgccactcatacaggctgccttttatcaaaactatggcacatgtcaatgatataacagataatatcatttgaataaaaagtcaactccatggggaggaaaaaaacctacttaagtgagctttagagataaaggtgaacacttctctaaatcctttgtttatggtctgttaatcaataaagtccaatctgtgatccccagatacataagaggagaaggatatgtagactatttatgatatttctgaaaatcctaagaaaaatcacacacaggcccacagtaagtctatgtttctttattttgagtcagaggatttcttttttccatttttaaccagtataaattggtttaaacttcatctcttgaataactcctaacatgaccagagcccttttcttccttcaaatttccacaaatgcattgctccccttttttcttttcaccacccatatgtccatgttggacaaaaaccatgaaggaaggaggttgagaaactgtgtaccaaaacgccaagagcatctttgccatgttccagcacaaagggcactgttagaaggaggtgatcagagtcatcttctgactcaacctcacaagaggagtcaggttagatgaacagttcccaactatttactctcctctctctctcattctctctctcgcattctttttccttctgttttttattagcagcacaaaagattttgaagtgcttaagggcagaaagcttgccttgttcatctatgcagctcttgctgggaccaagtatggtgctaaacacacggtagacattcagtaagtatttgtggaatgaatgaatgagcaaatgaaggacaggtgtggcttcgatggcaatgggtcagtgtgaactccggaaagagtatgcagagttatagtcaaagtggatgatggatcattgctctgacttactagttatgtaatcttgagtaaacccctttatcactgtgggattaatttccccagctgttgaaaaaatgtgtgtgggggaaagggggagggttagtgattaaaaatgtgttccataaggagcatgtatgtaaaatcatctggcacatggttgcagctgaatagctggcatttatgtagcactttattttttctgcattttttaaaaattaaaaacctgaaaattgttaagttgtactaacctcaaatctcaccacttaagaattatataaaataagaagtaaaatttctcttcccagccaacttttctaattccccagagataactacttttcttaacatttaagtttgatgtttatccttcttgacatttttctaaagtttcatatatatatattttttataattatttaatatatatgtaaactcatgaatatatatatgcaaactcataaatatatatatatatatctccatgcaactttggatggagatatatatacacacatatcattttcaaaatggaactattcatatatgtctatctatctatctatctatcaatcatctatctatctccaagtcaattatttttgaatgatggcagaatcatttgttgtttgaatataccatattttgctgccagtcccccagttccagtgttttgtgattacaaacaataatgcaagggtcttccttgtacatctatatctgtaagcttttgtacagtacttactttagtaataaggcacttgaacacttattattctctttactcataaccaccacaagaagaaaggacagaaattgttattctgtgttacagatgaagaaaaaggagagctaaagggggcaactggcttggccagagacccacacagatagactatggcagaccccgtgtttcccagtggcttgaatttttgtccagagctctttttgtcacactgcaataaagcacaagtcaacaggaaacctttacaaccaggcagagaagcttggatcagggagcaggcagtcacactaaattgtagaaaagaacaaacacacacacacaaacaagaagctcgaggccaaacacatttaaaggatattatttggaagaaatgcactggtggtgagtgagggaccagcataagaagagctgtcctttaactagttaccatgttttatgcaatgttctcaatatgatatccaaatgattaggatggcttagattgcataaatgaggcaggagaatgacaaaggacacccccacaaccccaacaatgacactacccctctccctcaagggaagtgtctagggaaggccagtcagcatctggttaggcttggccttaattgtcatcttcctcaattatctgcaggaaatattagctgttattaaaatttgcagatgcagtcaattgtcagagtcactggagaccaagaattattactcagagcattggagagaggctggaaagaaaaagaacaattcagcctggaaaaatgcaaactaatggataaagtgaggtagggggagtgggggaagaatttagagggataaggccagtagtagggtgaggcagtgaagcactcccctggagtacaaactttaaggggatgccaaaaactcagctatcaagataaataaaattttaattcaatattgaaaaaaatcaagttggcaaatgacagcctgtgggccagcagcctgtttgtaaatacaattttattggaaagccactggaagtaaaggtactgtggcaggggagatccaggctaattctttgatgtgaaaaccctggttaggcttgtgaatgttagacacattagaccttagcttgtgattgatgggaaaaatatttctgaagaaaaggaataatggatctgactgcttttatgggtttcctggggttactgtaacaagtgatcacaaactgggtggcttaggacaacagatattgattgtctcacagttctggaggctagaagtccaagatcaaggtgtcagcagggccatattccctctgaaggttctagagaagcatctttctttgacatctaatttttgatggctcttgcaatcactccaatctctgccttgatgtttacatactcttcattgtgtatgtctctctgtctttgtgtccgtctctctgtctttgtgtccacatctttttctcctttcccttagatcctagtcattgggtgacatcccaatccagataacctcattttaacttggtaacatctgcaaagaccctagtttcaaataagattacattcctaagattacctatgaatataaccttaactctttggttccttatttggaaatagggtctttcttggacacgattcaacccaccacactgttaaagatatctttctaggacacaattcaacccaccatgctattaaataggtagggatggggagagatttgacttaggcgcagcagaaacattatccattcacagaaatctggcagcggagtcaggggcagactcctgacatgatttaaatacctaagaaaatatttaaggaaaagtactttagttcctttggggcgcaaatattataacctttgctcatgtcacatggtgacaaatacatgcaggatttttaagggtagttctgatttcaaacatgcaaacaatagtgactggaaatatttttactaaattttatattccttttgttactattttattcttctcaatgtaagcaacttattaaattattactataaccgaatataacaacttttagatatttttcacaaaaattcaccaaccggggaaaaacgttgtttgtaaaatgcagtattctgatttttaatttatgaaatatggctgttatgcttctgaagcctgttcaaaggctatgaaacaatggagatgatcgaataccattagaattttaagtaagttgaaatgtaaatgggaaacaaatctattttctcccattttccaaacacatcacagtcaagtccaaaaatttgaatgttacatggctttttagtgaacacttttgttataaacatgcgtgtgtaggtatacttaattgtatcagcaacaataacattagttattttaattattgtatcaccaatcctaatcactaatcaataaatgtatactcattaattaataattcaataataatggctaatatttatgaagtgcttatgtgctagacagaagaattgatccctttatgtgaattatttaatttatgaatacagtaattcttccttagaattggtattctgttcatttgggcttgaaatgttctacatattatttttcctgcttttggtcaggagtcaccagcccatttaaagagagacagctgtatctttctgtaactgggctattttctctatgagtgcattaatgttaacagagaagcatggccagcaagggctgctagcacaaagtgaagggccctgctgtgatgaacagagaaattgggaactttatcattgctgctatatacattatcaactaataacacgtttttaaaattcctgaaaagagtttgctttctaaaggttaaaaaggtttaagttctccctgtaattttgtttatatagatgatttgctttgtaaacatttgttttgtttgtttgtttgtttttgagacagagtcttgctctgtcgcccaggctggagtgcagtggcacgatctcagctcactgcgacctctgcctcctgggttcaagcaattctcctgtctcagcctccccagtagctgggattacaggcatgcgccaccatgcctggctaatttttgtatttttagtagagacgcttcaccatgttggccaggctggtctggaactcctgacctcgtgatctgcccgccttggcctcccaaggtactgggattacaggcgtgagccattgtgcctggcacagctctccattttaaggctttgcaattgattgaatcaggctcgttcaggttacctaggatgatcttcctcacgtaaagtcaacccatgatggattctaatcggtctacagaacttcttcacagcaacacctagatcagtgtttcagtaactggggtctacagcctagccaagctgacagatcagaagagccatgacaacaatgataaaagaaactgttgccctctagtttcctcctgggcattaataatttagctaatataaacccaaatactttggatacgattgactgaattcagctttgctgatgcctctgatttcagttgctttaaccaaatgcaaacccctagtgcttctgttgtctgttgatacccagaggctcatgtgatctggaagggtaagtggcttctctctgatttgccagaagaaagtggttatgttagctgaggagccaggacactaatttcagtgatttgactctggtacaagtggtgggaggcccgagggtgggatgctgctttttcctttggccctggtaaacattttatgcttgttatggtggttgaaatgctgtatttaaccttttcttcatgtgccaggaggttcacagtaaatgaggggtgtggtctgtgaagggaaaagtggctgtggcttggcctctttgtaccctgtcagcacacgtacacgcatggtctgtaacatgtgaacctatcacgtgggaactcattactgagctgtgagggctgcccctgaggagctgggggcagtggtcgggagaggagaaggtcgtggggcacagtagaaatggcaccggactgggaatgagttcctactgccaacttctcatcagctcagttcctacagtcctctacttactccttcgttgcccaggacatttatttaatgccaggctaagcacaaggcttccaggattcagcagtgaacaagacagatgctacccttgcccttttggagctgactgttgagcaattttaataaatagcaatgatcatatcattagcatttcccgagggttaccatgtcccaaatgtgtgagttatgatagaggaagatggggttattctaggtgaaggccgagaagcttctgggaggcagtgactaataactactgccttttttactttggagtcatgtcctttctgtgactcccctttccttctcctctgtgttctctcccttggccttgtcaggctgcccctggctttggttctctcttcctagtctcctttctaattagcctttctagcccaataaattaagctcttgtctggaatctctagctgcctgatggacacctcctcgtgaaagccctcagtatctcaaagacacaacatctgtgaagaactcaactcttccattgtattcttccttccctttcctgtctctgataatgttatcacaattcgttttgtcatttaggtcaaaaacatagtcatctttgacctaccttccctatcatacctaccagtcactcagccctaccctgtctattcccatgatgtctctcatctctccctccatttgtttgtcactctcaatggtcagactgtcttggtcacttttctgggcaattgctatagtttaatgcttgcagttttccctcaactttagttcatcctctttagagctaccagagcacatactcttgatacatcttcttgcgtcactctgttgctcaaaagccttcagtggaccactgctgggctctgcagccaggtgcttgtgttctaaacctggctctgtcacttaccagcttggtaactggcaaattattaaccattctgtgcttctattatttcatctataaaacaattgtgtctgtctcatagagttgtgatggggattaaatgagtcaacatgtaagtagtgcttataaaaaaaagtctgacataattttagcattccgtccaggtagatgctctggctcctggtcctccacattttccctcttgtgccttgactttttgcatttctaacttttccctgttatatttctgaatagttttttgcaaagtagtgcacaaattagtgcctggatctacacaaactacatcatacatgatgctcttgtctttcttcatattcttttaaagactatatgttatatatttaaacacatatgcatatttatactaaactaagtatatatatgtatacacatatatacatatagattcatgtatactttattgtttcttcattaattgaccaaatgttttgatggtgcctctaaataagtagtacttaggcaaatctccactcatagtattgtggtaaaagattaacttttgaaaactgcccagagaacagctttctatcacattaatcatgagatacagttttgttttttccaatgttctggcggccattctcatgaggatggactgtgctgactgatctcagtgaaagttaccagtgggcatgttctcggggcctctctgtccccatgaagcatccccactcagagacatggaaaacctgtgagatgagctcatacaaatgatttctgggatgaaaatagcaatgtgagatagtgccaggaacttcaggttcacagagtataattaagatttttcctgaatcattgcacactgtaatttcatcacatcattatgtacgttctttaattatgggctctaattgcccattttagttctgtaattagacataaagacattaattttgtaggtataacaatcagctcaaatgtacttccaaattctttcccctacctttcaagaaaaattaatacatcattaaaaagtttgtgcacagaagagcctcttagagggcagcttttgggagccagttggtgttctcaaaggtggggccccagttcagaaagggtatgggaacatcaccctcttatattccccataaactgtgttgcttcatgtcagatagaccctactgggtccagggcagggaagagctccattaattcacatagggccgatttctcttaatcgtaaaattttaaggtgacatcaatgcttaatgagtcatgggagaggaatgaactaatgttagggcaactctggctttttatttctcttgtgtcctattaaaagatgagaagatgaagcattttaggctcatggggtttgtatttttcatttgtgcatgggtagctgattatcatctgtcattatgtgcgtgtgtgtgtgtgtatgtgtgtgtgtgtgagagagagagagagagagagagagagagagagagagacagcaagagagagccagaatctgttttttaagaactctcaatgattcagatctccattttttcccttcacctacagcactttagttaaaacaaaacaaaacaaaacaaaacaaaaaaaccgacgagttccagcatttccccccatggaccatgctatgtccatttcagccgacacattttacatgtgtatctatttgcctccacttacaaatccaaggaaaaaaaggcagtgtggtagagtagaaagagccttagtaagggtcctggcccctttttcttccctttttacacatactctctctctaggtaatctctctattctcgtccttaaaggccgtttatatgcttttgtccctccaatttatatctctagctcaggcctcatctctgagctccagattagataacaatcagaatgcttatttctacttggatgatttacagataatttaagcttgctgtgttcaaagctgggtttactttcctccaaatgtattgcttttctattcttcccaaactcaataaatggcaaaaccatccattcaagtactcaagctgagtcatccttgattattctttcgacatatgagccatcagcaaggcttgtttcaccctccagaacctatcttcaatctgtctgtttccctctccctcaattcaggctgcaatcccaatgcagagtgttcagtaaagcaaaaggggtggtctgctctcaccaaaagcaatttgcgtgctcttaattcacggatggattacctagcacttaacacagacccagatatatttggtactcagtaatatacactgaagaatgaatgagtgagttaatgaattaatgaatgaataacagaaactctacctcctaggacttaataatacacagcaggattaacctgctttcataagtaatcagtgaacctggtaaagtgtgacatttatcttttggtgaaagcagctcaccccttttgctttaccgtttcaccagcaatctctgttttatttttacctgttcttttggacacacaatttagtcagaaatttgcacctgagtcttacttctgccacctgctagtataaagatcaactggtgcagagcactatacagagattatttattgtttgctacaatgttggatatagagtttcctctctaggacctctttaactgggagggataaaaatggcacaactaaattttcatgatttggataagaagagaaacattgggtgggcatggtggctcatgcctgtaatcccagcactttgaggggctgaggcgggtggatcacctgaggtcaggaatttgagaccagcctggccaacatagggaaaccctgtctctactaaaagtacaaaaaaaaactagccgggcatggtggtgggcaccggtaatttcaactactagggagcctgaggcaggagaatgcttggactcgggaggtggaggttgcagtgagtcaagatcacgctattgcattccagcctggccaacaagagtgaaactccatctcaaaaaaaaaaagtagaggagaaacattgcttcattcagaaagtgcttcctaagagattcccatggtccagggatgatgctggatggtggagatgtagaataatgtagagattacagggtagcggggatggggatgcacttgtaagccaatgagtagaagaaaggggttctggcggtggcacagcagcaaccacaggacgaaagcaactgcagaggacatgtgctcaattctgtgaggggacgatggcgggacatggaagggtcctgatcatgtcgatgttgatggcaagtctaccagtcaaaaggaacaggtgagcaagggcctgtagcctggaggtggcttggggctttcaaggaaccactttgttagacctgctaaagcatgtgtttcaaagagaatgtacccagctcgaagacttgcacattgtaggcacttagctaatatctgtttaataaatggataagtgaatataagtggcagaaagacagctgagttgctgggacaggtgagatcatggaaggccttgtgtatcatgctaggatcagtaatgggaagtagagaagtggtcaatgaagttttatttaagcagaaaagagaccctattgggttgagttttagaaaaacccctgtggctgcagaaaagaggatggtttggtgggaatgagactgaagtcatgagcacagacaggaagggtaactgaacattttgagagagctgaaagtgtagacaggaagggtgttcaaagattgttggagttcagagagaagtcctcggcctggcctagcagtgtagacagccaaagacagacaagtagtggaatgtcacattctagtaactgattgaaatgtgtgtgtgtttataggcaagtgagttgaaaactgtgtgtgtgcttaagttggaatgtacatgtgcatatatgaaggtgatttgaagtgtgtgtgtgtgtgaatgcagtgtgtggtagtgcattggaacgtgtgtgtgtttacatgagtgcaagtggacagtaagaatggtgtctaacacttacctatttggtctaaaggctcataaaacttctgccttactcctggtcacatgctccaagtcacaagcagaaatgggcagaacagctcggccttgtaattccagcctgactcacactaagctgtttccaaccaagtgaattaatttctccctccttatgcccacacagcactttcctctacaacaattgttacaccactgttgttattagtttatataatactttaccccctgctaggctgtgaaatcctgaaggaggagaaaatatgttatgtatcatttatctccagagtctagctcattcaggcacatgctaagttctcagctaatgtctgttgaacgaactaaaagaataggcacacttttatagcttattaagctcaaacatagactccaaagcaaaatctcatcattgcctcttgcacattttggaaacaacagcaataatagttaccatttcttgagaacctactgtgtgcaaggcacagtgccaaatactttgggggagccagtgattttatgtgcaatgtttttaaaagtccctggagttaaaaaattcctaggaggtaaatattatccaccccttccacagatgacggaagtgaggctcactaaggataagtaacctgccaagttgcacagctagaaagtagagagctgaaacaggaactcaaagcctgggctccgaacaagcacgccctgcagacttcccttccctgtgatgccccatgctcagttttctattttctttatagtggaaaagtcaatgcccttcctatgagaaataaaagggtttaaagtggtcaaaaggaaacagtgtttcctctgtgctcacggggttttggccaatcacagagggtgaaccaaaaacaatattatgcgagatgtggccagtttgggttgattccagctttggatgctgtgagctggatcccaggagcacacgaggaaaaacgataatagcatacttgagatccaagcccatgttggggtgaggatagaagttttgctttcctcaaactattgcatttttcttttcctccctaagggtccgggcaggatgcttcctaccccagggggccacttccaaatgctgctctgtcacttggtggaaaacttcaaatttactgagggtttactgtggaagacttagtcaagagggcaagtaccctatatctccagattgctttgcacatgttggcattcaattaatattttatttgtcaatggatttaatagctgattacagtttgcaatgctctactcatggataaatcagttgatcttctcaggcttcttatgccttttcccagtggatttttcattgtcgtggataaccccaggaaaaagaggaggcacagaggaacctctcttacatgaataggtggggggatgcaagggaggacttctagcttttcttctcctgacttttctacattccccaggttgagtgactcgtctccatcttttaatttagcatcttggaactgaacagcacctcccaagcaaccctcacctgggaaccaggcagaaacaagtgaaaatgtggaggaggtgtttatgaatttttgggcagtcagtgatttcagggatccaggaagttattctactttctaaaccacttccccacctgctggatatgaatgtaactccctcagctttcagctttcacatctactttatatacaattctatactgcctctcccattttatattatttatacctatgtgctgggacttgagcaaaggtttttttattttttatttttttttattttttaaactttgtacaagggaagccataaagaatttgggcaacttgtagggaagagggagagtgaatttggtgaaaccgaaagtcagtaaaggtcacatgggagatgctgagctctgcagacagatctttcaacgtgaagcagcagtgaagaacatggctctggagtcaaactggctgagctaaagagttgactttgttacctactagttacctattggtagttacctactagttatctactagttacctacctctgttacctactagtgtgaccttgggcaggttaagtaacttctttgaacttagtttactgatacataaattagtgataataataattcctgtctcataaagttaccgtgaagattaagtgaggcaatgtatgtggagtgttaaaacagtgcatgacgcagagtaaacacgttaaaatgagctgttattaatatttggttgctaaaggtctgtcctacctgatgtgtctatctctttcaaatacatcctctgggatttagcactagaaacagtcttgcagaaagttagagcagggaggaaccctcaagatcatctaatccaaagtcctcttttgtaaatgaggaatcactggcccaaggtcacggagtaagtcactgagtaatccctctggtctgttgcccagaatgcattccttcccacaaatctggccatgcttgtcctggagggcagatagactagccttccccaggtaaccttgtatcttcccgtaaaaccgtctgtcctcacaaagtggcacaatttctaaggctccctcgggcaacaaagtaggttgtgttcagagaccagtgaggtggagaaactgcccagccactgaactccaggctggacttggtgagtggcactcagtggagtcagagtcctggagacctgcacatcagggagagggtcctgaagaggtcttgaaataatttgacatggaaagagaaaatacaaattttcagagacacagataagcatcatatttttaagccaagaactcagttatatttttgacagtgtggtgtctacagtactaaggcatgttcttacaagagtgacactcactagctcttttttttttttaactttcattttagtttcagtggtatctgtgcaggtttgtcatatagtaatggggatttggtgtacaggtaattttgtcacctgggtaataagcacagtacccaataggttttttttttctgattctctccctcctcccactgaccatcctcaagtaggccccagagtctgttgttccactcctagcatccgtgtgttttccttgtttagctcctacttgtaagtgagaacatgcgatatttggttttctgttcctgtgttaatttgcttaggataatgagatcatgttctctgacatggaaagagaaacacacaaattttcagagacacagatgaccatcatatttttaagtcaagaactcagttatatttttgacagtatggagcctccagctccatccatgttgctgcaaaggacatgatctcattcttttttatggctgcatagtattccatggtgtgtatgtactatgttttctttattcagtctaccattaatgggcatttagtttgattccatgtctttgctattgtggatagtgctgcaatgaacatgtgtctttatggtagaacaatttatagccctttgggtatatacccaataataagattgctgggtcaaatggtaattctccttttagttctttgaggaatcaccacactgccttccacaatcgctgaactaatttgcactcccaccagcagattatgtgttttttttcaaccttgccaacatctgttttgttttgttttttaataatagctattctgatgagtatgagatggtatcttattatggttttgatttgcagtgctctaatgattagtgatgtcaagtatttttttcgtatgcctgttggccgcatgtacgtctttttttgaaaatgtctgttcatgttctttgcccactttttaatggggttgtttggtttttccttgtaaatttgttcaagttccttatagattctggacattaagtctttgtctgttgttcccctcctagtttgcaaatattttctcccattctgtaggttatttactgttaatagtatcttttgctgtgcaaaatctttttaattagttctcattggtaaatttctgtttttgttgcaattgcttttggtgtcttcatcacgaaatctttgccaagtcctatgtccagaatggtatttcctaggttatcttccaaagtttctatggttttaggttttacatttaagtctttaatccatcttgagttgattttcgtatgtggtatataagataggggtccagtttcaatcttctgcatatggctagccagctatctcaatatcatttattgaatggagagtccttttcctagtgcttggttttgttgattttgttgaagatcagatggttgtaagtatgcagcattatttctgggctctctattcaattacattggtctatatgtctgtttctgtatcagcaccatgctgttttggttactacagccctgcagtatactttgaagttaagtcgagtaacatgatacctcctggtttgttcagctcatttctttcttgttgaagacttcagttcaatggccttagtcatctttggaatggcatttaggattcagttcaatgaccttagtcatctttagaatggcatttaggaaaatggactcctttaccaaaaaggtgaaaaagaaaataatataacccaaccttaaagactatttttttaaggggagagggagaggactttattcataatcctatcagctgaacacattccagtcttcttctataaaaacacaattttttataaagttgaaattatggagctaagacatttctaagaagacttaatttcagttagggacttgctgattatctttgggtaagtcagtctggcttcttttctgggaggagtgttgtgtccttagagacgtgaacatcgacgtctgcttgtttttgtgaggaagcatggtagaatgaagagaacgctgtctggagccaaaagatccagattgaaaccagactttaagcctgggctctgcttccccttttgctggatgaccttgagacagtgtcttaaccttcctggatctgttttttagcttttataaaatagatcactggcatatcagcttgttaacgtgcactgtactcagccttgacacacgggagaaaggttttcagggacagggtgaagatttcatctatatgacctttgactgcagtttggttggttgggttacacaatctacaattgtagattgattgagagtcttttgaaatatgtttttctttatgctagttacccaggtcctctcctctctggtgacagtggtaatttaccagggcattgtgtcctcttttcattaattaggccactcaggcctacccgaatcccaagagaccatttatggatgatgaaggtggtaagatagggttgtagtatgttggacctgctgtcacaaactaccatatgcagggtgacttataattaagagaaatttatttttcacaattctggaggccgggaaatcctagatcaaagtgccagcagatttggtgtctggttaggcctgcttgctggttcagagataactgtcttcttgctgtgttgtcacatggcagaagggggaagagaactctctggggtccttagtataagggtactagtcttatccacaagggctctgtcctcatgatctaatcaccccacaaaggcttcaactccaaatgccatgactttgggggtcagatttaaacataggaattttaaggggacacaaacattcagtttatagcagagagtgtatgttcacagcacaggaaggttcacagctgaagcgagccattaattgtgtatagactttcatgtctctgctctgattcattgtataatctgcttcattcaaaggaagaaggtaaattttgggtccctcttggaacatttaggtgactcccaccaaatacaggatagctttgagttataacgtcatgaagtccctggtcatgtctgtgtgtttgctttggaccagacccaagggcctgtcctgtgtcctgcccgggctcctcccacctctttcctggagaaacccacagtgagagtggagggtgggggtccatgtttatcttggtgggcctcactggagctggacactgctgctctgtttgcccaggcttaagtatgcatctccttttttaactggccagggactttcccccagtcacttggcctgccattgatttgggacttttctgcctaaaacttctaggatgataaggagagcactattacccactgcctgcccaaacctagtagcaacagcagctagtcatgaccagcattcatggctgcaagtactgtcaggccaggggcctgaccagtgaactggaactttacttctctcccaagtgggattagagttcactgagtaggtggccctattaaaatatgtatagcctgtgctaaagttaattctaggggtgagaatgaggcagctctgcttgctggctagcccaggctggcaaagaataatgggtgcaagcaagaataccagagccagattgggttcaaattccaattctattgcttcctaggtatactgacttaggcaagtacttctatttctctgtgtctcagtttcttcacttgtgaaattttcatattttaaggattttgaagatatcattttgaggcttaaaacaatgtatttacttatgtttaacacatgtaattactgatgtttaacttttttggacttataaaaatgacaatgtttagcagagtgctttaaaaacatgacccaactatgtgctttctataagaagcccctttgaatataatgatatagccatgttcaaagaaaaaggatgaagaaagctatattatataaacattaattgaatgaaagcaggagtagctatattaatacatgtgaaaatcctctacaagatattagcaaattgaatacaaccatgtacaaaaagaattacacatcatatcaaattagatttattctaagtatgcaagactggttcaatattttaaaatcatgtgattatattaattgatgcagaaaattatttgacaaaattcaatattcattcatgacttaaaaaaaactctcggcaagttaggaatagaataattacctcaattaaaaagtttacagctaacatcatactttgtgaagaaggacttaatgttttctccctaagacagggatcaaggcaagaatatctgctcctgccactcctattcaacatagcactggaaattctagccattacagaaaagaaattaaaggcatacagattggaaaggaggaaataaaactatatttgaagatgacatgattgcctacagaaaaaaataccaacacatttacaaaaaactctcctagaactaataaattctcctagaactaataagagaccacagaatacaggctcaacaagctcaccggatacaaaaatcaattgtacgtctacatacctatattgaacatgctgacaccagaataagaaatatagtgctaattttaatcactcaaaaataataagtgtaagtacatttaaatatattatatttgtaatgtatattatgtaagtttaaatataataaaacatacataggacttgtatgttgaaggctacaaagactgatgaaagaaataaaaagatctaaataaacagagagacatactatgttcatggaagtacttgacatagtaaagacacaatatactaaagatggcaattctccccaaatcaatatatacatttaatataattcctacccaaatctcagcaacgttgttttttttaaaatagatagaaagaggattattctaaaattttgactaaaggctgaggaaccataatagctagaacaatttttaaaacaaactaagtgggaggaatcagtctaccctatttgaagacttattatatagctgtagtaatcaaggctgtgtggtattgacagaagtacagacatagatcaaaggaatgcaataaagaattcagaaatagacccacacaaatacacctctgtgttgccttatttttcagaaaagctctagactcagagtcaggaagcccaggtttaggtccttggccttgcacaagtgagttcttccagttataaaactttgattttctgggtctaaatcacttaaacttttctatctcagttttcttttctgtttaagggaacatccttccttcttccttccaagcctctatttgacaaggatgataaaatatctttcttttttaagcataaggaattctacaaaccaaaagaattattacattggttgatgtgaataacacatctcaacaccatgaggccctgactccgcaaacctgaagtcaaatgccaagaactttcatgaaatttattaatttattttttcttcccaactaacaccactaattctttatttggactccttaaggagcatgaagaatgggactcattcttgcagaactgtttttagagtttgctactgctcaaagctcagagtttggccatgtgaacttctgagaagtctgtgaataagagattttacagcaatttaacagtggttcaaagatagatgctctgtctcccagtagaatacttgtgcttgtgtgggcagaaaattcttaaaatgattcaaaccaaccacccaaagaggattatatgtaaattcatattgtgtgggtcctgggagctttgaaaaccacatacacagagcacagaaacacacaaacacacccaccaacacacacacacacacacacacacacacacacacacacacacatacatgaatagcacccttagcaccattgctaccttatgtgattcctaccatgaaaatctgcactttaaaaagcaggaaaatttgaaatctacagatgtggataacactcaaacttgaattgggacacaagaacttttccctctcaggctagtgagatagtatggcctagtggctacaagggtgaattctggagataaattttctgggtttaaatcacaattttacctttcattaactgtgatttggggcatgttttttaactattgggtgccttggtttgctcttcagtatgattggaataattatatacaaaatatacaatatctatctcacagtattgctgtgaggatttgaagaaatcatttatactaagcttttatgcatgaaatatatttagaacagagtgaagcagaagtatctgtgttctttcatagaatgtatgaatgaaatgggacagtgggtggtcactgccttaaaatactataccatatattttgtcatggtgctattgcaacaatactcctaacattatgtatttctttatttgagtcactgaaatacaaatatgttctgagaagagtcagcagagtgatttacaaactagctttttagactgggaggcacactggagatccaggttgggggcctgggtctaatctcagggctctacttttttaacaaggtatataattgtggacaagtcaactggtgttcctgaacctcattcttacctgcacactgaggaggctgaactgggtgatctcggaggtcctttctggctgtaatatcctaagagactggatgctccctaggcaaggaaactgttttatcgacgtacatactgtggaagcttactaatgcaagtctttattaagtagtttttctgtagcagccgcttttctaagccctttgacctatttaacccttgcagcaatcctatgaagaaggatttatcattatccccattttacagataaggaaactgaagcagacagaggctaagtgatttgcccaaagaccatatggctattaagtggcagggctgagattcataatccagtaagttgaggtacgcacaccaggcattctattcagcatcagacagtgctaggcaaagaataaccgaagaagagggactgtgttctattcactttgttttccccacagatctgtaagagtgcctggagctttttataggttctgaatagatatttatcattcttgcagtggcttgatcttggctcactgcaacctccgcctcttgggttcaagcgattctcctactttatcctctggagtagctgggattacaggtgcccggcaccatgcccagctaatttttgtatttttttttttaaattttattttaagttctgggatacatgtgcagaacgtgcaggtttgttgcataggcatgcatgtgccatagcggtttgctgcacttatcaacccaccatctaggttttaagccctgcatgcattaggtatttgtcctaatgctctccttccccttgccccccaccccgtgacaggccctggtgtgtgatatcccactccctgtgtccatgtgtcctcattgttcaactcccacttatgagtgagaatatgcggtgtttggttttgtgttcctgtgttagtttgctgagaatgatggcttccagcttcatccatgcccctgcaaaggatatgaactcattgttttttatggctgcgtagtattccatggtatatatgtgccacattttctttatccagtctatcattgatggacatttgggttgattccaagtttttgctattgtaaatagtgctgcagtaaacatacgtgtgcatgtgcctttatagtagaatgatttataatcctttcggtatatacccagtaatgggaattttttgtatttttagtagaaatggggttttgccatattggccaggctggtcttgaactcctaacctcaggttatctgcccgccttggcctcccaaagtactgggattacaggcatgagccaccacgcctggcctatcattcttgtttttgttgacgacaaaaagttgttggattaaattgctttcagccttctgggttgctaagtgttgcagagttggctgtgttaaatttcattttcttttgttaatgttacccacacaaggtgaaggttttggttggggctcaggagggctcctgactggggagaaagtgggaagatccagagcaaggagaagacaatgaggctgccaggctttgggctgctctggcctctctgctgcctgccactgtcttcatgtccagcctcgctgtgtttctataaaggtggagttgtacctctctgatttcccctaaaggtggcctggatgtggtagaagaaagaggaggcaaggcattacctgcacctggaatactgatgagtggtttgctctttcttgtatgcccagtggcctggtcttaagcctaggaataaatgtagtcaccatggccataaaacggccccactgctgggcttgctttccctggcctctgtgagttccatgctcattatatggactccccatagcaacgttgagagcttgcttatcatttccagaagtgaccatggcagattaggaatatatgtttattttgaagtgggtttttttctttttaaattttacacattgttggatgaacataacatcaagggctgctttcccaactgtcttaggaaaagagctctaatgttggagccagtagccctgcgtgttctcatcccagttttgattataactgactataatactgtaatgacactctgacctgtgttcttttatgactgagatttccggtggggatggaggaggtgtctgatgtacagaaccagggggatgctgcctgagccaggttggggacggagagaagaggctgaatttcaagacactgacatcatcagtactggccctagtgcagttacatacctggtcctgcaacaaataatgagtatttagggcacatatgccaagcattaatggggtcacgaggtggatcgttcttttgggtgcccttttatatgccgctgcaatcagagaagcaggacaccatgtaggtgagcatctgctgttttcacagctatttgaagctgcaacccagtgtactaaaagtttccaggctgactcagtccaaaggtgactgttttggaaactttgaatgagattggttcggcaacttcagtgttatgtaagtaaaaggatgagagcagttgaaagagccactgctctggacatgttctaagtggcttctaccaatgggaatacgtgagcgtgcattaagaatgtagcaagtgagactgacatgtctccagtacaagcacagcacgtacaaggacacaacttcatgtttggttcaatgtgagacttctctgtggctcctttctcttcatttgcacagatatctgtaccacccagtataagtggtatactaatcgtagctagcctgtgctgcatgcctgctattttctgggtaattcccatgtgttttacacaggttaactctacttcctctcatggaaactacttgttgtcgaaataatggttatattttaccaatatggcaactgaggcacagagatgttaagtgtttcagcccaggtaaataagtggttcaatcaggatttgaactcaagcagcacctaccttggagcctaagctcttaaccacagcacttcactgaacctataaaatacatgtttattggttttaagctctgctagttgaagaacatttatacatgtctctattaaaaattcacttgtgtgtgggttatgaattcacccataaagaagactgccatgacgcacggaggaggggtgtctgtggagcttcaggagacgtgataatccacaaactgtcctgggttgaacttagctattattctgccaggaaactgtctggagaaggtccaggaaagtaccaagaagtaaagaagtacctgagagtgctcagctcccagtgtgtcccttggcatctgccagtcacagcttggttggttctggctgtggggccggccttcctgagacccttgtcagggggctcataccctggtgctctgttttcactgatgatgaagcctcagagcccttggtcccctcatgatgttctgcgggaaaattgtgcacacttttgttgtgtgacttaggttctttaactcaggctggttgacatggagcttggttccagtgatcagtgctggctttagatatgatttgcgcatctctgcaggctagtgtcacgctgcactgtggatctggactgtggctcgggtgccagttgcaacatagtcttcaaggatagccaatggcgagacaacagcactctgtcatgcagctgaagttatggaaacacatgatgtcacatgaatgtctattgtgtgaggtgatggttaatacctgtgtttccaagaaagtgccaggtactggctagtcctcaccacaaccctatatgtggtaagggcagttattaagcttattttataactgaagaagcattagcaccaacagagaagataacttgcccaaggtcatacatgaaaaccaatggagaaattaaggtttcaacctaggcagttaaggcctaaagtctgtgctcgtgaccaccaagctatctcaccggtcccctgtcaggctttttaggggataaagtacagagtaaagtagaactttcctcaaagactgtcttattggtctcacttatttttttttttgttagtctttgggtttactttaaattgatgggctgctggaaaaaatgtaaattgtcatttaaaaagaaggcatcaaggttttgtcttaggttaatttttcaaagggcttaccaagaacacagaagacagaatgccagctgggtgccgtggctcacgcctgtaatcccagcactttgggaggccaaggcaggcagatcacttgaggccaggagtttgagaccagcctggccaacatggtgaaaccccatctctactaaaaaaaaaaaaaaaaaaaaaaaaaaaaaaaaaaaaaaattggccaggtgtggtggtgcatgcctgtaaccctagctgcttgggaggctgagttgggaggatcccttgaacctgggaggcagagattgcagtaagctgagatcatgacactgcactatagcctgggtgacaaggcaagacaatgtcaaaaaaaaaaaaaaagacagaatgctgagcaattaagaactactttatttagtcctgtcttatcatttgtggcctttgtgtattgagcacgtcctgagagctgggcactttctaaatactttacatgtgtttcctcactttatgcttgtaactgctttctggaagcaggactgtgattattcccattttatggaagaaggaaatgaggttcacgaatattacataatctgctcatagtcacaaagctagcaggtggtggggctggcgtagaaacccaggcagtctggctccagagtccatgttcttaattaaccactcctctagggtggaaagctcactggttttggggttaggacactcatgccagctctgccaaaatgtcaacatgtgtgacactggccaagtcatatctcctcttgggttctcattcatttatttactgattcattcagcagctctttccagcatacctaccatgtgctaggcattgttagtactagatacataacgggtgataagatagatttcctcgatgcttctgtagagtttacagatggattttcagtttcctcatctgtaaaagatgagaattaaaatatatgaatgtttctcatcctttacaaaacccacacatctttttataaacataaaaagttatgccttccctaatgttatttgaaatttctgagtaaataaccatgactaaaaataaattaaagcaattataatagtgagtaatttttgtttgaatcacacaagccctcatgcctgttcctgaggagattctcctgcgctggccctctgagccctgggcattctttcggttaagaatcatgggaatagtattcttgctctaaaaacggacctacagttatattttttaattgctttgaaatgctggagttgtgtctatttaatttgtattcattctttcaccaagttttggctcttgggtttgtatggcagataaaactttactcattccttttactgaaaacctctttcccccccagggtatagtcgtgagtcacgagctctctcaccaactgacatttccccatcctgtttttggagggaacaacaaaggacatgcctggtgcctgacacagcgggcccacaggctgctcctttagtggccttgtgagttcgatgagcttttggctctaggaagtgcctgggctgctattactctgtgaatctcatgagagtcacagacctcttaggagcaccagccaggttgtaaagatctcttgaggactgggctctggaaggactggccactccaacaccctgccttgcccttaattgtgcattgcctggtgttctttaattgcctcacaaatgcccttgaaaactctcagggatggcctcactgtgcatgacaaaggaatgcaacctactgtctggttgtactgaaggagcagagagcaggattctcataatgattgttcaaagaatttatttatgtggagtcctaaaaggagtgataggtgtgaaaaaatgcaatttaattcaacaaacattgatgcaaacgctgtgcttggtgacagcaatatagagatgaataagaccagtgtctagtgacgtgctggcaagtacaactggctctgtggggaggcggtaccctgatttgtaccttttgctgatttccattgagtaaatactcttgccatgtttgatttcaagctaccaacatggtgtcaattggctcacagaagccctgaaaatttaataatcagctcttatgagcctgtacaaactgaacttgcattctgctaccaatatctacttttgaagttttcagtttagattggaagatacataaattgccatgcagtctggtaaagacagaaatagaagtatgtagaaggtagaaaggtatcacaagggacactggttcaattctgcggtgggcatatccacatggtaggctgcaaacaaagacaggcaaggcctgtaggtgggtggagacagagaccttcagagcatcctcagtgccttcaggtcatggggaaatgccttggcctgccttaaggtcccgtgcagtctagcctcaccttacctggctgaacattctcccacatttactgacacaaaccttctgctctagtgagtccagcccagtgttttcagtcttgagagcacatccctgccttggctgacacccacctcctcccaccaccgtttagaaagtgccttccctccacctccacttccctgctctactcatccttctttatgaatgcttcctacaacagctccaagccacagaaagcactgacagaaagggaaagattgatcacgtgaattccattaaagtgaagaatttatgtttatcaaaagtcactgttaagaaaggaaaaggcaaacaatggagtcagaggaactgtttggaacacttatgaccaatcgaggatttgtattcaggacatgtaaggacctctcacaaatcaataagaaaaagacaagaaaagggaaaagagaccagaacaggaacttcacaagaatggatatccaaatgacatgaaaagaagcttgccttcactccacctttacctcagtcactagggaaatgtgatgccactacatacccactaaagtggctgaaaccaaatagacttgtattaccaagcattgttgaagacttgaaagagtgggaaataatgtatactgctggtaagaatcagacatggtataacctatttgaaaaacagtttggcaatatttattaaaatggaacatttgcatactctatgacccagcatataatctgaccatactctatgacccagcatatgatatgacctagctataatccaatgaaaatgtatatccatatgtttacctaaaagtatgtactggaatgttgatacagcatcattagttatggctccaaattggaaatacccagacattcatcaatagtaaaaaataaattataggctatttgtgaagtggaatctttttaaactatgaaaaagcatgacatactgctccatagaactacatggatgaacctcacaaacctaattttgagcgaaaggggccaaacaaaaaagaaaacaaatggagttattatatttatataaagttcaaaaacagacaaaactatatgaggttagacatcagtttacctgatacctttggggaagagcaagaggttagtgactgggagggctgtgttgggggcttctgagttgctgaggttgttatatttctggccctgagtggtgataacacaggtatgttcactttgtcattgagctttacgtgtgcaatttgtgtacttttctgtatatcttacatttttattagctaaaaagcaaaggagcttctgcatgaaagtattagaactagtgctggaaagtgagggagtgtttctgaaccgcctttgtgtttttcttttgacgttttctatctttatgagtttattcatcaaacaaagacattttgagagtgacaatgtgccgggaactattttaggtactgagagtgaaacaaaatagaaacaactgctgctttcatggagcttacattctcaaggggacagcaaggtccttgaacagacaaatgtataacaagtcaggggataagaaatactctgaagtggtattaggggataagaggataaagaataatggagctgggctgagggtttgggcactgactaggtgttgttttatatggggtggtcgaagaggacctctgaccaggcagccttggagccagagcctggatgaagtgagtaagggaggctgacaggtatgtgaagaacattccaggcagagagggcagtaagcgcaaaggccctgcattgggatccttggcctccgaagcaggaaactcagcatcattcttggcttctctctctcttcttcaccttcatatttgaatcaaatcatgatccatttgatttcatagctaaatctctcatagtttgcaacctctgcctcccaggctcaagcgcttcttctgcctcagcctctcgagtagctgggattacaggaacatgccagcacacccagctaatttttgtatttttagtagagatggggtttcaccatgttggccagggtggtctcaaactcctggtttgtctccatcccctccattgttgcctatttgggtaatagtttcttaactctgccttcccgtttccatttttttctcttctgattttaagtcactgactggatatgccactcctctgcctaaaagccctccagtggctctgctttgctctcagagtaaatgccctacaaggttttggttttcctcactggtctcatatctttctgctttgccgtacactccgtgcttgagccacaccaaggcgattccatgtttcccacattccctctgaggaaaggccctttagtctctgggtctttctttatgagggtgcatctacctgtggagttctttcccccacctcctcattttatgttttgcacatcccttagatctcagcttagatgttgtttagtctgggaagctgttcctgtcccttaaaccttggccaagtccctgtgttctcctatcgttgccccgtcatatcattttgtcattgatttttcttttttccagcctcccatgaaactctaagacacatgtgggaagtaactatgttacttattcatagtgcttagcaaagtttctgatgtttagaaatttctcaataaatattaaaaaaagaatgcatgttgagctacatttctgtgatatgtcaaaaatctagaagtatttttattagtaactgatagaaatatctttcagtcaaaacattattcatcaactcacaaaaaagcagactagctttgtgtttgagttttgtttttgtttttcctggtaattttgtgttccataatttctcagacacagaaacattatctttcaaattttaataccactttatttgactcaatcacatgtaaaatttttgttcagagaattttgaatgtatccgtgaaaaatattcaaatgtcgaaatccaaatgtcttgctttggctgtggagcaatatcattactgtgacttagttctagaatttagacttaattgctaaaaaaaaaattttgaattcaactttattaattttgtcaagtttttgatgtgctaggtggacattctttccaatttattacagtcccttcatatagacacaaaagcttttaacacgatgggaaagctggtgagacaagtcagaaaataaagcagctcttttttctttttttgttgagacagagactagttctgttgcccaggctagagtacagtggtgcgatcttggctcactgtagcctccacctcccaggttcaagcaattcttgtgtctcaggcaccgaagtagctgggattacaggcagtagccaccacgccggctaatttttgtatttttagtagagatggggtttcaccatgttggccaggctggtctcaaacttctgagctcaagttatccacctgcctcggcctcccaaagtgctgggattacaggcatgagccaccgtccccagccagaaagccgtgatttttaagctgatgctttgtaccatcagtgtgaggagtgatgctattgatccctgctgggcatgagcattagaagaaagttgagcagggacttaaaatggggatgtggagcactgtgccaatgtctttcaaatgggcttttaaaaattattttaacaggattatttggagaatcataaatgtttgagcctcagatacactcatagctaccatttactgagtacttgctatatgccaggcactataaaaactgctttaaatagacaatcttgtttaattgtaataacagtcatatgggattgttaccatcattcccatttaacagatgagaaaattaaggctcagagaggttgagtggtttgccctaggtcatatagcaggtcaaagctaatgctgaactatgaacacagttcctctgactgaaaatgtgcaaggctactaacgactaggtcctactggcttatgtattgaaaagtagatcaatgaactcattctggagctaaatgttgtctattactgtggattatccatgacataacccactcattatattccagtattggttaaaaggtaggagagaagtgatagtaaatttcatgggttcggcatatcttctgaccgacagaagacatggaaatgttttaaatgtttcttttcctttttttttttttttaaaaaaaaaacaaaaacaaataacactaaaagtttcaccaaacaagggttcataaaaggatcgtctctaaattgtgagtgtggtgagtgtgcatgctctgagcaaaaagagcctcccctttctgagggaattgtgaccctggaaaggaggagagcaggaacagctggccatctccccctgaaaggccagggcccccctctcaggcctctgggctccagctctggctgagggtgtgtttgtttggctgtgactctttcccttctgtttccctctcggtgtcatatttcatgagctccaggctcctgcctgtttcagcttgagcctctggctttcatcgctgcctccttggccaaagctgagtgagggcttgaaaaaaacactgattggatgcacatttagtggaggcgattgctggaccagcacctcaccaatccccagccccaaatgcaactgacagctacaccctcctggctggagcctaaaccagaggcccctttcctccctcctctccacccatacccttgctgtttgcccaactcttcctgctgaaatcagaggcagcttgtgcctcccagccttcttccctgcccccgctgtctgcccagccaccagcttcccctgggctggaaagacccccgcttgtctgactgtgctaatcctctgtttgaggttccagaacttcccaattgttgggcctgggttcctgtacttagctgcccagagtccacttctctgctgagatttctattatacaagagattcaaccagaaccctctccgtgggcctccatgcctctttttgctgaattccccattctcattctgcgtagggggtgggagttggtgggggtacatgcaccttgagtctaatcatgatcttactggggagagctcagtaggaaagtaataacatattcatttaaacaactttttctctgttaatctttttattgaacttcatagaattaatggataaagactattggttagagtgcgtctttcttagacgagatggagttagagacacttaaaaaaaaataaggcttgccactgcaggagtgcacagagcacctcaactattggagcccaggtgatctcttcagtgggtcataaaatctgagtcataagaacctcatggcaaagaaaacttgaaactgcaaagtctcacatagtcatttgctgaaaactgaagtgtcccaacaaatgtcgggttagacctactttgagaaacacattccaatatgagatcgaacctgacaattttgcatgctaacctggactgtttcttattagagcaaaggggatgggctttttgtttgctttgggtatatttgtttttgctgccaaagtgttgtaatgtcatgattatttaatatgtatgaggcctagttgtgtactagggagagtcaaaatacatttactacgaaatgagaccagctccagttgtttaaacagctccagttgtaataataagagctaagacttgatgccaagcactgtttctaggtattaacttattgagtcctcatgattactcctcacgatggtcctcttggaaaggatcctatttttctatgagaaaactgaggcttgagtgttaaggaacttgcttaaactcacacagttagtaaaggtcagcttttagatttaaagccaggcaccctcattctagagcttgtggctcaaccactgagctatactgcttgttagggttgttggtggagtgatagtagaagtagatgggctagagtttttcatttctaaccctaaaaatctatagctattaacactgaagacagcaactgccaattaaataaatcctcaacaagactgagaagagaatctgctaatctgttggtcactaatgtctgcagtttatctgcttatctatctgcagcaaaactgtcttagaacactttgctgaatgaaattgaacatggaaagctgactgaagggaaaacagagaaggtgggatagttgagaagggagtaagatcagacaaattgcaatgctctgtgggatactgcgtccaagcagaacagtcaagggattcagttctcagaagctgttcaggtagacgccctccttaccagagtcggttagcctcttgctgtatgcacacttgaggctgctcaaagcgcgagggaggcatggtctgtgctcattccaggcatccaaagcaccagggaggcatgatctgtgttcattccaggtgtcttatctcgctgccacttccaggcctgcacattataggcaatatatttactacactctcccttctcctttattttttacttctggatgtgccatggtgaatatttttcaggcaaatcgggggaatcgtttccatttcaagctgggttgaaatctagcactatgattagggttgtgctaacctctgcctgcctctcccctaactcctgctgtgtataggtgggcatggctcaagcatcctcagggctgggagaaggttgcatcaggaatgtttctaccaacagaagctggccagtgggaggcttgtaggcactttgtaatttaccattctcttcttgaactatgcagcagtctgaggggctgtacagaggattcttcccagtcattcccattgctagctttggaggccttctcccacaattcatagcctcctagtaatgtgctttattcctaaagcccagtccttggggtttttgaagaaaaggaaggcagatcagcatgccttccctagtctgaaattaccctgtttgactcatatagtgtggagctttataatctgtaatccaaaattgggattgtctatactataaggatattctctgggacttacgcttatttaaccaaggttgtctgcaatgggaagctcccatgacgggagattcaggagaaggctggcataggcttctaacttacaccagtgctccctgatgcctgtgaatgtggggagagggcaaggagattttgagaacagataagagacatttgaatttctcaatgccttctgaaaatctgtgtgcagagttgaattgaaacttaccttgttagcattataaatctgaacactttccttgctaggccacaatgacttaataatatcgtctaaaggatctatgttcactctgcttgcactgatttacatctcctttttccaattctgcgtagtctctggacacttctacttccaaatatcacctgtttaaggaatagcacttaccttgtcttgtactgtgaacccaaatttctgtgaaaaatggactgtagcagttgttccagtttgagattgctgagtgtcatgaacattggttttgaagagtatggagtgttgttggaggacagctcgaggctaaatgtggttgtgcaatatggtttctacacactgtccagcaggtggttggatacagttatgccattctctgcttcttgtttgttgtcttcaaaacatgaaaaaataaaagcaaaatatagaatatcttcgatgaattcagcttctcttaatctcacttttatctcctttctgtaagacttagtcattatttccgaatatgccatcaattttatccaagtgaaaattcagttttagttttaaaacacacagatataaaaataagatgcaaagttctacagtaaaattcttagacataaacactgagatttttggattcacaaataaatagtttagataacactcagaaagatcttttcctcctaattagcttctattgtcacctcttcctaagttgatatgtagctcaatttgttaggaaatggatttcccacgcatgccctaactataatcataagcatctgcaactctgttttcaaacaaagcatctgcaactctattttcaaacaaaggtagttactcatgagagagcttctttaaactgcaatggaccacacagaggtggatgtctagcacatttacagtgaccatgatcctatctctcaccatttcttcttttcaatattgcaggattctaaccatatgactttcccacccctcacctgatgtttggcgacaatatcctggcttctactggcaacaccatcttttgctatttgggtaaatgtgctccttatcagccttggatcctacccaggctcagggccttgtgagtgcaatgtctattgggctattgtggaccccatgactatgacccagacactcagttttgtatgccacatcccttttcagggagctaggtcaaggacatcatgcaactcatttgcatgccatattgaagattcacacttgggggaatattttattctcaggcagctaagaccttgaaactccagcatagtatggagagtgctgagccttcagcatttttagcacatgatttcagccttggaaatctgatgtacttgcagacctctacacaagaggaggtatttgcatagaaacatgagcatgctggggctgggtcatccttttactacacatgttaaagcatacattgtaaccaaaattttggaagcaatgagaatctcttactctactattgggatttggggtcacagcaagactttggaagaggtgttactgagaagatgcctctatgaggtgttactcaaagtcattaattacttacagggctctacgagaatggcatagttcatgtcttaaaaccgcttatagctactggttgagacagaaaaggaaactatgtgctgtgtgattaaaccggtgttttcttttttgcattctgtcttctacatgtgttgtggtgaaatgaaactttaccacattcagcagtgctcaggagaaacattgagcagtgttggtatatatttcaatggcattcaaaaccctgataaataatttaggacttggggagatctgggtatgggaagaagaactgaaaaaaaaaaaaaagcagcggtaatttactaatatatgtttgtaggttaaaacactttttatagctgaccgtagtagatagaatcattctttacaactattaagtggtattaaataggttgacccaactcccttggaaaagtgattaattttgtcttccagacctgacttctgaagctcaaagttggtttaaacagttcagctgtagtagaggatagcctgatatcctagttttgccacagtatctgggccagatggcatttgcagtaaatggaaggtaacaatgatcagctctggtatttacgtgtgtaggtgatatggtcatgtgggagtgttcataggcttacaagccatatggctcttggccataaactattgctaggtaaggctttgactctgtatcagtatgaataaagtagctctttcagctcatgagtatccatttgctttgtgtcaggctgatgtcaagttaacctgcttttgcactctggtgaacagacacatagattattaaaactgaaagtgatctaaaaagttatctaaaccaatatcctacatgaagaaggatcctccctacagcctcacaagtaagatgattagtcagcctctacttgaatatttccagtagtggggagctcataacctcacaaagaagcacagcctgtttttggatggctctaatttttagggtgttccctcttatttttgatgaaaatctgcctctctgcaacttccttagtcatgactggagttctgttgtatgagctgaatccttttatttcagaatagggcatcacatatttgaagaccaacattaagtcccagtgtagttttcttttttctgcatgaaacattcgaaggtctttcagtaaatccccttgttttcttggtagggagtcactcatcaccacttttctcttcccactggagctgtattaagctccttgaaactttgcatcctggagatacagctttctagtcacaaagcccaatttaccttctctgagaagagtctagttctttttattagttttagttgtacagtttgggattctcctttttctcctctttgtcttatttttcttcccagcttcctcctcacgtggcgttgttgtgcataaagttctgaatcatatttttcatctttgttcgttgcaattattgtcactctgtcttccttcttggattatttctttcattctccttagaaaatttttgaattctcccatcagctggagaaaagatatcttttaccttctcctccatcttatactgactatgcaagcagcttatacttaggtcccatgcaagcagtgacttcagaaaaaacaagaataccaacaatgtatcatctcctattgttggctcttggttttgaatagatattccctacccaactagattcatgtgtgcgactctgagtataggtcattcatcgaatgtctgttactgctagagtctttgagtatgtagtctgttgatgtgaacctaaatgtaattggtgttacatgcagtttaaatgtcaccctatttcaacctcatgattctcaatctttatgccaatagctacagtatatttattgtctaccataggatctaattacataagctttggtactgctcgttgtccagaaggatcataatgttagagaggacatgtcttcctcacattatgaaggactaagaaacagaggctcagggagaatatttggctcatccaagattacaccattagttcagcagctggtcagatgctgtttccgataagccactcagctagctaactcccttggcttcaatagagaaagtgacttaaactgtggcatttctggtcttttatactctctctctctctctgtgtgtgtgtatatacattttttcttctttatcacctagcatattttctgatatgtaataagttctcaataaatgctggttaatgaatatttcaagccatcctttccttttggaagttgggaacatgtgtaaagggaagaagactagattgagtgataaagcataaaatataactaggaaagtcatagcttgggatagagagtatatgcagtttgttcagaagtatataaggcattgtgctatgtgccacgatgcctatacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccctgatatcagtgagtttataatgagataaacgtattatatttggcattgtgaaaatgagataaaaatagagataagactgaatcatatggaaaaaattagtttccagttcaagagaatgttatcaacatcaatgaggagttcagagaagggaaggtaatgaagagcctgctattatgctattgttctcatcagaagaggggtgagtgtgagggaggaagagaggatagatggaagatgagaagagggtgtgtgccagagcactgttgtccatttagtgccagccctgtgtggcaaataggacacaaacctccaattggcttaagttcctgaggtagaagagattaagaatgttaaaaagggaacaaaatttattgagcacctactataggtgaattcatgaatatttcttgatcacctgtctgtggaaggcactgtgttaggtgttagagataaagagagatactatcttcaccttcaagggcaggccaagcagtgtgctaggaacctcacaaaaggaggtgctgaagtcacataagctccccttatgtagttattccagttcctggttttcacgtctaatggatttttccccatagcttctccccctccacccaaccccagcctttccagagtgtgtctgtcttcccaaaatgagtttgatactttgtgcgcatgccgggatccccatgggattgatgacatcatacgccattggctcctattgcacacaagagaggagacagatctgcacattcctgcagttaatgctgagtagaatcttggcagaggtggtggcatccttcatttgactttagaccttcagcctcccttttaaagccctggctcacacagttattgagaagccttatcctgcaaggaacctacagcttaggaaagagttgcccatgtgtctttgctatcaaacaaaagatattggcaaatcttttgtcgattttctattctggcagaggtaccatttattatggggtagatgggatatagataaagcatctccctgcccctaatccctgccttgctgagataaatgcctgttccattccccaatcaccagaaaatgccttggagcaatggagtctaacagcctgagagttgtaaaggggcagcaaagccacttctgcaggaagagagtgtgcatgaaccttattcattgtccatgtgtggagttgcttcatgttcatgctcttcaccctgatttgacacataccaacatcaaataactatctactctaccccatttggatactataataaaaaaaagatagtccagttaccttataaacaacagaaatttatttctcattgtcctggaggctaggacatccaagatcaaggtgctggcagattcagggtctggttagggcccactgcctggtttatggatggcatgttctcactgtgtcctcacatggtagaagcagtgaggcatctctgcggggtctcttttaaaaggaccctgaaagagggtgccaccctcatgacctaatcacttctcaaaggccctacttcctaatactatcacattgagggttagaatttcaatataggaattttgggggaacacacacatccagtctatagcactatctgataaggcttctgaatagtcctgggccattttacataacgggggtttactaaggactctcaacagcatagctcttgcttcaaggggttttccatgcggggcctgccagaatcccctgaagatttgcccttttgcttttgggagaatcattgagagaaaaaggacctggctcctgtgcttttcgcatgctcacccactccggcccttctgattaatgtttgctgttctgctttgcagatgcctcccaggacccagagggagactgtagcctcatttctgtggagacctttggctggactctcctggctctcccagaggtgagagaccgtggttcctgtagcctcaggcttggcaccagctcatctctggtggatccaggattccagatatccaatctcactacagccagggcctctttgtcccagtgtgaccttgcgggctgtccccctgactgcgtcttaacagcccctgccattggtgattttcattccagctacgagccaatggatccctgaaagcgactgtgtgggcttctctcaccatgtcgctctggcctcagcctggcggtgtgctcctctgtggtctggatggggatgatgaactcgggctgcccgttgtttttgttttgtgatatttaaagcagccgaagctctcattactgtaatacagtatgtgcctgggctaaagggggagcagcattccttctggatcagggggcaactctattctgttgtggtgcacccgctggagtgtttagaaccacggctggtagatttacagtgccagggctgacaggggccttggaactcctccattttcattcattccagcctcgttgttggaatgaagagggagctgagcccattctgggtatgggacgattgcttaggccctggggtgatgagtggcagatctgggactagaactcaggcccagaggccagcttactgtcatctggctaagtttctgcttctgttctcttcacttgttcaagatccttctgaggccctgaaccaaatgaggaaaattcatgtaaatcttagcacactgcctgatacataataagtgctccataaacgtttatcagtgctctcataagccctgagacatgcaaaatattcttgcccttcagggacttacagtcttgaggaggagataaaaatttcacacatacacactaacacaattaaggagcaatttaagtcactaaatggttatctgctaagttttggggaataggtgcagtggatcacgcaagagaggagacagattattgtggcctagaagaagtgccatggtgaagataagagcataatgtgtatgacatctgtgtatgacatcttttcaactcctggcagtgagatgaacaggtcagcagccattcctggacactgcagagccctcaggccatccactcatctacccagcacattcactgattatctcccaactctgtgctctgcataagaatgtaaggaagaccatgacaagaccctttcctcaagcctagccagggagacagacatgcataaagatactaccactgaaaaattctacattcatatgtgttcatatcctcaaagcattgtctgagcccacaggtgggtaggcaagtcagataggagcaagagtttgaaggaaagcatacatttacctggtgaaaaggggcaactcacaagccataagctcttgtgcaaaggggctggtaaatgtgagtcttctgcaggagaggtggagttgctgggaggttagacccaagcaagggcattctgagaatgagattgagaagcctctgaggccagcatggggcaagcccttggtgtcacacttggccctggcaatgtggtatttttaacctgggccagaaagtggagaggagcgggcctggtaggatagagaggagggctctttacttatcaagagtaggtaccagatgctggtgactcaaggggaagcttcctgagtggagatggagcctataggtgtttaatcgcctggaacaaacatattttctgcactgcttggttcagaggctgcaagttaaagtaacacagaagagaatgtccggccagcaatgtgaaggaagcatgaaacggaaagggttagaagctgaacttctcttgatcaatgactttattatcttggcaaggattgcagaaactgtaggtgctgagggactgacttgtttggaggaaggggtagggaccaggaaaagaatcccagacacttggtgctaatccaactgctgaatgaggctttcaggctctgggattcaggcaggaactcctgggccatattcttcctaggtatggggctagagagccttcaatcttagtgtctgtatgtccctgggccaatctgctttgttctaccatgcctaacatcagaaaaaaaggggtagattaagtttagagccactgctctgtgtctccatcctgcttctttttcctaaggcaattgagccttacaaggccttctaagtccctatgaggtctacagctgtcagggattggtgaggatggagaacaaaccagtctgttctgaattcaactcttgctttctttctccctctcacaattgaaggtcttcctgagcctttgcctctttcaacagctggatgttgagactgcaatttttcatgattgcttgttttgtattttttcttcatggtctttcctaaagtctgttattcatccaggtccacttatacatcttctaatctattgcaccaaccctgcagccatggcctggcatgaagctgcttgctcattgtcttgttggtttttccaaatgctcacaggcgctagtcatgtaaatctcctcctggcaagaaaaaaagactgactttttgttgttgttgtgttgccccaggtgattcagccagtcctgggctcacaatagatgctaaacatacgattgccacctcgactgctgatctttttcttcctatacaccattctattcataccgctattcaaaaattgatatttataagcacttactatatcccaggaatggtactgtaagttctttatatgcattattccatttaattttaatagtgataccattttctacttttaaccagcttatactttctacactgatagaaaagtgtccctaaacccacagactagttagtacctggctgttttagaagttcctcactcatgacatttctgaagttatcactacaggatatggttgcaaaggcctgggaggagaaatcctttctgtctctgatggtttcagagaaggtgagaggtctctgtctctttgtggtaaaaacaccagggtaggccttgatctcctgagtcttgagtatgttaagggaaagacactaagattgctctgccaaaagggcagacagaccctgcctggtgtctgggaagttgagcccaagtttctctccaaggagggtctcctgcagggatcaggaaggagggtctattggcatcacacatgatctcttctgggttcaggaggggttcctatagctagatgagatagaattgattgatgtctcagtgatgcttcaggccatgttgattgggcctgcactaaaagtaagcagcccttcagagccatgtgctctcaagaggcagcacagccataaccgcaagagtaggatggtcctggtggaaatggcacaatcaaaacaagctcctgggccttgtggctttgagtggctgaactggaaggttcttgaggtatgagcactctcactcacggtattgatcaagcagcgtaatcacatcactgcccccacagaagtggctgccactcagttctcctcagcccaggctgatttctgctctgctggttcataggaaactgcttgggtctttcatgactgctgaagcccaaggcactttccccagaggcagcatcactcacaggatggaccaaatgaaatgtcctggtcaaaggcaggaagtttgtattgttgttcttgcctattttactatcatgtaaatacctgccaaccaacctacacatattctctgagtacttactgagtacttactatataggtgttaatggatacagaaataagagtatggctaggggtggcatgctttttgcccctaacttgcaaatttattgagaacatgatgccaggcacagtgaaaaccaaagagaaatacaaataaatggtaacatttatgagacaggtactaggttctagacacttcttacatgttaactcatttcatccttacaacattcctgtgggcaggtgccattattactcccatttttacaggtgagaagacagaggtgccaaggttcaagtgtgtgcccaggtgcatgacactggtgagaggtgggagacaggactcaaacccagcaagcctggtctcagacaaggtgactcataaggagcagcaagggaggtaggaggcagaacattgagtgcaggggctcagagggtggagggaagtaacttcaatctggtttaaagaaaccagttatcagagacagacagggcctaaagaaggtatgggtggctcagagttttaggaaggaaaaacaggaaattgggctaatagggatagcgtgataagagaacaagtgctaggctggaataccaggggcctggccttgcctgtgagcagctgctgcccctggggaggtcactttgctttttgggctgccttatttttatcacctccaattggagagaattgagaaagatgagctttcaggtcccttcaggtttttaccgtatggttctatgattttgagggctggcatgtttccttggttgcttccaaaagcctctgaccacagtccctcaggctgaccctcttgtgcccagtaatgtggaaagatgaccttctgctcaccagcacatgcttccaagggctgcggagcctgggacagaaggtacggtgggaaagaaaatgagaggagctggttgggaaagatactcacatgcagaaaagtttccagcaagtcagaggtgagagtaaaagatccaaatgaaaagctagagattgctagggctcaccaaggttgaataacttgtccagggtcttagcagactgagggatactggatgataacacttctaaaatactgttttgtatctggaaaatgctctgccttcagtttgcattttctctccttcttcctccccagtaatcaaatgaagacgttagatttgacatttcccagtgtgtacagtacagacaggannnnnnnnnnnnnnnnnnnnagcttgctatttcatccagtgtgggtcacctcaggtcacctggggcacatcctatgtgcccagatacttacggaaggggtcattctgggcctttggctccacaccgaggggctgcattttgagaatcacgaggttgggactcccagaggaaagttgagagttaggaaaacttcaacaaatcctcaggaatagaaacagaacatgagatgagaatgtttgggacagctctgctgtttgtttctgtgtatgtgtttgagggcccatctcttgccaaaaccaagctcatttctgcatatttgtttgcttaatatgaaatactccaaaactgctcttcatatttgtttaatctgaaatgaaaatgactcagcagagaggaaaaacaagatttaaatgccctgaatggcccctgaattaaaatacatagccctaaatcatgggggcgttcttctccccaccaaatcttaatcttcaacacacacaaatgcaagtgccacacacagtcatgcacacacacacacacacacacacacaaacattgtatttgcctgccccaacttgacctcagtccctttatctcttttccccttcatactccagcctttccagggtcctacctttcctgcaggggaggtgcatttgagcttaggtggagaggcctggcctgggctacaggccacagatgattttcctggagggccagcacttcctctccagtccagatcacaggctcagtgtcaagatccctgggggaaatctgaattttcattcttcagcaaagtcgaggccacctcagatagtccctagcttttggatctggaaaaatggactccgtggagagaatggctgtctaccaaatcagacatgtcttgctttttacacaagctgtattcctgaaaagttgggtataaactggatcttggtatgttgcatcaattttgaatgtactgaaaagatttgctattcaaaggaacccagcactggattcttttgtcaagggatgaattactttgtaatggctactcatctagtgatttatgagtttggtaagtagatggaatatttttatatactgaatgttattttaaatgtactgtgtgggatttgttattcaaagttacccggcattgaatccttttgcgaagaactattctgtagtgtagataaacatttcatgatttatgagtttggtaactttaggcatttcttaaagtgggatatacccctagttctgcttcagagaaaaagttgttttttgcaatgatcagacttggagaaaaaagagttctaccatatttgagttatggtcactcctgaggggcttaggaagaatggaggtactcaaactttccattttgttggagcaaaagatccaggagttgcctgctcttcttactttccatattatcactggggtggaaatgatggaggtatttttccaaagaaatgtagttcactattatagctacatttcaaaggtgtttctcttcatatctatatcatttgaatatatatttatatatatatacacacacatacatatatacacacacatgcacatatgtttatacacacacatgcacacatgtacgtatatacatatataatctatcatgtgtatttagatctaaagcaaagacattgcagtagggcttgtgttttgaaccactgaagggctgctgtttccaccagtccagagtgctggggcttgctctgagatcaccaggggtataaaccaggcaagaggagaacttaacttcctgctcactctttctcacttggcaggtcaaaaatcatttcagcacttatctcccaaggttcctagctgtgtccccataccatcctatctgagcactagtgtgaagcttgttttgggaaatgatctgattgctaaggcagttggaaaagagaaatatggtgtcatgtgtgtacaaccaagagctgatctaggatgcccacatattcctggctcatccatgagccacatattcattgaagttcttataggtaggagcaaaccctgcctataagaaccctacatggactggaactgtgtcaggcagaatgttcagataacttaccctttcaccatgatttggccctgaatgtgtctcagaaaaaggcttttagaagctcacccaagtacagagataatttgtgagacatttaacctctcagactcttgcttttttctttcctggagagctgctaatttctagttgtggctgccacactcctgtctgcctgatcttccattttacttcctggtttcctggtggctttgacacatggcctgtccagatcccagtgggggcagtcctgagatggagagctggtggtcttttgtcagatctgggaagtcctgagccatgacttcctttgaaatcaatttggaatgtccatccagcttggctagggaagaggattttgactgtgaagagggaagtgggttctttactacaaaggacatattctctctgagccacatgctccttgatgttctttggtaaatattgggctgtgggcctagaaacactgaccttggagtcaggcgaactgggatccagttcttactctgtggtcttctaacttagtgacccaagcaagtcaaaattaatctcatttcgagatagagatatgcaagatccttgaccttcaatgactcatggtcaggcttgagagaaagtcaggtaaagaagccaactctaattcagcacaatgaatgggaagcaccagccagaccaggtaaaacagcctcaattgagggtgaagtgacttagggccgtacttttctattgtcaaaaggagatgataatttctctccacaggattgtggtgaggctcaatgatgtaatgcatctataagtaactgataaagttcaggaattctaaaatagaaacaggcagtaattctcaactgttttcttcttccactctattcatgtgcaagatgtgctaagacatttcccaatacaacaagtgattcttgaagtataggacgtgttccccccacacctccaactctcggaaatgcacagaaagtgtccttgagattctgatagcctgcttccaggaaaaatgttttgtttggttttgtcagaaaagctaatataaatgacattaacaaggaacacattttccttgttgaaaatcaaaacattacaaataaggctaaagtctccctttgatcaccattcacaatctcctctgacaaatacagcagtccatctcctaactctgtcttggagggaaccactgctgtcagcatggtgtttaatcttccagatcttatatatatataaatgtacatgagtgtgtgtctatcataaaaatatatagtgtgctttacataaactttgcaaccttcttgttcacctaaaaacatgtcatagacttcaaccgttgtaactgtgagtagctctaatgcattcattgttactattgcatagcatttcacagtaggaatattctatagttaataacattatcctacggtagacatttttctaagtttttgttgttaaaaaatatattgcaaagcacttttttgtgcatgcctcattgtgtacacacacaagtctttctttagggtaaataagaataaatgggatatagaaattatggtatatgtatttttattgaaattatcttctaatttatatatccagcagcagagtatgagagtatgcatttgccatattattgccaaagtttatattatcacactttaaaattttgccagtctgataggtaaaattggcattcaactactgctttaatgtttgtctttgtgactacttgagaggttgaatacttttagatgtttacagcattatattgtctcccctgttgaatgctttttatttacttggcccatttttctagtggcttttaaaaaatgatttatagagattattaatactagaagttatttcattatacaatttcaaatatttatcttagccagttgtttacatgttatgtttatgatgtcttttggtcttaaagaagttttgaattttggtggaaatttttattattcttttcatttctggattttgctttccatgtctcatttgtgcaggccttccttatctttagctcatagcaaatttttctagattttccttgaaatattcttatggttccatctttacattttgggctcatttttgtgaggtgtagatataccttcatttgcttttgaaaaggctactaaagcatctgaaacttcttcaccaagtttaaatacccaccttctcatgtagtacatttccatttattcatgagtcttttctgggttgttcattctcctcagtgttctgcttatctatttctataccaattgcatactcagagaggcctttgctggccaccttacctagaacagctctcattccctttctgttacattactctattttattttcttccctgtacatatgtttctttaaaattcttcttcatttacttgttttcttatgtactataagttccatgttggcaggaaccttctttgccttttttactgatgtgcttatcacctgtaatagcacctaatagatatttacaaaatagttgctgaatgaatgaatgaaggccaatggcttgaccaggggtgtttgcattttgagttttatttcttgaggcttaaataaattgtcaaaggggtttgtactactaactaaataagtgggtagagaagggctttcctagcagctccttgacatgcttccatgtatacttttgagttctgttcacatgtcacattgtttaaatattgaacccttggaaagactcattcgaaggtgcagaaaagggtgattctgctcacaataagctttagagatacttccttttagggtatggaatttagaatgaccagatgtagtcactgaatatatggctcaaggcaatcattaattcattctgcaaatacttatcaggcactctggtagtgttgagactacaacaacgaataaaatgaacatggagcttgtgtgtgttgggggggaatacaaattaaacaatcacagcaatgaatatataatgagaaactatgatcatttctatatagaaacattatgtttttagagcatgtaacaatcaaggggatgagagaatattttgctgagaaagtgaccatttagtagagatttgaactaggcaaagagaggagagaaacttcttggcggaggtccttaggcaaaagaaaatggaagaaaaagaaaagaagctccagtgtgactgaggtggagaggatgaggagaagggcagctctggtgaggtaggtggagcccagatcaaaggatgatatagtgtgatgatgagcaaaaacaaaagaaggaacaacaaaaacaacaaaaacccatgtggattttgaagtaacacaagccttaggttcacatatgagtttggtcacctatcaggtgtgtaacctgattagctttaacctctttctccttagcttccttgttgttgaaaacaaacctcattgagttactgtgaatattgtaagagatggtctctgattcgtagtagaagtacatggtataggtataatacttctaggtgctttacagtgctctgtttgttagctgacagtcatctaattttaggcaaaacagaaaaataattattgcttttggagattcgcagcttgaagcccggcaacagtttcaaaaagtaaattagtcaacattttttgaacacttagtaggtttggcttagttcagttaaaaaccatttttgagcacatactttgtgcacgatgtaaagtaatactttggcaatataagaatgaaccattttgaagttaatgattaaatggataattttataacaatgttgtgaaggatccaatagagttaaattaagcatgtgttttggtgaaggaaagaaaggaaatgaggtgtgggagacattctttgcagaaggaattattggggaaggttatggaggggaggaagttacggccagtaacccatgagagaggtgccacaggagagagagagaattctaggactgtcctgcaaaagactgctaggagagggcggtgagccaagtcagtcctgggcctcagcacttactggatggctgcttacaaagagctcgggtctctctggaaggacatcctggattatggtcatgagttagtgctcaactatagccaagaccaatgtctccaggattcacctgtgtgtttctttctctgggcatgtttatttagggacttatttatggaaatagtgttcccgttgctggaagtggctaggaacactgagacatgtattttatcttatccaaatcaattgctatgaaactatgctcatcaccctttgtagttgtagatcacatacccctcagcccctcactatggggccatttaaatcttccgtgttttatttgctttggatccatcctcttcagtcaaaaccatctgactacattgcttttttttttttttaacccctctgggtgtgtcagtattatactgcttagaaattgtcttagaaagcttctgtttcctgaaaaagaaaactccttactcatgtcatcctctgatttactccatccctgttattgcctattaaagtcttgtccatccttcaagaacctgatcagatatttatttctccatgaagccttccttaatcactccagcttaagggaatttcttctctctttataatattgtgtcacatactatttctaatattgcatccaatgcttgcttgattattagtgttactcagagggaattttttaaaaatcactttgtattctagaacagtttttttttttttgtctcactctgtcgcccaggctggagtgcagtggcacaatctcggctcactgcaacctccacctcctgggttcaagtgattctcatgccttagcctcccaagtagctgggattacaggcacccaccaccaagcctcgctaatttttgtatttctaacagagacggggtttcaccatgatggccaggctggtcttgaactcctgacctcaggtgatccacccgcctcggccttccaaagttctgggattacaggcgtgagccactgtgcctggctttctagaacagttttatatttacataatcattgtgaagctagtacagggaatccttgtatatcccacatccagtttcccctattattatcatcttatattaacatagtacatttgtcaaaatgtatgaactgatatagatacattattattagctaaagtccattctttattctgatttcctcagtttcccctaatgtcctttgtctggatataacattacacttagttatcatatctccttaggcaccctgagctgcgatagtttctcagactttcttgtttttaatgaccttgacagttttgaggattactcatcaggaactttatagaatttcccccaactgagacttttctggtgatttttttataagtagactgaggtaataggtttttgggaggaagtccacagaggtaaagtgtcattttcatcacatcatatcaagaacacatactatcaatatgacttatcaatgttgatgttaaccttgattacctgtcttgaggaagtgtttgtcagatttctccactgaaaagtgaccctttttctttctctgtttttacactgtacttcttgggacaaagtaactatgtgcaacttactcttaaggagctggggaagggagatagtaatgcttcattttcttaagagcagattatctacataaattatttggaattcttttgcattggaaatgtgcatattctccccatttgtttattcaatcattaatttatagcagcatgaactcatggatatttattttattctttggtttataattcaatactgctgtttttgaggggaggaactcattaagttggctactgtgtccctttgtcataccccatcatctttttgtgtgtacattttctcaatttctggcactaaaagatactccaagtccatcttgtttatagtctgctccattcccagaatcagccatttttctgaggaatcctgtctccttttattgaagaatgttattagaaatcaagatctgagcactaggtttgctcattgctactgggatgtcattgcctctaggccttttcagcggatggaacatatgtgtgtatactaacccaggcatatacacatatctataaatatttccatatgtaactatttgtatccttattaagctaaacataagttcatactgatgtctccaaatctaatctattatcatagattagatattatgaatcattttggggaaacctgaaaatacagaatcccaggtatcactccaaagataatgaatcgggataaatattgaacttatatgttttgaaaggcaaacattaaaagtaaatgcttctcttggttgaatattggaatcaatatcaagattatgaaaacatcagtttacatgataaatataagttttactttaccattattcaccatttgggtaagtatttatcttaggaaaacttcgtgtgtctgactatacttttgctaatttaaatttcatgagtgtgcaatctgatagagtttgaaaattattatattaggtgattattggatgtgccattcaactcccaaagtctgtgattcgaagtcccatatataaaaacaaacactgcaggaacacaaaattaattgtgagaattgtactcattcatgttggcagtatctgcctcactcatttcctctccttctctttctgttttcttgcattattggttggtggcagactccagttccaacaccatcttctgagatgatcctgattcccagaatgctcttggtgctgttcctgctgctgcctatcttgagttctgcaaaagctcaggttaatccaggtaacatggctattactcagctatatgctagaagaccagcagaatgtttaaacccatcaatgttcaatggtgggtctaaaagctgccaagagggactacaaagctctttctttttaaatctccatggtgaaatatgactaaaataggaagaaaaatgaatatactttatatatatgtattttaatacttacaacctgttgaatattgtaaaatattttcttatatagagtaggggtgcagtaagagggcattttaaaaaatgggaggtggcagaagcaaccatttgcttctgcatcttctgagaaaaacaggacagaatttttagatgtcttggagaacttcttcaggttggtttaccagttgttttgggctgtcttagactttgattttacttggatgtcctgttatgcttttgggatcctggtcctgtgggatctcaggcaggttctctttcctctaggatgtggccatgctaaaaatagataggttaggagaatcttttgagcccaaatttgtgggattattttgtattacatgcatttttaaagtttaaatggaagtaaataattgtattatttattacacaataatgctgcttaacaacctatccaaagctcaatgtctttaaacgagcatttatttggctcctagctggacttgtttggactgttctctgttctgtgttgatttactcaagcataactggaagtcagctggctattggctcatctaggatggatgtggcactgatgaatggggcaactttgctgtgttctgtttcatcctcctgcagactaacctgggtatgttttcctggaaattgcacaggaacaagaccagaagccagaatactcaaacatttttcaagccactgctgaaatcatgtttactaagtctcattggccaaagcaattcatgtggccaagcccagagtcagagtgggagagcacaaaaaattagatggtaaaggtctgggatgcaggtattggagaagaattggagtcattttttttttcattttgctacaaatatgaacatggaaaagtatacagcttaaatgttcaattttatgaattcataaactgaacacatctaaacagtacctggattaagaaacagaactataccagcactttagaagctctcttcatgctcccttccagtaacttttctcaccaccccgcaaaggtagccattatcctgctttctagcaacatagattagttttgcccatttttgtactttatataaatggaattagatgatgcataaatactctttgtgtctggcttctttcactcaacattttgcttatgaaattcatcctactgttgcatgcagttgtcaactattcattttcattgttgtatattactttgtttgaacattttatttagccaatctactgtagatgggaatttgaataatttctagtttgggcccattatgaacaaaactcctataattattcttatataaaacttttggtagagataagtactcagttcctttgagtatacacttagaagtggaacttcatatgtgtagcatatgatatactattctgcataataccaaaaattttttcaagtactttaccattttaccatcccatagcagtatatgcaagttccagttgttccatgctatattttgattcttgagggtgctttaattttgtcctcttcatagcataagggtacatttgtgaaaatgcttgctctcctcccttcataaaagttccatgtgcatgggtttttctttataccttcaataggaaatatgatcaaacatccttaaaatcaaagaattattggctgaaggagcccagtgccttgttactttctcgtaataagctcagctgttgcatctcagatcctaacttgggtaccattttttcctttttctgttctgtattcctctcaatcaattgttgatgtttggttgcctcctactacattcttcatgctctgagttctaaggaagagtgctgtgagtgcatggaatggtgggatgttttggtggtaagcatagtcatggagactggcatgccacgaggacatttaaatgactaaccaggagagctgatcttctgtgttagagtccacactgtggccctggagcaggaaatgggctatttggagacagcaaatagtcatcttaatttttttttctatttctggtgtcaggtatttttgttggctctttctgacagggaaagagaaatagacttcttgctttgcaaagacctttataggaaaacaggacatgttgaaggactaatccttctctctgccatttctttctattttaccaagtcaaaccagagatgagtgtttgaggcagatgagacattttcattcattatcagtgataaagagtctatcatgaatcctgaggctcatagaatgttatagcttgcacactgctgagcataaagtcagcatatgataaatgcatgttgatttaaggatgactcttcaggagtccttactggtgtcaactgaaagactgactataactaaaagtattgaaaggtaactgaaggcactgaaagactgagtgaattcttggccagttaggtttttcccacagaatggccacatgatataacaaatagaacttaagccaggagacctgagttataagcaaatccaatatgcaaccaattattaaattactgaaacattttagttggttattagctataacatattggttggttaatagtaactgagctaagcattaaactcaataaaataaaaataaaataataattagttgaagctcattgttgaagatcttacaatgactattggtcaataagccttcagtattagcatgatttagttgataacaaacattaaacatgatatgatatgaaatatcaatcttggtgtctcagcagataccaagagaggataaataatcttgtttacatttaaaaaaactctctagtatttgaaatcataaatgtctcacaggtgtcatccatggaggctgcagagtagtggtggtatgacagagatagttggctgaagcacgaaggcagcagagtttttggctcactgttctaaagtatctgagttttggcaaagcaggcagtcaggcagatggtgttagtggcatttccagtaatggcagtgttaaaggtagcattgtcaatggggcctggagcgtaggctacgcaagtctttgtgggaaatgctgacatgaaggtgtatatacatagtcctgaattgtgggcagagttctcagctatcttccagctgcaacagtgcaccaggaactggaacctaatcatcattaatccagtgggagaggttattggaagaattagaggcagtttcttatgtcaaaatcatggctcagaaataccatttagctagtgacatccaaatcaaacaaataatcatcccaataatttctgaaaatcatttatacaaatcaacagatgattggaatgttattagttctgatgaatgatttggagttaacttagaaaaaagtatttagcttaacttttgagtaacaaccctaattataatcctgacttggtcataaattaattgtgtgacagtgagggagttgttacgtgtctctttatacttccttaatattttcacttgtagtaagattaagttggattagataatctatgggaccctttctgctacaaaattactgtgatttttatgatgtgagaactttatagcccatactggaagatttgggcttggaagtatagcccctgaagttgcatggctgttttttgcaagaaagactacttgtttccaactccctaccacttcccaggctcagggatgtgaagtctgaatttcaggagaatcttgcctttggggctaagcacacaggaagtgactgataaatacttaaaaattttaaaccctaaaactctgcttagtggcaggtgaatgcagaaaccctgccccagcctaacctgcaggagagtcatagtgctacaagctaccctgctccagagcatcttttgctctagaggtggggccaagaggtagcatttcaggctgaagatatagcgtatgcaatggctgagaggagggtgaggaacatttggggctcctggtggaggataatgagtgagagagccagcggggctatgtaggagatccattcccctgtgggatccttgagtcaagttttcccttatttccagcttgggctgggactgccaaacttgataggagaactaagggcatctccatgggaaagagaccccacaatcatgcacaaaaatacggggctgcagtagttgtttgagtggacatcagtgtcaggctcccctaggggatataaaaccactgtttcagtggttagtggggaactggcaccttacgtttttccaggtaggaggatgaatagaactatcctgatgatcctgaaattctagcccagcagtctgaagccctgggacccacccagccaattagaggattgttgtgtataaaaaacacaggggtgcttgttcttattcccctgacttggcctgtgacaactgtttgtgctcaggaaagggagaaacatctcttcttctcagcaggcaaaccaggcctttaggatccatggtataaagctgaggcagggcagtgctggaacttcccattttcatgtcacactttcccctcataggaagcaggcaacttactaccagttcagagtcctggggtgggagtccccctttggtatccagaatgcttccactttgaaaaagagtggcaaagccattcagggtttgggattaggagaggacgagcttttctcctcctggccccaaatttattttaggttcaccactgtggtttttgttctttccagcatcagtcccacatgtcagtgagttcttagggtcaggcaactagaattctagactgttcatgttggaatggaccttagaaatatctaagtcactcttcctcactttacagatgaggaaactgggagtcaaagcaggtgagtgatttgcccatgctccacatttagctaatagttaagctaggacgaggacccagggctacctgtctcccaatcccaggtgacttctacctgggccctcagggagcaatgtgctgaagtgacctttatctaaaaatcacatatatccatgcagcctcatgctttcctttctgcaaccaacttccaatgtatatttatggggatgagatgtaattgagatttgagggacagcctgaggccaaagaatggagtcagacgaataggatatacagtgctcacacctagtctcatgctaaatgaggaaggctggagctagaagccctgcgggccaacttacccccacccagaaactgaagcaccagggatgctttggttcccttctgcaccaggttgtgcctttatcaccgctcccttgtcttccaccaaggctgctatgtgttaattcacctacacatatttccaaattggaaactcatttttgtttccctggcttctcgtcattcgtgttcccagagatgtgctgagaaggtttatgtggcctcatctgttaacgagaaggtgatgctagtttcaggtttgtgaaaccaggcctgaggtactagtgttgtgatgtgtgtgtatgtgtgtgtgtaggtgggtggcgcgggggtgtagtgtgtgttagatagcctgaacaggccttgagaaaaagataaaaggccggcaaaagacctctctggttgaatttatcttaagtgagcaatgctagaagctgcccagattggctctttcttgcttgtgtgtttgttttttaagtctaggctgacgcctgagagtggcctttggcatccttcctgccagtaaaagagcctttctctgggtaaaacagaaactcatctgccccttgagccctcttggttgtgccaaatagggaaaaagagaatgcaaaactcaaagaatattcaatgaacacttaatatattctgggtaccattttaagtggtgtcaacaaatttaatcttcacaataatcttattagtattagtattattatataatagtagtattattattccagttttacagaggagaaagtgaggccaagaaacattaggtaactcatagcaggttacagagaaagctaagtggcagaaccggcattcgactctgctccagcaagcatgctcttttcttctacttcttttttctttatcccgtttttcaaatttccaacaatgtatcagttaagagtttttcgcttgtttttttgtttgtttttggagagggcatgttgctctgtcacccaggctggagtgcagtggcatgaacatgactcactgcagcctcaacctcctgggctcaagccatcctcctgcctcagctccccaagtagctgggactacaggcatgcgccaccacacccaactagtttgggtactttttgtagagaaggggttttgccatgttggccagactggtcttgaactcctgacctcgccctcctaaagtgctgggattacaggcatgagccaccacacccggccacaagcatgctcttgacctctgtgctctactgcctttggagtgtgagactcaaggaatgtcagggcagaggaaacccagattcatggaccagccacgaatgggctacagagacccgtgaatcccctgaaattgcatcccaaacttaatgtgtgaagacaaaagtacatttgcaaaatgaaaaatgttttctattatcagatgctcaaaagactctgtgaccagttctagaaaagactaagaatggtggatttaatctaatcttgtacaaatgaggaaactgaggtttagggagataaagtgatgggaggaaacatgtttgaaaagactattagcagacctaaccaggctttgcctactcgctggacgagcatggtcagagttttgggttctctgaactgcagtcttctcacctatcactgatcgctgccttaagggctgttaggaagagtaagagaatatatgtaaagtacctagcatagtgtcaaacacacagaatgtgattaataaatgctggaacttctgtcctcttcctcaattttgtatattgtgctgtgataatggcagacttcattagtctttccattattctatactgtcctttatattttagtttaatcatttcattaattaattatttaacttaattactatactgtaaaaatatttcattttctttgagggcagacttcacctaattcctgggctttgtatcttgggataaaagggttccaaatacatctactgcatcatcacctttccatccaaagtagccaggtgaattcccggttcataccctgaaactttgccttcaccctgttgttttgcattctgaggcctagattcctagttgtaaaaggcagtcagaggagctaaaagtaatgcaagaaaaaacaaagctccactttttttctgttgtcagtagggatagaggcccagggagacctagtctccttgagtctaaactttggggccaggagcatgatcatgggactccaggaagagcttcacacaaagtcccttttctggacctctcagttttcacaaccacctgcagagctcagttttgctcagggctctcgtgtggaaagactaagagtctacagaagaacaacagtgttggcaggagcagacaaggagacagggaccctgcttaccatggaaactgggcgcactggggccattaggtccgtgcatcactgctgcttcacatatttgcttattaatgttttgttctgaaagctgacaagaactctaggggcttcaagcccataagatcaagacatacaatatagcgatataagtatgtaagaaacatagattgatacagatataaaataggaaaaggatatgaaacaaatataatatatatgataaaaattataaatattataataaatatattataaatattataatatttaatattattaatacattaaaatataaacatatatttatattttgtaaatataaacatatatttatattttgtaaatataaacatatatttatattttgtaaatataaacatatatttatattttgtaaatataaacatatatttatattttgtaaatataaacatatatttatattttgtaaatataaacatatatttatattttgtaaatataaacatatatttatattttgtaaatataaacatatatttatattttgtaaatataaacatatatttatattttgtaaatataaacatatatttatattttgtaaatataaacatatatttatattttgtaaatataaacatatatttatattttgtaaatataaacatatatttatattttgtaaatataaacataaatataaatatatatataaaatatgtataaaaataaacataataaatattataataaatatacacacatatatatgtgagtatatttatgtatgtatttatatatagatatatctatatttatgtgtgtatatttatgtaagtatatttatgtatgtatttatgtatatatagatatatctatatgttcacatgttacatgttatatagatatatctatctatatatagagttaaaaataaataaataaataaataaaaataaaaataaaaataaaaataaataaataaatacagagaagcctgggagtttccttgacttcctttttccccctccctcttcttattcatcaaacatttgttgattgcctatataagccaagcactgtaataggtgctggtcatgacgacacaacagattatcactacaccagagacaaagaccaaagtcataaaaacctctgaagcaggaagaaaaaaaaagttgcataaatttttttaacaactcatcacctcccacttaggctcataaaaaaacctcactgattttagtgtcttaacttctactttactgtgtatgtgtccaaactactgaaaaattctgtgagggctatcttgccacatccatactcttcagagacccacaggccaggaccaagagctaagtcgacaatcacactatatatatctatatatatatatatatagatataatcacactatatatatctatatatatatagatataatcacactatatatatctatatatatctatatatagatataatcacactatatatatctatatatagatataatcacactatatatatctatatatagatataatcacactatatatatctatatatagatatatctatataaatatatagatagatatctctttatatatatatagatagatatatctttatatatatatagatagatatatctttatatatatacatacatagtccataaatatgtacataaatatgttcacattttacccaatcaggtcaaatctccaatgtcatgctagttgagatactgaaggtatgagagttagctggagctgaaagaatttgccaggccaggtaaaaagaggaagggaaagcttttgagctgaagaaaaggcacagaggcacaaatagaaaaacaagagtgaggatagtgattattgaggggtcatgaaggcaaaggtggggttaggatggcaccaaaagtaggaaccatataatcttgggatcctcagtatatgacaaatgttttatgatcaaaggccttgtcttcacctggtgttaacataatgctatgccatgctgtctttcccagagtgcaggttccttttgctatcacatttcaacaaatcctgggacaagcacattctaaaaattagacaagcaataatcctccctgggctctctgtccagattcttccccaacttggtgattcttgaccctagtgatcacatgataaacagggtgtgtgtgctggtagcagggtgtgatgaccacgtgatacggttactagacagactgtgacaatggagatcaagagatctagattctagttccagctctgtcactatctagctttgtgactttaggtaaatctctgcacctcactttgctcatttataacatggggtccataaactttgctctctgaacttcatagggttactgcaggggattgaaagagataatggaaataaatgggctttggaaaattacatgcaaatatcaaagactgtgatttgttacttttggaagaaaagaaaatgaaaataaacactatgaaacaacagtttctatcaagcagatgatgcaggaggaagaaagagaaaaaaactccattagtgatcattaaggtcccttgtggtccccaagaccgactcaagttgcttttggggaatggggcttctaacagtcctgaactctggccaccctaactttaaagggatgcagggaccctgtgctcaagccaagcatatccattttatataaaaaaaaaatttttttttttttttttttttttttccttgggagaatagtgtgattgttgacttagctcttggtcctggcctgtgggtctctgaagagtatggatgtggcaagataaccctcacagaatttttcagtggtttggacacatacacagtaaagtagaagttaagacactaaaatcagtgaggtttttttatgagcctaagtgggaggtgatgagttgttaaaaaaatttatgcaactttttttttcttcctgcttcagaggtttttatgactttggtctttgtctctggtgtagtgataatctgttgtgtcgtcatgaccagcacctattacagtgcttggcttatataggcaatcaacaaatgtttgatgaataagaagagggagggggaaaaaggaagtcaaggaaactcccaggcttttctgtatttatttatttatttttatttatatttatttatttatttttaaatggagtttcactcttattacccaggctggagtgcaatggcgcaatctcggctcactgcaacctccgcctcccaggttctagagattttcctgcctcagcctctcgagtagctgggattacaggcatgcaccaccacgcctggctaattttgtatttttagtagggacgaggtttctccatgttggtcaggctggtctcgaactcccgacctcaggtgatccacccaccttggcctcccaaagtgctgggattacggcgtaagccaccatgcctggcttttttttttttttttgcaaaaaaaaaaaaaaaaatctaaatgatgccatgtgagacttgatctcagaaagatgttgggaagctgggaaggaacccataggaatatcatccctttaaatgatgagatgctgagtatggtgtgagtaaattagaaggaagataatgaaccgaggccatttcagctgaagctaccaaagtgcagcaccaggtccagccttctagtgttagagaactgggagagcccatctccttgcagaggtagagcagcccgggactgcaggggagggtgaggccttcatgcttgttcctaaatgcctaaggtcttcgtttaggctacaagcggagcattttgattgttatacataaaggaaaatgtggttaaatttaattcaaatatatgtaaatatcttatgattggcatttcaagggaggaagtcagattcaatcttttggctactgtaacctatattaaagataggaagtatgcaatgatgtgtactgtctatgtacaggtattgctaacttgagaaatgtattggcatgggaggagccctgggcttgcccataggacaaatccacctcgaaagcagagcagagtgtcttcattctgggtagctggtaggatgtaagcctgaattcttggtcttccagtgcttcttaaaaactcccacgtgctctctttcctcaccaggtcctgaactctaatctgtgtcctgtccgactctcaaaaaatcagctcagctcttcagagggcttctccttacattccccctccacacagccccagcatttggcacatgtgctgagtgagatacactgcatgctcgagggataccaggtctccctcaaaaactctgctaattttgtcccgtagagaccgtctgctagtgccaaacccggagtcggcctcctgcccctgctccaaatgggcaaatggctgaaagtggctacagaagttccctcacctctctgagattctcccttctctgaagtcttggtctctgcattctcattgcctcagaaacaatcagattccttcaagtagatgatttatgaattttatttagctcttccagttacttttagagggagcactaattactgcacactactccatcccacctagaaacagagatattaataaaaagtgaatttatactttattgccactgtgattcatgttaactaatcatgttttactttttgacttgacttctaggaagctcagagccaaagttgaaacccatcatcagccagtggtatagaaccaaatgtaatactctttctgtattaaccttagctctagcttatctaattgttcctattttctttttcctttatccaaatttcttcacttatttatttatttatttttatcttatgcaactttggaagccgactccaaactttactgagtgagtcaaagtaaaaataattaaaaataaataatacctaactttattgaatattagtgctctaagtgcttgacataattaactcatatattccttatggcattcctataaacaagtgcaattactaccatgaaattgagaggctgaaagcttaagtaacctttctaaggtcataaaaccttttaattgtttaaggaagagtgaatgtactattttaaacaaatagttctctcttctcctcttagatatcatttattgagccccattacattctataaagtatgctaacttctttgtatacattatgttaaccttggcttggcaggattatgaaagatgaagaaaccgaagttcatagaggtttggtaactggtagtggggtcccataattcagaagtggcagagccaagtcttaatataaactttccatgattccaaaccgtggcctcagttttcttcttcactcctgatctgcatagctacccagtttcctcttcagcttaccttcttgttggggaaaggagatactatttactatgaaagtttcactgtctttgttaaccaggaagaagaattcattatctgatccctatgttagtatcctgaaacccactacagcttggggactgctctcctggggctctgcaagaattgtttctggaaagtattttgggcttccaggaaaactgcaatcctaaaggtctattcctaaggggaatttcaacttgtgcaagaggtctgggtgaccattatacccaaagaatagccctgtaggctgaagaaagaaacccaaataatctttcttggcccccctgtggaatcccattgtgtcaatatttatctgcacaaaggaccagtctgaaacagcctgctctgtgaagcttgtgggaagcagggcctcagtgacagtttctttaagtggactaccttgtcctttcagaaactggaagaactagaccatggtagcctagggttggaggaggaagaaccagggatcaggagacctgaatttcagtcctggttaccctagccctctgtgtgaacttgagtaagtcacttcacctttctgggcctcagaggttctgatatttaacacggagacattagagggattggcttcttaaatttgcttctgggctccaacgttttatgattgcagatgtccctttagattgtagactggcttgagaccgctgaccccaataatgcccctcagtcagtcttgtctgggcccagagaggcccaggtgtcaggtctctgcacctcaggcctcatgtgggccatgtgtgtgttttcctggaagctgcatataggacactcattgacggggagcccgtggtctggagctagtagtgagatggtaaacattatggaacaagcagccctttcaggctctcagccttggcaggatagtatgaaaaataattcttgggaagctggggactggtggcagctgcttctcctcagcctgcctgccaggccctaccagagcttggagggctggagctccctgctgggcctgccacagcctgtgctggtagttttccactctgggaaactggaaaagtgaattggcttctctgtccgggagattggtgggtagcggaagcatcagaaaaccgctaagacaactcagcaggaaaaaccaggagacacttctttgctgcagggtctcttgcttcccttgccattcccagctttttcatgcttctttacagttcatgatagaacaaagacagactggtgggatttgatgaacgaggaagtggaactgggggaaagcaaggagacctgacatttagggcttgggccaacttggcagttctgagtcttgactattggctgagatcccttccacagaaggagtttacccaaaataggcacattcaatgggaaaaccacactggtacagctgagaagtgccacgttggttgccctgggcttttcctggttccaaagattcagtaggatgagaaaggtcatccaagatcatcttgtccattttcctgtgccttttctctaaggcccttgggcatactgagtcactgagaaactttgcctattttcttaatgtgactattgctgatttactaagttcttatctctgaattgtctatcctcatccttatattactttgtcacaatttctagacctccatcctaactttcgttgtctggagattgtgtgcaatacttgtagccctctctgccttttcatctacttatttatttgccaaacgtgtgttaagcatctcatgggtgctgtgtgttggcaggtactgagggggaaaaggaagaatctgacatgattactattctcaaagttgctcacaatttcaacaaggaggtaaccaagcacaagagtaacagaaaatctccgttggagtttgttacttaatagagctcgcctacacaccatcatcactttaatcccatgccacgttttagtattttccatagcttcgtcacattatctgaatagaaagagccagtaatagctactgtcaaatacataatcaaattgtgcctatttgattatgaaaaatctattttcttttttctgtctcccctaccggaatgtaagatccatgagacaaattattttatctgtcttgcttactactgtatcttcagaagaacacccgatacacagcaaaaacttatttattaaataaatacatacacatttgtaaaagaaatacatttgtgaactcaatacatgcaggtaaagataggttgcaataaaatatgtcatgactcagacttacaaggaagtttcctgtatctcctgtctgctaaaacaccattagccaaggctacccttgaccaaactcccaggactttgtttttaagccttgtaaagtgatgaacaacagaaaacacttcctttatcacttttcaatagacgtttattgagcacttggttaatgccagacatcctactagaaattggagatacaacagaggaagatagatatgatccttgccctcataacacatgctgtttagtgggcagaccaaaattaaacaattatttacattacaagtctaaaaactgttatgaacgaaaaccagtttgttataagagcatataatagaaattcctaacttagctggggacttgggggaattccttgggggagtgactggctgacagctgaaggatgagcaggagctagtgagtgaaggagggaggatgcacatcccaggtaaagggagcatcatgcacagagaccttgaggctggaagatactttgtgcattcaggaactgaaataaggtcagcgtgcttggtagagagcaaagaacagggaatagccagagatgaggccagagagtaggctgagacccaatcgtgtggacctcaagggtcacattttcttaagaagaatgaaaacctgttagaaggttcatgacagaataaagttttaggaagctaatttgggctattgtgtggagaagggatgatagaggaacaacgaagaagagctagaaggcattatagtggctcagatgggaggtcatggaggttgcgcactgcatgggaagaatagaggagagaaacagctggactcaactgcaggaggtaggatttgtagaacttgctaatggactggatggttctcaaaggccaagcttacttctcattccttgactgccgcctgttgagagtaacatcttacctatcattcctggactcttcctctccaagaattctattttggtctccaggcagaggttgactcagggagagcctttccagttttcatcaatgtcattgccactctgctgtccaccacacagttgacctaaaccctctgtatgctggaagagctggacgagtcgaggaagaggggagcgctgacatgtgtaacaagttatttacatgaaatgaagcctcatgtcctcccctacttcctctagttctcaagcttgagtctgcattagggtcatctagagtagtggttaatacactgtttgctaccccctcccagcaaccccaccagagtttctgattcattaggtcaaatggagactgataattagcgttgctaatgagtttccaggtgatgctgatgctgctggtcctggaagcatattttgaggatcacagctctaaatggtaactgaaatgcaatcacaatacatagatcaaagagctttcaggaaggaaactggcactcctttgacaccacatagcagagtatcctatatggatctacctccacatctgttatataggaaaattcctgaatgggttcagttaggacacaaaatataaagggtttctatgcctaggaaatataatttaactgaaatgtgtcataaaagcagctgcagcagcagtagctctgataaaactccttagttgccattctcagaatgagcagtacgttagaaggaaagttatttgcaacaatatcatgattcacctcatgtgacccacattccctatttctgctttactttagatattccaagaagcagaggctctcattgcattcatggcctagtgtttagagatgcattaaagccagggatgaaagcccagtgggacggtcagtgtggctttctctggtgcccagcatggtcctagagaatcattacacgtccaggctgaagggacctgggagcagtggctccagagcctggctacacagcacagtcacctggtggactgtaaaaatatgcaggttactgggctcagcttcaggtataccaaagcaaaatctctaacaggaggctcacaaacatgtattctaaaacctctccaggcttttctaatgctattggtccatggactggctttgggaatcactgccttacagaaagcctaatagaactctcttgctttccacatgaagaaacagaccgaaagagagccaggagcttgctcagatcccacatggtataagtggtagaaccgggagtggatgcgaagtcttgattttcaagggttgtgtgctcagtggaattacaggctttagagccaagttctaagatgagttagtatttactcaaggaatggcctttgcagttaaaacttacctgtagaatgtgtgattagtgggaaacatgaaatattgggtggaaaatgcttatcatattgcctgacacttggtaaatgcttctaaatggatgtcatcattactgcattttactgaatttaagcaactcacgactctaagatgcatcattactttatgtgcctctaagaaagaaagaaaaactactgccagttaaactatgacactatttgcttgcgaagtgcatccagatttcagagatgtcagtacgtgaaagaatgggcagtgtggtatttcacttctcttttctcaactctatgaagattcttactttactgaattagacacttaacagtacatgaaaattcctgaaggagaagtatacttagtgtgtttgaggaacaacaaggaggccagtgtggctgatggggaaagtggggtaaggacaaggtccaagacagccaggggatgtctgattccatgtcttcactattgtgaatagtgtgaacagaagagtttcatgatatgactttcatttcttttatgactacatagtattccatgctgtatatgtaccacattttcttttcttttctcctttgctttttctttctttcttttttttcgtttctttttttttattacagttttattttttatttattttttttggaataattttttttttattatactttaagttttagggtacatgtgcacattgtgcaggttagttacatatgtatacatgtgccatgctggtgcgctgcacccactaacgtgtcatctagcattaggtatctctcccaatgctatccctcccccctcccccgaccccaccacagtccccagagtgtgatattccccttcctgtgtccatgtgatctcattgttcaattcccacctatgagtgagaatatgcggtgtttggttttttgttcttgcaatagtttactgagaatgatgttttccaatttcatccatgtccctacaaaggacatgaactcatcattttttatggctgcatagtattccatggtgtatatgtgccacattttcttaatccagtctaacattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgataatgagcattttttcatgtgttttttggctgcataaatgtcttcttttgagaagtgtccgttcatgacaaacccacagccaatatcatactgaatgggcaaaaactggaagcattccctttgaaaactggcacaagacagggatgccctctctcaccgctcctattcaacattgtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccacattgccaagtcaatcctaagtcaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaagggcttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcgtttctttttttttgagatggagtctctctctgtcgcccaggctggagtgcagtggtgtgatcactgcacctccgcctcccagattcaagcaattttcctgcttcagcctcctgagtaactgggattacatgggcacaccaccatgcctggctaatttttgtatttttgatggagacagggttttaccatgttggccagtctggtctcaaactcctgacctcaagtgatccgcccacctgggctgcccaaagtgctgggattacaggcgtgagccaccatgcctggcccacattttctttatcgaatccactattgatgggcacctaggctgatttaatgtctttgctattgtgaatagtgtgagcggaagaatttcatgatttgatttacattctaaaagatacatgggaaaaggtggacaaagggagatcagttaggaaattattgcactattcctggcaatggaagacagtgaattagcttattatgatagtaaaatatgtgagaagaagtaggtgggatatgggaatatttttagggtagccagtagaatcttctctcagtggatggactgaatacagggtattgaaggagtcaagaatggcctcaagatttttggcttgagtcgttgaaagaatggaacctgaaaaaaaaaaaaaagactgaaggatgagctttggagggagtctgtattttactcaatgttatctttattccttatttacatctatctctaaagtttacctctttttttaaataaatatttttaaatacctattttctccccaatatgcactgagaaataaaaatgaataagatacagtggctttattcccctcaaaattttgccacctgcaggggagataggactcacacgtggtacattacaaagcagtatgtatctaatagtataagaaagatatttaaaatgtgagaaatcagagaaaggaggcattcattgtaattggccctatcctcccctcaaaatgcttgcttttgttgagtacaagttcattacattggaaaaggagaatgctagcataataactttaactagttttttcactttgggtaaactgcctccttgctgtacctcaaaccacctccacaacaagcatgctttttcctcaagtttacctttgcatttgctgttccccttgcataaaccatcatccctgcaagagtcacctggttgctgtcttccttcactcaggtctctgctccgagtcaccttatctaagaagcctaccttgatttctttatataaaagaatgcctattccttttgcatactttttcttcacagcacttgccatcttctctcacattatatatttatttgctttattggctgtttccccacatgagaatgtaaactcagtgacaaaaggcactttgttttgtttaccactgtattcccgcaaggccaatgaattgcttaacgaattatttaataaatataggaattaaaataaaccatgggtttggaaagcaataagcaaatggggttggagataggactggactctgaacacagcgttggtttcagaagagagagaagacactagagaacagctctctgactaagctacatgcctctgtggcagcctggaatcttgggacacacggcttgcaccaggccactcttttggttaaagcaaaggttaaagtctggtgtattgggacaaactttggatagagatacagaatgtgatctacgtcaatccctactacttaatagctgtgggccttctgccagtttcctcatacaggatgagtatcccttatctaaaatgcttgggaccagaagtgtttcagatttcagaattcttggactttggaatataatataatataatataatataacataacataatacaatacaatacaatataatataatataatataatataatataatatagtataatgtaatgtaatgtaatataatataatataatataatataatataatataatataatataatataatataaatttacccaggtgagcatcccaaatccacaaatccaaaatccgaaatgctctaatgagcatttcctttgaacgtcatgctggtgttcaaaaagcatcagattttggattttagatttttggatttgagatactcaacctgtatatattttgagagtaatagtgtgtactctgccaactacatagggttattgcaagggtaaagcaaagataagccatgggacagcactttgcaaactgttaagaattctattatcagggtcaagatggcaatcagggacactatgacatggactacagtcaaaagatccaggaatgcctgccttggacagctagatcttctccccaggaggtgcctgagggagacatacacacaggtgacagtcacaaagggtaagtgaagttctacattattagtagctgggcttgggtcctaaatgccaatgtgagcgttctgataaactgacctgggcatgtagcccaggttaaaggcctccagaagcctctctttattcattaagtcactggtgacaaggactaaaacacttagcacactcagcgacatgtaagatcagtgttgaggagggattagagcaggcccctgagagggccattttctttgtgtgattttcaaaaagtacattgatctcatccattggaaattttggccccattagcatcctgtgttagtgtttcctcatccttactcttcccttcaatttcacttctcagaaagtggaatttgagaatttgttgcttcatccccaaacagttcagatttgcccttaagattcaagcataatgattacctgtggcacacattacctctactggagaaattatacttttgataagaataggcaaagtgatattacattcatatgttcatctcttgattcaaaactgacttggaaatcatagtggatggtgtgttaggctgttcttgcattgttataaatacatacccaagactggtcaatttataagaaaagaggcttaattagctcataattctgcaggctgcacaagcatggcattggaatctgtttggcttctgaggaggcctcagggagcttataatcatcgtggacggtgaagtgggagcaggcatgtcacatggcgaaagcaggagccagacagagagagtggggtggcggggaagggactgcacactcttaaatgaccagatcccctgtgaacttagagcgagagctcacttatcaccaagggcatggcccaagccattcatgagagatcttcccccatgatccaaacaccctacctcctctcccacacaccagcccccacctccagcattggggattacttttcagtatgagatttgggtgggcacaaatatccaaactatatctgatggtgtattaatccattttcatgctgctgataaagacatacccaagactgggaagaaaaaggggtttaattggatttacagttccacatagccggggaggcctcagaatcatggcacgaggcgaaaggcacttcttacatggcagcagcaagagaaaatgaagaagaagcaaaagcagaaacccctgataaacccatcagatctcgtgagacttattcactattacaaggatagcacgggaaagacgggcaggcccccataattcagttacctccccctaggtccctcccacaacatgtgggaactctgggagatacaattcaagttgagacttggtggggacacagccaaaccatatcagatggtgaacatagaagtgttcctgtgggtatatggccatgtttcttgccaaaacttcctgcatatgattctggttaattgcagtttctggaagtatcagctaatccttggcctaaagctatctttcccttttttagggtgagataagactccaggagttctccttggtatgatacaagcagaagggccctcttgccttcagttcttcatggttgtagtggatatcctcattcttcaagcccatgatgttccttagggaaggtagttctgctgtttctgtgccaagcctgggcattatgctcacgtgaaacctttttcccttgatttttgctacttctccagggcacttcctgggaatggggcttggtacctattaggactataaatttgcctctctctgacccctccaagctgagagaagtctcgcctttctccctgccacctctactccaccctgcagtccctttctgagggcaggctttctaggaagttctttgtcttcatgtagtttcttttttcttccctgtaaacataaatgtcccctagggtgaatgaacataaaggcctggccacaggctttgaaaaaggaagtgataatacacaaaaatcttcaaaattatctttctccagagattatttcaaaaacagttttattgaagtacaatagacatacaatagactgcacacattaaaaatgcacaagttggccagttttgacttacatataaacctgtgaaatcatcaccataatcaagataatgaccacatccatcactaccaaaagttgcttgtgtccctttatgattcctctggccgctcctccttcccccaggaaacaactgatctctttctgtcactatagattaacttgtttttgttttctaaagttacatataaatggaagcatacagtatgtgcttttttggtctgactttttttattaagcataattgttttgaaatttatccatgttgttgtagcatgcatcaatagttcattttattgctgaatagcaaggcatgatctagggtaggacaagtgaagtgcctagggttaaaatgcagtcagttccttatgatgataatcataatgatgatgactgtaaaaacatttaatgagacctgctctctgaacaagtttttaagtgtaatataccgtatcgttaagtataggcacaatgttgtacagtggatctctagaacgtattaatcttgtataaccgaactttatatccctcgaatatgaattcctcatttccctttcctcccaattcctggcaaccatcattctactttgtttctatgatttaggccatttttgatatgtaacgtatgtggaatcaggcaatatttacccttctatggctgggttatttcacttagaattatttctaccgggttcaaccatttagtcaaaaatgttaggatttctttctttcttcttttttgttcttttcattattattttttattatcattatactttaagttctggggtacatgtgcataatgtgcaggtttgttacataggtatacacgtgccatggtggtttgctgcacccatcaaaccatcatctacattaggtatttctcctaatgctgtccctcccctagccccccacccaatttctttcttttttaaagctgaataagattccattgtaggtgtatcccacattttctgtatctacttatctgctgatagtcatttgtgttgtttccatgtcttggcttttgtgaatggtgctgcaatgaacatggaagggcagatatctcttcaagatgctgatttagatcctcttgggtatataccagaagtgggactgctggagcatatggtagtcctatttttaattttttgaggagcctccatactgactgcatcattttacattcccactaacagtttataagggttccagtttctctacatccttgccaacatttgttatcttttgattttgttgatgatagtcatcctgacatgtataaggtgatatctcattatggttttaatttgcatttccctaatgattagtgatgttgaacaccttttcgtgtaacttggccatttgtatgtcttctttgaagaaatgtctattcaacttctttgaccactttaaaatcatattttttgtttcctatcaagttgtatgagttccctatatatcttggatattaaccttcaaatatataatttgcaaatattttctctcattccaaaggtcttttcactttgttcattgtttcctttgctgtgcggaagtttttgttgttgttgttcaattgtagttccgcctgtttttgcttttgttgcttatgtgtttggtatcatatccaagaaatcattgcttagaccaatgtttttttcatgtatcttcttccaggagttttatacttttagatatcatgtttaaatctttaatccattttgagttgatttttgggtacaatgtatgataatagtttaattttattatcttgcatgtggatatccagttttcccaacaccatttattaatgagatttttttttttgcccattgtttatttttgacactcttgttgaagatcagttgacctgtgtgggtgacttccaggctctctattctgtcctattggtctatatgtctgttttttcaggtaccatactgttttaagtaactttctaaaatattttgaaattaggacgtgtgatacttctgactgatttcttctttttcaacattgctttggatattttgaaactttttgtggttccatataaattttagggtttaaaattatttcaaaataatttctgtaacaaatgtcactgagattttgaaatgcaatcagttgtgaatccgtttcaattgttcttttttttcttacaatggtttctatttttctgctttgtcaaatgcctgataattttttatagtatgggacacacttacaccttaaaactttttgttagatggctgaataggaacagctccagtctacagctcccagtgtgagcaacgcagaagatgggtgatttctgcatttccagctgaggtactgggttcatctcactgggacttgtcggaaagtgggtgcagcccacagagtgtgagctgaagcagggtggggcatcgcctcacccaggaagtgcaagtggttggggaattccctttcctagccaagggaagctgtgacagatggtacctggaaaatcgggacactcccagcctaatactgcgcttttccaatggtcttagcaaacggcacaccaggagattatatcctgcgcctggcttggagggtcccacgcccacggagccttgctcactgctagcacaccagtccgagatcgaactacaaggtggcagcgaggctgggggaggggcctctgccattgctgaggcttgagtaggtaaacaaagaagccgggaaggtcgaactgggtggtacccatcacagctcaaccaggcctgcctgcctctgtagacgccacctctgtgggcagggcgtagctgaacaaaaggcagcagaaacttctgcagacttaaacgtccctgtctgacagctttgaagagagtggtggttctcccagcatggagtttgagatctgagaatggacagcctgcctcatcaagtgggtccctgacccccgagtagcctaactgggagacacctcccagtaggggcctacagacacctcatacagctgggtgcccctctgagatgaagcttccagaggaaggatcaggcagcaacatttgctgttttgcaatatttgctgttttgcaatatttgctgttctgcagcctgcactggtgatacccaggcaaacagggtctggagtggacctccagcaaactccaacagacctgcagatgagggtcctgactgttagaaggaaaactaacaaagagaaaggaatagcatcaacatcaacaaaaaggacatccacaccaaagccccatctgtaggtcaccatcatcaaagactaaaggtagataaaaccacaaagatggggagaaaccagagcagaaaagctgaaaattctaaaaatcagagcacctcttctcctccaaaggaacacagctcctcaagagcaatggaacaaagatggacggagaatgactttgacaagatgacagaagtaggcttaaaaatatcagtaataacaaacttctccaaggaagtttggaggatgttcaaacccatcgcaaagaagctaaaaaccttgaaaaaagattagacgaatggctaactagaataaacagtgtagagaagaccttaaatgacctggtggagctgaaaaccatggcacgagaactacgtgatgcatgcacaagcttcagtagccaatttgatcaagtggaagttcaagtgaatgaaatgaagcgagaagagaagtttagagaaaaaagagtaaaaaaaaaatgaacaaagcctccaagaaatatgagactgtgtgaaaagatcaaatctacatctgactggtgtacctgaaagtgacggggagaatggaaccaagttggaaaacactcttcagggtattatccaggagaacttccccaacctagcaaggcaggccaacattcaaattcaagaaatacagagaacgccacaaagatactcctcgagaagagcaaccccaagacacataattgtcagattcaccaaggttgaaataaaggaaaaaacgttaagggtagccagagagaaaggtcaggttacccacaaagggaagcccatcagcctaatagcggatctctcagcagaaactttacaagccagaagagagtaaaggccaatattcaacgttcttaaagaaaagaatttttaacccagaatttctatccagccaaactaagcttcataagtgaaggagaaataaaatcctttacagacaagcaaatgctgagagattttgtcaccaccaggcctgccctacaagagctcctgaaggaagtgctaaacatggaaaggaaaaaccagtatcagccactgcaaaaacatgccaaattgtaaacaccatcgatgctaggaagaaactgcatcaactaatgagcaaaataaccagctaacatcataatgacaggatcaaattcacatgtaacaatattaaccttaaatgtaaatgggctaaatgctccaattaaaagacacagactggcaagttggataaagagtcaagacccatcagtgtgctgtattcaggagacccatctcatgtgcagagacacacataggctcaaaataaagggatggaggaagatccaccaagcaaatggaaaacaaaaaaaggcaggggttgcaatcctagtctctgataaaacagactttaaaccagcaaggatcaaaagagacaaagaaggccattacataatggtaaagggatcaattcaacaagaagagctaactatcctaaatatatatgcacccaatacaggagcacccaaattcataaagcaagtccttaaagacctagaaacaaagagacttagactcccacagaatcataatgggagattttaacaccccactgtcaacattagacagatcaacaagacagaaagttaacaaggatatccaggacttgaactcagctctgcaccaagtggacctaatagacatctacagaactctccactacaaatcagcagcatatacattcttctcagcaccacatcatacttattccaaaattgaccacatagttggaagtaaagcactcctcagcaaatgtaaaagaacagaaactataacaaactctgtctcagaccacagtgcaatcaaattagaactcaggattaagaaactcactcaaaactgctcaactacatggaaactgaacaacctgctcctgaatgactactgggtacataatgaaatgaaggcagaaataaagatgttctttgaaaccaatgagaacaaagacacaacataccagaatctctgggacacattcaaagcagtgcatagagggaaatttatagcactaaatgcccacaagagaaagcagaaaagatctaaaattgacactctaacatcacaattaaaagaactagagaagcaagagcaaacacattcaaaagctagcagaaggcaagaaataactaagatcagagcagaactgaaggagatagagacacaaaaaacccttcaaaaaatcaatgaatccaggagctggttttttgaaaagatcaacaaaattgatagaccgctagcaagactaacaaagaagaaaggagagaagaatcaaatagatacaataaaaaatgataaaggagttatcaccactgatcccacagaattacaaactatcatcagagaatactataaacacctctatgcaaataaactagaaaatctagaagaaatggataaattcctggacatatacaccctcccaagactaaaccaggaagaagtcgaatccctgaatagaccaataacaggctctgaaattgcggcaataattaatagcctaccaaccaaaaaaagtccaggaccagatggatgcacagctgaattctaccagaggtacaaagaatagctggtaccattccttctgaaactattccagtcaatagaaatacagggaatcctccctaactcattttataaggccagcatcatcctgaaaccaaagactagcagagacacaacaacaacaaaaaagagaattttagaccaatatccctgatgaacattcatgcaaaaatcctaaataaaatactggcaaactgaatccagcagacaacaaaaagcttatccaccacaatcaagttggcttcatccctgggatgcaaggctgcttcaacatatgcaaatcaataaacctaatccgtcatataaacagaaccaaagacaaaaaccacatgattatctcaatagatgcagaaaaggccttcaacaaaattcaacagcccttcatgctaaaagctctcagtaaactaggtattgatggtaagagctatttatgacaaacgcacagccaatatcatactgaatgggcaaaaactggaagcattccctttgaaaactggcacaagacagggatgccctctctcaccactcctattcaacatagtttggatgttctggccagggcaatcaggcaggagaaagaaataaagggtatttaattaggaaaagaggaagtcaaattgtccctgtttgcagatgacatgattgtatatttagaaaaccccatcatctcagccccaaatctccttaagctgatcagcaacttcagcaaagtctcaggatacaaaatcaatgtgcaaaaaatcacaagcattcctatacaccaataagagacaaacagagagccaaatcatgagtgaactcccattcacaattgcttcaaagagaataaaatacctaggaatccaacttacaagggatgtgaaggacctcttcaaggagaactacaaaccactgctcaacaaagtaaaagaggacacaaacaaatggaagaacattccatgctcgtgggtaggaagaatcaatatcgtggaaatggccatactgcccaaggtaatttatagattcaatgccatcccccatcaagctaccaatgactttcttcacagaattggaaaaaactactttaaagttcatatggaaccaaaaaagagcccgcattgccaagacaatcctaagccaaaagaacaaagctggaggcatcacactacttgacttcaaactatactacaaggctacagtaaccaaaacagcatggtactggtaccaaaacagagatatagaccaatggaacagaacacagccctcagaaataataccacacatctacaaccatctgatctttgacaaacctgacaaaaacaagcaatggggaaaggattccctatttaataaatggtgctgggaaaactggctagccatacgtagaaagctgaaattcgatcccttccttacaccttatacaaaaattaattcaagatggatcaaagacttaaatgttagacccaaaaccataaaaaccctagaagaaaacctaggcaataccattaaggacataggcatgggcaaggacttcatgactaaaacaccaaaaacaatggcaacaaaagccaaaattgacaaatgggatctaattaaactaaagagcttctgcacagcaaaagaaactaccatcagagtgaacaggcaacctacagaataggagaaaatttttgcaatgtacccatctgacaaagggctaatatccagagtgtacaaagaacttaaacatttataagaaaaaaaatcaaacaaccccatcaaaaaatgggcaaagaatatgaatagaaatgtctcaaaagaagatatttatgcagccaacagatacatgaaaaaatgctcatcaccactggtcatcagagaaatgcaaatcaaaaccacaatgagataccatctcacaccagttagaatggcaatcattaaaaagtcaggaaacaacaggtgctggagaggatgtggagaaataggaatgcttttacgctgttggtgggagtgtaaactagttaaaccattgtggaagacagtgtggcgattcctcaaagatctagaagtagaaataccatttgacccagcaatcccattactgggtattcgcacaaaggattataaatcatgctgctataaagacacatgcacatgtatgtttattgtggcgctattcacaatagcaaagacttggaatcaacccaaatgtccatcaatgatagactggattaagaaaatgtggcacatatacaccatggaatactatgcagccataaaaaaggatgagttcttgtcctttgtagggacatggataaagatagaaaccatcatttgagcaaactatcgcaaggaccgaaggccaagcaccgcatgttctcactcatgagtgggaattgaacagtgagaacacctggacacagggcggagaacatcacacactggggcctgtcgtggggtgaggggacgggggaggaatggcattaagagaaatacctattgtaaatgacgagttaatgggtgcagcacaccaacatggcacatgtatatatgtgacaaacctgcacattgtgcacatgtaccctacaacttaaagtataataaaaaaaaaagagaaaagaaaaaaaaaacttttgttgcttatccgaaatttaaatttaactaggtatactctattttatctggcaatcaggtgtcctgagactctagcttcctttacttctctggactcccatttttgtctcctcaactcaggaaattctccaggctctgcctgagttcccactcattgtgttgtatcctggacacactctcatgccagtaagctgatgccaccgtaggggtcaacttttttgtttcctgactctcagattgttgtccttcattgtcagatgctcattatcttaaaacataatttttcatatattttgtcctttttggttgtttcacactggagagcaaatctggtctctgttactccgtctttggttgaaagtggaagtctgtatccagaagttattgtttatagccaggagccagaacatggttctaaccagggccaaaaatgtgtgtttgatcccttcataggtgagtgtgtagtttctttatagtttttatgcaattaactactgaaaaaaataattctttgggtcataaaggcgcctggtgattatgagggttcctcactactgtcaggaaattgattagaagtaaacatcttctaataagagaatgggatgggccactggggttattaccaagtacaaagcataaattggcacattacattgtattacattgattgtcagagtttgaaccaaaatatagatttggctgggggtcaaatctcggaggcccaaattgtatttggagtcagggccaggaagacaagtctgatagagtcagggtgatcaaactggggccatagaggaatttaggaagatgtaaattctcttattccttgttcaatattcagtgatattcttcctagggggcttggaaataaaaataaaagcatgtcctctcttttctctttggtttctcttggtctagctatatgccgctatcctctgggcatgtcaggaggccagattccagatgaggacatcacagcttccagtcagtggtcagagtccacagctgccaaatatggaaggtgaggatggttacatcaagaaagcccatgttctggggttgggcagatttcctgggcacagattcctgaccctaggggctggggaaggtggtgttattggcaggaactgttgagaaatgaaggacagacagcaagtgggcctgtcctgctctgtatgttttcagggagagaatttaggacttagccacatgtactggtctggcagccccatctcaaccacagaggccccagggccacattacccacagtgaatgggttcattgataggaagtggatttgctttccctgactttctcattgtgagctgctgcaggaggcaggcaacagtggcacctatgggaaggtgcagattatgtaggacactgggagttagcatccactcctcttctcagtgggtctatgaaacatcactcactgcaaagcatcactcactgccaagcatcaagacactgaggcctccaacaagttctccacctctctcaaggatctcttacacagaagggccatccttgccaacagacagagtgtggcagtttcctggggcgattgatttcaggggtcttgtacatcaataaactccctactgctctactggttggacccaatactctacctggaatcttattattttgtgaagtattgattttattaaaatggaattacccataagaaaatgaatcctgatgaacctttccccttaatttcttagtgtatgaaagactagagtgatggtaggtggaattggaagggagcaacaaatgaatgggtaatatctgtgagaaaagggagcaatccaagggagaggaaaagtggtagggagttctcaaagtaaactttataataatttcacaattttgctcagtggtagctcagcctgaaggtaataaaatgaaaccagattatttactacttccttgacatgctcttccccctcatcctccccatgtgtttctatggctccttgctggtctgcaatgcccatcctgctgcattgcataacccacactggagaccctactatccctcctccctattgccataacttgatgtccaagcaaagggtggctagctttgttaggctgagtttgaaagagggaagggaaatatgaaatgactcatgcgggaacagagagtaggaagagttttatttctctttatgcttctaaatcaggatgggaagtgaaggctatgtgtgatctgaaggcctcagctcactgtctttcagggtctcatggtactccagggaaagggatctgaccacaaatgggtactgtggtggcagtgaaaactgtggcaagaacccaaaatgtttataaggacagcctgctctctcccctcagtacagggcagctgcttgcctgtgaaccagtaaacagctctgtggtttcatggttgctccctctctccccaaccctcacctctcaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtaggaagaagagacatccagatcctggatgtccaagaccatattttgacttaggctaggagaagaagggtacaggttttctgtgtggatatgtgtgtccacagaccaggcatgcccttgtaaatgtgtgacccagggtgagggaggcagggaaggaatatcaaggctgtggggaaagcagagtagatgcattctgctcctcgaattaagaagagagagtccatcaaaaacgtggtggggtgaagaaaagtgagcatgatttaataccacctcttcactcattctcttctctctcctcaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctaggtaggtcactagcccaggaagcctatagactttattaaaaactccaacttctgggaaatgaaggcaatcaaatcagaaagggatgggatcagttactcctggaatggtgatgccctcttgggaagaatagagacagaagcattgctcattaacccagggcttagggccccacactgagtcatgcattcagagtcattacgttgactgccatggaggggcactcctccaaagtcttccctcggtgtccagatggagtcctgctggacacgctgtgcaagcttatacccttgaaactcacatagttccctgaggtaatgggcctgagcagtaggcactcacttggctgtgtttcctttgcagatggcttggtgtcttacaatgctccagctgggcagcagtttgtactccctggaggttccatcatttatctgaatgattctgtctatgatggagctgttggatacaggtaaatcctgggaaactttattagaatgggaaattggccactaagaaagaataatattttatcatgtcttgggatcaataatcaatcaaccaatccgtatttatttagttcttgtacaaggcatttggaaataatttagatgaaggaatacacatgacctttatttccagggaacttaaagcccggtttgggaagacaagttaattacccagaaaacaatcaattacacaaagtaatggctaaagtttgtgatatggctctaagtataatagccatatttttgaccctcaaaacaggacatgtagtctgacacaaatattgacctacttatggaaacaaagggccagagaattgaagtaataagtataatactctgggcaagtcaagaagtcagaaagaatagaccttatacatataaatgctttgaaatttgtaaaaaggggactagtaagacttacaatagacaaggaaagttctaggttaagatgagaattgtagcagaggaaggtaggtagaaggtagcagaagaaaggaagcagggctgaaggcaagactgacctggctatagtagaagctggagttgagaagaacagaatggaacaatggataagcctgaagtggatcaaaggagtgccatggcaaagaagtgtgaccagatatagtaggaacttagggttgggtacaggatgctcccacctataccgtttcacttcaagcctttcagccttgccattcttctagcccacactaacacttttctctctaagcttggtctgcatctgcaaagtgagcctgggagagaattcagtccatcgtgaagaccagaccagatgatggaggttgacagggctcgagagaaggagatactagtgagtctcaggaagggagtgtggaattacagccttctactggcttaggtgtggagaatgaactattgccctctagctgccatcccctgggtgaagacctgattcatccactcttctactcctagtcacttcctttccatcttcttaatcactgttctttcctttttgcttaaacggtcttggcataatttcgctcagtcacaccccaacaggcatgtattcaaggcacagaggaaatcagagatcaaccgaattcagtttaatttaataagcctttgttaatcaactgttactatatacaaggaatttggccaggcatgttaggtattcaaaggtaatggagtcattgatcctacctttaaagtgctcacaatttggagtaggggctaaaacagaatataagttactatgattcaagtatatgagcaagagatagcctatgactgctctggggttcaaaggaaaaagtaaactatagtaggaaagcacaaaaatggggatgaaaacatctggatttcatataataaaagttacttctgtttgctacaaggcttaagggattaaaatgtgtgtgaaaagcatttcgtaagataaattgctatgcacatataagttgttatctgattatcatttttctgaatgaaggaccagtaaagatatggtagaacagatgaaatctgaactgggtcccaaagaatgggtagtactttcacaggtgcagaatcttgaaatggaattttaggcagagggaataatagcatgaggaaaaaagaatcatggttataaagtttaggggactgtctgggagaaatcaacagtttatttaaccacgggccatatttatgtggcaaagtagtgcaggagaagcaaaacaaagcagattatgccatattttgaaggaacctgaagtcaaagccaaaaggagcaagaagtggaggaggaggaagaggagaaattgctgttcttattcttcataaacattatcattaatgtaatgagtcattgaagatttttaaagctgaggaaggacatgattggagctgtgctttagacagattaatcaagcagcatgcaaaggttagattggaatggaatgaggaggctatgaggaacattttaaaactcttagttctgccaagtaaaaagaattaatgaccaaggccataaccgtgactgtggggaatgaggaaaagatattcatttaggatgtttgaaatctgattggatgtatgaggcaaaacagtagggtgagaaaaagggtcagatgaagtttgacagtctaagtgactgaaacaatggggatgacatttatttattcgacaaatatattttgagtgcttaccttgcgccaagcattttccattactatgaagagaagtataatttatggaaaagggaaaccaaggagaaagacttagttcagtaggggatgatgatggatttagtttggagtgtaggtctgtgagactgagaagacattcagtagagaaataaggaaggtagccggaattatggctcttaactccaggggaaagataaaaaaaattacaaaaatgtagacatcattggctttcatttaataattgaagtaatgaaatatctggtggaggtggctgagtgaagagatcctctcagccactgagagatgacatcagagtctcaggaaatagtcatattagcaaaagttactttttaaatttaaaacaatttcaagaataatatatgcttactggtgattttaataactctaaagtatataaatattgaacatttattttcttatcccttcttcacttgatttaattttgaccaagggggaactgaacaggcattccttttaatttctgttgcttttcataaaactttcctgggatttatttttctgaggataatgggaaatatatttattgcaagtaaacttacgttctcctagctttctgatctgtagagagaagaaaaagatggcaaaaccttggaagggagatccaggctctggtcactgtggataaggccagtcaaattttataatttaccaaacattttcaatgattaaatatattttaaaaggctggcataatcacccttagtatttttttattttttgcgattcacaaattttacatattattgatctagctctaaacctcaagggtcacaccaattattgcttgagggtgagtatcccaatctcgtcatttgggaaatttgtgtcatatctgccagagcttgagatgcagagcttgaggaaagagaagttccacatgatggtttttgctctgtccctccataaaaagaaggaaggagcctcttcgtgttctctaagtagtcaaataagcatacatgcagttatattccatccagcagtcaggcttctggaaaactcagcctttaaaacagagcctcttactcagaagtcaaaaaagcctgctaagctagaacacaaaactaaatccaatacctgggattctcatgaaatccttgcatcttacttcctgggtctagtatcctacaaatttaattaaaattaaatagaaattattatttaaatttagagcttgtattttcccccttagtttaatatcaaactgggttgttggatatgtggaatagaagagagtgtgactggattctctgaaattgattcactgaacaatgacaatatgtagttaaaggagagtcagcaccaagctctggaaacatttatatgatagtggggcaagtgctactatgtatggtagcattcattctatgcatttatccatttcctcatttactctatgaattagttcatcaaatgcatttgataatattaagtcattatgtgaagacatattcagtatataagaataggcaaggtgcaataaattatagaaagcttttcatattaaataagacattgtttaaaagttttactactaaaggagtaagcatcaaatattttataaaaattactaatatgaaattcttagttctccattgatgcaagataaacgagtcaatactataatgcaaatctgattatttacaatccttcaattccaagataataagctcatacaaaatctggagtgaagatgccgggtaaaagctcttccacgaatgtgtggttaactcagatttctctctccttttcctcctcttctcctggcctgagcagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtcagtggggtcgggtgtggtggaacttctttaaggaggcacaaatcatagtgtggtagagaaaaggcatgctagaaaaaagtctaggctgatgccagttcaatgacatattctgttactaactagctaaatgcatttcacaagtcacttcatctctaagggcgtgattctccatttgtgtgtaagggagttagaataggtcagtgagctctcttttttttgttgttttgacactaaaggtgacatatccattaagccaataacacagtgtccagggcccacagatttttaagacgcataaaaatgctctaatttcttttaatatcaggtgaaaaaaataaatttttagggtcaaagattatctttttaccagcacagttgtgtgtgtgtgtgtgtgtgtgtgtgtgtatacacacacaactatatatatatacacaatgatatatatatatacacaactacatatatataaccatatatacatatacaactatatatatacatatacaactatatatgtatatacatatacaactatatatgtatatacatatacaactagatatatgtatatacatatacaactagatatatgtatatacatatacaactagatatatatatgtagttggtgttctgcagtcttctgaatttttccttctaggaacctcacagtggcagtgatagttggtcaggccttataaaacctgggctgcaaccctggttacctgtatgcactgtctgcccttggccacctcacttcatgttgctggactgcagttttctcatctgttaaatgaggactgcaccagcatcttctcagcccttccttgccttgaactctctcgagtctataatcctctcagccgcagttgccgtctaccctgattcgtgtgtgtatctatacacatagatacatacacacatatgtgagaatatgtgtattctcatttagaaatgagatttctaaaaaaaaaaatgaaattgttttagattgtacactattttgggtttctcacctagccctgtgaaaagaagaagactggctctgaaatgtacctaggaggaagcaggatggcagtcttcctcttacctcagttcagaatagctcgaatcagggtagacggcaactactgagttggctggcactgtgtctccatgcaccttagcagggccaacctatcactcacatgcctctttctctaccaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcaggtagggagctcaggtcctctttgggaagtgggagcaaggtgatgaaggaggaatgcacatgcccagaacttctcattagcaggtctctgagaggagtgggattgtacaggcagcttctcattgacggatacggtgaatcctttgtgtgactagttttaattgtggaggggatgggatgagaatggaagtgaacaaaatatgcacgtaactcttcttagaaagaatgtttttaaatgagagtacagtgtgttaaaaattttatataatttaaggtagttaacgagtgcgctgttaaggaaaagcacacctaagcattactgagatatttaaatgaaaatttctaaatatacacaaaagtaaagagaacaataaaccactcatcactcagctttactaatcattgatattttgccatatttgtttcacccattccttccttttggctgtagcattttaaagcaaatatgagatactacttgatttcattagcaaataattggactgcatctaagaaaatagcatcattttcataggtataatgccatgataacatctaacaacctttattattaaataatttcttaataccacccaatatcctgtccatattcaagtatgactaactgtccatcaatgtcttaattcagttgactttatcaaataaggatcaaaataaggatctgttggtgagtttctttattctatttgctctgtgtctcttttaatctaaaaaattccttccatttttatttctttttaaatggattctggcttggctgatggctttctgtggtgtcattttacttgagcttctgttctctgtcattcctaatgactggtgcttacatctacaggttaatttgattccagttcaatatttatttttgtcaagaattctttataagcattctatatatctcagtaatgctgtatattttatgctgaacttcatcatggggatgtaatgctagatcctctcactttttgtgatactaagattgatttctggttcctcatgaactttttccctaagttttatcctccatcaataaccactgtctgaattatttatttcactagggttgctaaatgacgattttctaattcttttattttttctgcatttcttagctgaatttcttccgaatagagtaactattcttcatcatgcaccagtttactcagaaatcacattgaaagagcagcatacgtgacttatcttcccctttaattgttaattttcagaataatgacttgataccgtagcaaccctcaataatgtctaattaattttggtttttacccttatttttttggtatcattataaactcattgctttttatcaatttaatgcttaatcgattgcagttattattattagtagtagtatgtttatttttagacagagtctcgctctgtcacccaggctggaatgcagtggtgtgatcttggctcgctgcaacccccgcctcccgggatcgagtgattcttctgcctcagcctcccaagtagctgggattacaggtgcctgccactgcgcctggctagtttttctatgtttagtagagatagggtttcgccatgttggccaggctggtctcgaactcctgacctcaagtgatccgcctgccttggcctcccaaagtgctgggattacaggcatgagccaccgtgtctggccattattctttttaatactcaagttgtgctgtctttgactagagtttgcatttttttttttttgagacggtatcttgctctgttgcccaggctggagtactatcttgagtcattgcaacctccacctcccaggttcaagtgattctcctgcctcagcttcccaaatagctgggattacaggtgcctgctaccacgcccggcttttttttttttttttttttttttttgcatttttagtaaagacggggtttcaccatgctggccaggctggtctcgaactcccaacctcaggcgatccagccacctaggcctcccaaagtgctgggattacagatgtgagccactgcacccagcctagagtttgcatttttaagggggctctttgctcttttgatctgaccctagaagcctttgataactttcttgttttccgaaagaacaaggtatttcaagctcattttgaacatgtacagcatccgacgtggaatcaaccatttcaagaaatcttgattccttttagtaggaaatggtatttagaaaacacaaactgggtagtagggatgctcattactaataggttgtcattgtttcttggatttttcggtggaagaaagcaatgaaatatgtatatttaaaaagaaagattgtgagtttacattgttacttccaattcaaattaaagataaggtttttatttaaagttgattttatacgttcatctctattatttatgctgaatatcatgtttcctaacaatgttaacagcattttcttcatcctattattcaaaaagcaataccaatattattactagcaacgtaactattgaacattaagatttcttagcaattctcttttctttgtcctgagaatatatcctactaagaatgtgcagtcaaagcactatgttctaaggtcagttgggtaacagtgggataattcttttctgtatatagttatatcaccagtgtggtatacagttagggtaacagtgggataattcttttctgtatgtagttatgtcaccaatgtgatatacagttaggttcattgtattccatttgtttcaacctttagggattccttttaaactttaaacactacttttgattgaacagtaactgcagcaaatagtgatttaacttactacagccagaaactgtgccaaatcttgaaaagttaaaaggtgtttagaacattgttcataccattaaatttaaatgggaagatgaaagatacagaatgctttaaaaaaaaaaaaaaaaaaaagaaatgtccaaagcaatatgaacaataaatggtcaggaggagagaggcactagcgtgggtttgtcatagacagcatcaaaggaatgagacttgtactgggcctggaagaaaagtccaggtgtaaaataacataaaagagaggaagagactaatttaaagataaaccacactttgggaggccaaggcaggaggattgcttgtattcaagagtttgagactagcctaggcaacatggcgaaatcctgtctctataaaaaacacaaaaattagctgggtgtggtggcacgtgcttgcagtcccagctacttgggaggctgaggtgggaggatcacctgagccctggaggcagagcttgcagtgggtcgagattgcaccactgcactccagcctgggtgacagagtgagaccctgtttaaaaaaaaaaaaaaagaaagaaaagaaaaataaatcagaagaacccatcctttcagatttgatttttaagggaaaaaaatttcaagatggtttgcttattaagatgtactgataagaaaatagagcatatttttaggaaaacaggtttggtgtttaaatgccttctgtgctaatgatttaatctaagagtaagttgattgattgtttcatctgaatactgagagtagaaatcaagatgctcaaagtcagtgccacttacactgtaagtgttaactgggggacaaatagattcccacccatcctcagggattctcctggcatagtaactggtacacttattatagctaattatagctatgaaccatggtttttactcctggggtctcttgagctttaaatccaatgcataataatattagttttcaccggagcctgacagccgaactccgaaagcacatgcagaggccagatacctccttatttatataataatattaagaagaagaaaaattaggatacctggaagaaatgtctcttagaaaggaaatacatattctaattcttgacccccttgattagacaaatcagagggaaaaactctggcaaagctgccaacatcaatctggcaaatacgcttttgtggtttagtctcaaaagctgtaaaatcacagaaaaagacactccaatgtcagtaaatatctataaagattaagccttaattcataaattgaagggctaggccgatgaggcatagtggagactcttttataaacaatctaatatccttgaaggaaaaagcatcttaacactatgtctgtcccttgcccatttacccgctatattctgtctatattttcgctgaatttgggtcctgcttcttatgctttatgacaatgtgtggtacagccctttgaatcactgtttcttaaacttttttgtaccatagcatctagtatgtaatatgtgaaacaaaaattttacaaaggaaaacttgcttttactatttagataaatggtgattttttattcaacgtatttatgattttatctttttaaaagactgatgacaactcactaaattgatcttgtaatgtgctaggtcacaatatgccttcagagaaaacactagctgtctgtcttctccctggctctgactcacccttgttttataacagatgctgcaatgtacaacaactctgaagccctgcccacctctcctatggcacccacaacctatggtatatgtgattcctaattacacaaattaatttgaagggacttactgggggatgaagaagggtggagagttgcaaagccctggctgtgtgggaggctttacaccagttggctttggatgaagagtagccctggaaaggtaggactgtctacctccaagttatggatccaaatatactctcttcactatggattcatgtgcttcttcagctgaggcagagtctggagttgtcctaatttctccatgaaagtttgggaatttggggtcagaaacagggaaagggacattcctgggtcagacccatagtgggtatttctaaggaggggtggaaatcaaagaaacaaaatgctgatatctccaattggagataaatatgccatgtatgcattgctttaggcagtcattggtgacactagccagcaatgtgggaaacatgtgggattgaatgtgtccaaagaggactttcagctaccttggcatgtctcaaagaatgcagagagtgaaactggttcctcacctgtttttcatgaggtgtgattaagggactacagactcaggccataataatacagagacaaaattttgggaagaatagaaaaactcaccattattctgtctgacacatggagagggggagactactgtcttatggaagagggaaataggataggggaacaaagtaataaacagattgggcgtggtggctcacacctgtaatcccagcactttgggaggcagaggcaggcagatcatgaggtcaggagttcgagaccagactggccaacatggagaaaccccatctctactaaagatacaaaaattagccgggcgtagtggtgcatgcctgtaatcccagctactcaggaggctgaggcagaattccttgaacctgggagggggaggtttcagtgagccaagatcatgccattgcactccatcctgagggacagaacaagactctatctcaggaaaaaaaaaaaagtaataaaacagtagcaagaaaaaaaaaaaaacagtagcaagagcaagaataagcagaagtattaaggtggcatcttccataattatcctcaaggaacagggtctacctccatgtttccagttcagtccctcatacttttacttgacctgtgagatgattgtattctctgccttctctccctggtcacagatccaatgcttaaagttgatgacagcaacactcggatcctgattggctgcttggtggccatcatctttatcctcctggccatcattgtcatcatcctctggaggcagttctggcagaaaatgctggagaaggtgaggaggtgcagaatggtcatgatataagaaactgctcctttctttcttaagccactgttgtcccaggagtaaaaggcaaattgcaaacatttattaatggttggaattaactgaggctaccaagaaacataggaatgaagccagaatagaattagctaagtctattttctcatttttagagtggacatgttggaaccttcctaacgttcctcggaaatgcagaaaactcttcttaatacattgaatctccattcaggcattttccttgaagattctgattcactggattttgggtagagtccaggcatccatatttaaaaaaaaatttaacaagtgcttctgatgcacattcgaggttaagaattactctcctaatgccaagctgaaatttctgataatgctgttgaagttccttctcatctttttcactttgcttgtctgtttggtgtgtgtgtgtgtgtgtgtgtgtgtagaaaaacatccagcttcattaatattcaagccaagtttctcactattctatttctacttttgtgtacttgaaggttgtgattatgtatccctctgagtccctcttcagactctgtctatgccaaatgatctgaataactttttacattgtctaacactttacaggaagcagaatttttcctcatgcataattttatatacacctcattgagtaataactcataggcattgttatgtttaactatttttctgatgagaaaatgtgatgtgcttaaggtcatacaactgatgtccagtcttctatgctttttccaattgttaatattgaaatgcattgatttctttcttcaaaactatattcatttcatcaaagatggaatatctatgacttgtcttggtttcttggaccaaatagcaactcccttggaccaaatagcaactcactgctgcttagtgtctgattcttttggggcctgctgacgactaagtgtttctgcctttggccatgatcacctctcctggtcaattagttcctctcaatagacatggactagtagaggccacaggaactctgagctgtggggctttgaactgcctcctgagggcagggaataggaaggaggagaaatcctgattgatttctgtgtttgggggtggggactcagaggagaccaatgcctgtgtggaacctctattccagaggagaggaaagggcaccatgagaatgggcttgagtctctagagctttctagatgcaggatgggagaaaaatggctcaaatcaggggtaaggaggagcaatcctgatgagtagcctgcaattccttctgatctgtgccaccctcaggttcctgagatggttgatgtttgttttaaggtttttaggaaggaatatttcatggaagagaaggtctccttgcttcccacaagtatgtctaccagtctgaaaacacttaaagctttcaattcgcaaatagcaacagaagactgaaatacagaatccacagagactcactcgctgtcacgagtatgtctcaaggcatgaatgaggcaaatatcaaaatttttcctcctttagaatgctggaaaacactagtgtttaatgaggtattccagagtgagggtggtggtgaactgaaggttcattgaactgcttgaagaggatatgtgaccttcttaaatagtctgttaggaccacattttagccaagggggaaagtctgtgttctctgctatatgagctctttttctctttatttgagccacaatttaccatacttctctgagtctttattctgaggcctgttggaatatcttcatgggctaagagagaaatgttggaatctccaggtaaaaggtagagcaaacattttgcccttgaatatttaacttggtcctccaagaaattctacccctgtacatcctgagtaagatgactcaaggtgctctggaatgacacccagtgtttcttcctgggaacaaaattttatgtggaaaatcattaagtacacacatacattctaagaacattacttaacatagctgtagactgtatgtagcattatttgtaggataattttggtggtgtcctcaacattccttctttgagagatttaacccacatatattgagtacctactttgttctgagcttcatgcttagtactggggatattactgcaacaaaagaccttcagtctagtggaaaagtgcacatctaagtttcgccattgagcaccaaagctgtgtttgttggagtggagcattttacatgtttaaacccaaatagtcacatacatgcaaatgctggcatttgccttttgatggagcaggcaggttatattagataagataccacagaagtagttgctttgttgttctccctcccttattaggtgtaagtcacattgttatctctggacacccagggctttcctgtcccatgttgtagccattttatttttggttagtgaaaatatgggtcagtggtgggtattatcctaatctagggtatcaaaatgatcaagtagaactactgattcatcatgttatagcacatgcattaagttaataaacaatttatgtctattccaaaaccaagtagttaaagggtaagccaggaaaacccatcatttaataaaacatagaaaactctataagattgagatctttggctactgatgggttcttatagcaacagggagataatcttttttttttaagtgtttcagaaagcacatcatagaaattagaagatcaaattctaccttgaagaaatgaaggattattctaagttcctacaacacaggcatttgtggaaccagactgcattcctagcacgtgcagtgttgctggggttaaacagtagtaaagagttatttcatttgagtgggagagctgagtttaagaagaggaggcattgaccatctcttttgtgccaacatgcctttctccttgctcttctcttccaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggtgaggatgatgtggtgggcagggcgtcaagggagaaacctcagcaagcatcaggtaggtatgacacgcctgctcccagttcattgcatctatttttagtctctgctaacctcctgagaagtccacattctctttctagatttggtctgccgctgctcctggcctaatttgagcaactctcctttgctactgaatataagatgtgtggagggacccacataccagaaaagaaagaaaaaaataataaaacatgtgaattaggtgttgacaccagaagaacctaaacagtccaaccagtctaacctcattttacatgtcgggaaagtgagaaagtccagatagagtactcacccaacaccaaatttcatgagtgggtaaaggcaggactagatttttacctggagaaataaataaataaatgaagctaaagacattccgaaattcccagtggtgtagccatttaaataactaaaataaataactacttgagttatctattttttgttaatttctctttggtaaacatttattagagtaatatgagattttattatgagagtaaaacatttctcaccttttctcaataaaagcattgaaataaaacaataaaacaggtaaaacagtaagtagtgtcagttgattcaaatttcgatgtctttcaaaaaatgatgcagagtcatatcagaagggaagctggagtcacctctttagctcagagcaacttttctataagatcatcaacctgagggacccgagtcagtagaaaagaacttgtagtgttcaggagagaggagctaggcctgagctggatgtagaagcagacaggactaaattcaagagcataggattttataggaaggagcctgaaggggtcttttcaaaggataaaaggaaacttgcatctattttattattcaatggatagaagacatgaaagagcatgctaaattcaagtaatttcacagagacagcaagaataaaggatataaactaatttatttcttggggtgaatggaagtaatttacctatttcctaagtctaaaacatcccccacttcatattttaaggcttttttaagttagaatatgtcttaagctagatcatatgtctttaatctgaaagttttttatacctaaaatcagtttttaagtcaataacagtgtcttaaaattaaggaaataagttattaaaccttcaacctttaatattcccaccctgatataccatgagccttcctatagcttcaccacacaattccacaagtttagccacagaatttgttaatgatcatgtattatgaggaaaagaatgagaaataaaatgatgttctacattctgtaggccacaagaaaatctctagaggaagcaaaaccattttccaagtaagaatgtcatgaagcaggttaggctttcacaggggcatgttttagccctcctctcagagttccttcctgaagagatctccaaagacactccacggaatgagggctcgttgcccttgtcttcccaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggtgagttgattctttgattcccttatagctcgaagaaggtggttggataaaaatgatcagtagaacaaagagtcccttccagaggtggattcacaacagaatgtctcttccatttgtctctccttgcattgtcctctggattccagtattgggtcaacctaatctttgtcaaatagctgtggagttcctgggacttctgatttctatataggagtttttaaggcaggcaagtcactagacttcagatatcttgaaaaacattcaatattttcaaaaatgtttacaatagattatggagggtgggatccagaagatgtgatcatcttttatgaactgtccaggaacattctgctactcaatagccactttgtttttttcccctttaatgggagttatatgtaaaatggtcaaaaacaacctcgcccctgcctttggtcccagaatcagccactagggaatgaatcaccaactaggataaggaggagtactcttttcatttgccctcagagtgatgcatgcattattaaacttttcattcttgcatcagtcacatgaaccttctgggagctcaaagcaatgttttgaattctaataggaactcttcaccactgccgtctaaactccaaataaaacatttggtttcctaagacatgttattggttttcagtgtggatctcatgttctctccttagataggtctggtgttgcaagaggtggagggacccatgttatctgttcatggtgtgacatgtactcattctgtcccctgggttgaaaacccacatctgttatactgttactaatacacaggagtttcttataatgctaaaccctatactaagggattattttaggaaattgccttacgttttacatgatccagtgactaatgaatcgaagttcaagcatttgtaataaaagacattttatattgggctatgctgtaatataatattgttattgattcattcattcacttagtgttccaagcaatgtgtatttctaaggcaggagagtggcacattagctgggtactttaccattgttttaaatcttatcaattatttgaatcatagatatgttacacatatcttcttattggtcttttgatcattttgcctgagttgtaagagttagtttatctccaggaaatgcccagcaagagtactgagacatcttcaggagaaatgatgatgctgagactagatgacttttgtctaggttcatctctgtgaagtggagggaatggaaaaattcaaagacaaagattttgccctagatgtcagtgccaaccagcctgtcctggtggctgtgaaaatgctccgagcagatgccaacaagaatgccaggtctgtggtctacattttgaattttcctttatgtatttcatctttaggaccaggaatactcctggatacttctgagcaattttttcttttgagatgggaaggtcagtgagctgcctcccatttccactgttatcctttttcttattccgatggggtcggcagtcctcatctttttctccacctctctcaaacacaaaggtacattttccattgtacttgccacatatttacttcctaaccccctgtgcacaagcactgtacttgttcccaacatatacaactgtctaaatgtgtacttctttggtctttatacacagacatactcctgcatgtcattacctcctcttgacaaagtcttcagaatcacacatgactttcttgctaagcctcttccagtctccttttttcacatttctatttattttctcatcccttttttctcttttatgctccttttcttctatctccagcaaccctcaaaatgagaagctacctctatttggaaaattatctatgaacctcaaagcaaaaggatccacagttctctagcagttttccaaactggctaataatctcttggatctttttctacataaattgcagtttccagccacacttcattgtctgacagcctttccattacaataatggtgagttaatcctcacccagagagacaagctggttgaaagctggctgtatgtgtcccagagaaatctccacacctggataacatatgcattttcccatttgtgttgtcttgatttgtctcactgatattcatagtgaaaaaaagtttattattcttattttccaaattatcataaattccaagaatggtgatagacttcattaaaagtcttgcaatggacaagatgtaagataaagaagagagaaaggtgaggaaatgaaactggaggctttagaaatttaactgataatttcaatctttaagatactggtaagaataaaaagtgacattctctgggtcttatagagagacgaagtatttcttatattaatcttagcacatgattggagaaagtggcatgaggggaaacaaaaccaaaccaaaccacaggacataggatatgacaaagcctttctccgttgttccgatcggtgaagtttgccattcctccacctgtgtccttagcaatgatggatggccatgactgcgaaccctcccaagccatggaaacccctggtttgagacggaagggggaatgaaagaggggaggtgttgcatcaggacggcattgattccagtggtttatattgacgtagtatgacttccagtccaggattcctagcaaactcttggagggcttataactcatctgctccaacagttttgggaatgtgggctagaggcctcactaacaaaatcttgctactttatgacccaagggtgtctgtcaccatgtactcaaacaattattagtcttggtcaaatgaatacttcttttgacatgattaccaccacagcctttaaagagctctgttttcgacaggctactaaatacatgttgcaactgactgatggttcgtactgcattaagaaaagtcagtatgagaaaataaagagtaatcagataagccaaagatggttgttcacatcatacaaagtttcttcactagtaatagagtgactccatggctttaaaaaaaaaaaaaggtaaatatcctcgtgcacttaagatatgattttcagtgaaacattttactctgtagagtggtttttagcagcctatttttgattcagcaaatattaatcactttctgtgtggcagggattttgttagatgtgagggatagaaatgtgaataagtcatggatcttgttctcaaaaacattacaattgaataagggcccatgatatttcaggaggaatagaatgagacagatccaggtgtcaatttctctgtcctctcaaaagttatccaaagggaaacaagatttggcataatgtccaggaataggccttggtgtgcattcttctctctcttgattctgactctggcaacttctgagtttatctatgtctgtatcctcccaaggaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcaggtaaacaagccaggtcttccttctcctccctgtggtcatgagagtaacctgggatctgaaaatagggagcagtgagccttaaagtgtatcaatgttctgggatggtgggggaagtcagtgtgcagggaataatggagcagctgccctttggggaaacgcaagggattcatcaagagtagagaaagaatgttgagctttcaaccctagtttgttgataccattttagaatgtgtacctttcacatcttcctgtttccataggctaccttctgtcttcttgtctatttcctcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctggtaagttctcagcattttaaagccctgtctaacaactggcttgtgggctcacatgcatgacacgtggagacaaacctgagacagcaggaggcaaactcaatagactgtagtattttctctgatttgaaattattttctttgtgtactaattcttattatttaatgcttgcctatttctgctaaaaaattaacacacataaaaatttagggagagaagttaaaaagtataagagatttattatctttgtttctctttatcatttctacctagtgattgttcttaatttaagatattaaaaaccttatcatttaaagaaatgttacctatacaaaatattttcttctccattagtttcataagcatgtttctcataattacatagactaattcctataattgtatttcaatacttttcaacatgttctttttaagttcatcattctttgctttataatttttatttgattcttgatattccataccataagtgagtaatttttcccaaatatctctattagaggtatattttctgtccatgcatacctgagactttttattgttgattttataaccactcagctgatttatagactcattagactatacacttttacttcctacaatgccatgtacatgttattttatcttttttcttgtgtgacattgcagagaaaagtctgagaccaatttggttttgttcatttatgattaatctgcttatttcctgctaatattcttataggatttgtaaattaattttgaaataaaaaatgtatagttattcccttgcactcaccaggataaccactatcaatactttggtatattttcttagaggatttttttctatacatatattttttctatgcatgcaattttttttctgtgcatgcatttatatacatatgtacatatatgtaatttatattacataattgggatgacactatgccatacaattctctatctctatttttaacttaacattttattatctgcataatattccatgtgtagatatatactataacttaataatgcctctataatttgatatttaagtactttccaatttcctgctattatgaatgatgctgtgatgtacacgtttacataaatccttataaagatctttttcacctatatatgtgaattgctatattttacccatttctaatgggatagttaggcattactctccctaaaggtattatatggtgttcaaaacaatatattagactgacattcagaggaccttggttcaaatccagtttttccactactaatggtcttattaaccagaagaatttgggaaacctctcctgtttcatttttctgatctaaaaaataaggataactggcatggtggtatgtacctgtagtcccagctactcaggaggctgaggcaggaggatgaaaatctgggctgcgctgcgctatgacaattgggtgtcctcactaagtctggcattaatatggtcacccctaggagcagtggaccaccaggttgcctaaagagggatgagccagcccaggtcagaaacagaggaggtcaaaactcccgtgttgatcagtaatgagatcaaacgtgtgactggccattgcactccaggctgggcaacataatgagaccccatttctcaaaggaaaaaatatttaataataaataatatcatccacttcacagtgtggttgtctgtattgagtagaaaatgtgagtagtcaatgcatgctatttacacctgaatctcattgctgtcacttgttaaagtctatctttcaacactgtgattatcactgaactggtaaatgagagtcctggattcactgcaggcacttaaactagattcctctatctctaccataaaaaccattgacttcccattcagattttgcctttctcaggagcattttcccaaggctaccctagagttgaaaggttgacctaacactcagttgcagagtcaaatagcttatggctgcatttttttcagctcttggatctcatccccagagaaacagaaccaagctgagatcatgagaatgaaagaatgggctgtttctaaatactccatgcacatcttggcattttcagaattccttgcctgtggtgggggaaggggtatagctgcagattatgaaatttaacagggtgttgttgtgcacaggttattctgatttcccattcttttctttacttaaatagggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcaggtaagaactgttggggatgaatggatgtggacctgtgtaccttgaaggatggagaatggcaagtcctgacttagcaggagtgggccgagatggaagacagactatccaggtgttagtctttgtcactaactatccagatgatgtgaaagaccagtatcctccccaggcatccatacactttgctttatctatgtgtcaactcattgactcttggagagcataaagggtcatgtcaggtttctccccagctcaaaggtagcaggaaacaaagtcctatctctcatgatttatctatttcttgatctagaccatgtggtttttcttctgggtcaaaaaataaaagtgtaaaagggatgtattagcattcattaaaaatatagcttagtataagaaatggggttggttttgactatctagcaatgtttctagacttggatgtctgaaaatgggcagatatatcctaaacttgttgctcttggaaggcatctctgggcccagtattgtgacatctcaggactcagggaaagatgagttcccaagctccccaggagtctcaattcctagccaagatactccaagcttttttttgggtggcttagatttaaaattcctgtgagatctggaatttaaagcttgccagtaactacagcaccgcacttccccaaaggggcctggcaacagcatacccttggattatggtatctttaccaggaaaaggataatagctgggggaaggatcttgcagacaataaaaagtggatcttctgtggcttgaacagatccaagcaagccaaagatagataaggtattgacaagagataatacattatgcatattaaaaataagagaggggtctgagaatttaattgtatcttgatactctgtaaatattttggcagcagggagtctaaattagctatcttggttatgaggcaatttgccttcttactatagtcaaaggaaaatttactcctgagtacatgagataagtgagtgggccaaagaaaaatgttgttttctgcctctgccatgatcggctcagccaagatgaacttcaatatgggttgcccataaatggaagatttggtctctttttggttgtttcatcttttgcatgaaggtagggaccacataatggcccatcaaaaaattctgctgcagacaactgcagaagacaaatggaacagcttagaaaagggctgatatgattcagaactttcacgagtaggaaaaatggacaccacacccatttcagttatcaagttcaagaaagtgggcagggggcaaatcaaaccatgatgcaaagatacttccctttcccccgtctttgtaatattctctctctctctctcttttgttttcctttatttttgttcccaaagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatatacttttttttttttacattaaagaactaaaaaaggaaaaaaaaaagcctagggcagatacaatctagtaaaagaaaatctttgatataccaaagtgttggataacaaaggctagaaaattcagataatttataaaggttaactatacttgtgcttataaatgtgcagattctacaatatttttccatgtcattctaaaagaatcttcagaaagaaaaacttgaagaatactaatgtcttgggaaacatgagattaagtttagggaaaacacttgatagatgtggagaatctgaggactcagaattcagcaactaatcacaggtggttttctaatttggcctctggacatgtctcactgtttgtatttctctctcctgtcaaagtgaatgatatattcttgaaaacccccaatttcttgaaatgggtgttctgttcattcatgggcaggggtcaggattgaagttcatatatgaaacaactggggatgtagataggaaagaatgtctgctgcaagagtgtatgaagggggattgtcatttacaaaaaaaaaagtacctcatggatggaaggattcatgaatagataatggacataggaaaggaggtcaatggaggacacataacagacatgctatccaccatttatttgtgattttgtaagagggttctcttctttgtcttgttcagatattttcatgtgtgtgttttagtgagaatctgagtttttaatcagtaaagtctgatgttttgataacttgatgttttgatggtagactcttgagttcatcttgtccaaatcttctagcattttcaaggatgaagcctctgtgggatctttgggcttggggctgaatttctcaggcataaatacctaatggccttgtctaagagggaatagatctgttctgagtgtccccaaaaaagttgtcctaggaactgatgtggagaagttacagggagactgatttccattccttattggggaaaacgaagcactcagaacatacaaggataaatgggctgccaccagaggtgaggagtctcttgtcactggagaggttaagatagaggctcaagaacaatgcaaggaaaatggaggttttcaaacacaaagtggatggtggtatgagacaatgtttaatgtccttctaactccgagagtccttgattctggagaggcacaggatgaacatctgttgctactgctgagtatacacactcttgcctctgagatggcgtgaccagcagaaaagaaagctcagggctgtggcttcagaattcatggaaacagagccactgtcaagaaggaatctgctcagagcagattctgagttttcacactccacaaatcctcagatttagtgggaagctggaaaaaggaactcttaattccaattgaggagaaacaagaaaacattacaaatcagtttcccaagctgagaaggattagccttgaccccttgggtctgcctctgttgccctcaccagtttaccttctacaacagtttctcaggaacatgtgtatttccccattcagctttcagcattgctccacgccacagcataagcatagatcccaagtccacaggctccattttgcaggtcatcttctgatcctagcaaatgtcctttccccatagttgtcctatgcctttgggctttagtctatcccaggactaactgtggagaaatcattggtttgagagtcaagagagcattggtttgggagctttaatcctctttctgcttcacactaagtgtgtcatcttggctaaatcacttggtctttctgcattttgttttcttatttataggatgaggaaattagattaaatggttttgaggtcctttcttgttctgatatgtccagtactcactggaaaattggatctataactgatgggtttagtaatctgctcatttcttgctctgaaaattgtagtcagcaaaagagatcatggaagaaatcactgtaatggtagtaatagtaacacatgccatttgt

SEQ ID NO: 16998 - DNA, 13568 bp, Human
ggcaggagaatcacttcaacctaggaggcagaggttgcagtgagccgagatcacaccattgcactccagcctggacaacacagcaagactccgtctcaaaaaaaaaaatattttaatgatgaaggaactatgttgtaattgcaactcaaggacgacccaccccaccaccatcagggaattcgaggggagactggcagttatccagggatcccagaaggagtcaactgggagttaagagtcctaacaaccctagaaaaaaactttcaaagacacaggtcttctcattaatctccataatcacagaggtcttgcctaaaagggccccccttgagtacacagctctgaaactggctaacatcttctgctgtctcatttgattttaaagttcacatttgtgaagggctctattgtacaacatggtgactatagttaataacagtgaatttcagttaataacctgaatttcactgagagtaggtctgaagtgttctcatcacaaaatgagtgtattagcatcgctcatagctcatttagccattacacaatgtatacacatttcaaaccatattgtataccataaatacatacaattcttattggttaattttaaaaataataaaagttctctatcagtcccataaattacaattttcaggcatctgcaaaggcagcatgttttggtttacatgtggtctttccaaattttatacgtataaaataaatgcataagtgtactacatatgcaaaaactaatacataaattttataaagtcaatgcacgcggggtcactgggatgaaccaatttcagtgcctgcagtctaatgtttaaaatcaaaatggtacaaggtcaccaccaaagaaattgtttaagccaatgtttctcaaactaaaacctttggacatactcccagaatcccctgtaaagaaatgtatactgtactcaaagttgagaaccactgacttagcataaagggaccgtatttcttttctctcccacccagcacaggcccagtgctcagcagaaattggggctccacagttctgcccaacactgggtcactgctgagaagtctgcaccaggccttcctgcacctttccactgagcaatggagtttgtttattcatttatttatttatatggaatttatttatttattttggagacagggtctcactctgtcacccaggctggagtgcagtagcgcaatccaggttcactgcagccctaaactccttgggctcaactgatcctcccacctcagatacccgagtagttgggactacaagcacgcaccaccacgcctggataattttttttaaatgttttgtagagatggggtctcccgatgttgcccaggctggtctcgaactcctgggctcaagagatcctcccgcctgcgcctcccacggtgtgagccacctttgatcttactgctatgatttttttattgataaaaactaataaatattctgagtctcaagaaagctttctgaaactatcaaagggacccaggcggcgcatcactacctgtgaggccgaccccactcacagcacagactgcaagtgaggcttacagatgggaagtgccctaagcgaggttaaacagctagttagcagcagacacggaactagaacctaagcctgctgtcccagcttcggtgcccgtgctcacagcggaagctgcctcggctcatccgtaagggcgctgattagggacgacaaagacctcaccccaccgtccccgtcccatttccgccctcccagatccccaacctccttcgagtcctctccaagtcgcctcgcctcgctccactccaggccttagcaagcattccacatgcctttaccccaaccctactgcctgtcccccaaaagatgcaggcggaaaagaccccaggaagcgagcccactcctccccactgctcagcaacaccgcctacgacgttctcagtagccgaatccctttccaggcgcatgcgcccccgaggtgggcgagcgccggtgatgtcacgcatagcgccatctccgagctccgagagtctgcgacagcagctgccagtgcgtcatcagagagcgccggaagcggtccgagaatgaagagtaagcggggccgcgaagttggagagggttggggacgttaagggtcggggtcttggtactggtgggtgaaatgggtccgggctacctgttgctgcggagtcctaacagaaccgctacaggaatgggcccaccctacctaagaaaaactgagggctggagcacgggttagcctggctcgacctctgagctagggagggatgtcagggctggaggcaggttctcccggaggctgctcagtggtgtgcgatgctagaggagggttccaggccttggctcaacttggccactatctcccggggtgaccgcggtcaagatcctgctcctttctgcgagctggtttcacactcttaacctgatgcaaagcgccgagagctgctggggaatgatatcactaacccaaagctttggtccttaggggtagaagacatgtgccaaggaggggcgtgtagacaccgttaagactgggccttcaatcagaatttttatttttcatctctgccactttctacctatatgatcaagtagattgtctcggcatgtctgagcttcagtttgctcatgcacataagtgtaatgagaaaaaatatgtgtaccttgtaatgaggtttctggcaagtaatggatgttcagtaattgttagatgtgtattgttgcagaaagacttccaagtctgttactaagcacctgtaacagatgaagcaaagttatcaggccccgcaagttgctctctacagtttataatccccatcttccatttgagggagaactagatgctatatataaaacttgcaaccacattggtttgcttgatcaaacaaacatacctggctgggtgtggtgggacacgcctgtggtcccagcactttgggaggctgaggcagggggatcacttgaggccaagagttgaagaccaacttgggcaacaacatagcgagaccctgtctctacaaaaactggaaaaaaaaaaaaaagaattagccaggtgtggtggcacacacctgtagtctcagctactcaggagactgaggtgggaggatcacttgaaaccaggaggtcgaagttgcagtgagctatgattgtgccactgcactccagccagggcaacagagcaaaacccagtatcaaaacaaacaaacaaacaacaaaaaaaaaaacttgtaaccaccttgcatcaaacattctcagggaagtacaagaaagctggaattaaatttacagagtatagtgtaaattacattttctagctatttagctcataaaccaggccttagtagtcccattcttattccattcacacctgtactctgtccccagtgccatggttttcttctttcaaaaaattaagaaacagaagtgtggaatttattttagaggttgaaactttattgaccaatgtatattttgagtttaaaggaaaaacttgtattttatcagttcaggacaccatcgattatgtgacacattataatttcatattaaaatgtgaagaatctttttaaacatcttacagttaacaaaacctatttctaaccatctacatcctagacagctatatcatataacttttaatgagttaccttgttagcaagtgctcaagcttctaacttggggtattttaaaccaatgcaactcaaaatgtgattcactgacctgcagtagtatctgggaatatgttaaacactcaggatctagggtaggagaccaataatctgcattttaataagatcccagagatttttacacacgttaaattttgagaagcattctttttaaaccatgtgcttggaacttctagcatagatgtggccagagggtgggataagaggcatccaagaaagctttgctcttaataccaacctcatcttctcctatctctgaataagcagttgttctgctataagtgtagttattttcttttcttttcttttcttttttttttttttttttttttgagacagagtctcactctgtcacccaggctggagtgcaatggcacgatcttggcgcattgcagcctctgcctcccaggttccagcgattctcctgcctcaatctcccatgtagctgggaatacaagtgcaagccaccatccccggctaatttttgtatttttagtagagacggggtttcaccatgttggccaggccggtcttgaactcctgaccttgggtcaggatccgcccgccttggcctcccaaagtgctaggactacaggtgtgagccactgcgcctagtggcgtagttattttcatagttagaaaagtcttgggtcttacagccatacccaacaagaattgatcatttcttttttttaatcccccaggtgtgatctaccatgcattgtctcagaaagaggcgaatgactccgatgtccaggtcagttcttggcagggagtccaggagcaacagaggtgatggcaaagatggctcagtagcttctgagcccccagcactgattgagatgtcctttcccacatcatactcctcatttttctggcagacatctaaggctggatcaaagtctgtagttctcattacctgttcccacgtgccagcctccttttctgttgtgccaaagtcaagtttggtaaaatgaggctttccttaaccttttatcatttcccactgtgttggggacaccaggctgtgcccacgtggtgggcagcatcattcaaccttgtcactgtgccctctgcacttctgcagaaggtgtgcaatcacatatcataagtgaaatttacagattatatctgaatgcctcggcctgctttgtcagttttgcaaaagttcctcttgtggctcataatgagagcattaccttgaaagcaagattttgaaagaccagtatacctttattttgcttctccatgaaagatgagccactcaggtatttaagagaatcagatcattgtcctattatagtcacaatgacgagagtgaattaatttttagttagcatctacaggtgcaaagctgaagcagagttcccaccatcatactgtgagctccctcgaaggctatatgtaccctatcttcccatccccattgctctcccacagaaggaaggctgcgttactaatgacagatcagcatcagtctgtcagcctcagtcttagcatttagcacctggctagtgcaaaaagagctcaggaaacagcccagccaggagacaggccctcaggagagagaactgcccaggtctgtggcaggcatgagggcagtggcattgccaccaaatgaggaatccgttattggaactccaacctgagaggtagtgagcttggagggtttctttgtttgtttgtttgtttgtttgtttgtttgagaattgcacacaattacgacagtcatttttcccagaagtcctctctaagagcctgtgctcattcatggtaagttgacgccctgctctcagtgacacccttcagagagagcgagcctggggcctcagatgctctcgacggtaccttcctccaagtgatggtctgcggggcgggagcggaccttttggagagtggccacaccatgcccacagagctggaaacccggttaaggagtattgtcctaagggcacagtgtcagggtccctgcgccctgaggcttggccgaccctggagccctagttttgctgttttctgtagtgttaggatcacttcctccatagcttagtgctactctgagctcactttcatctggtcatgcctggttgaatatatttgttatacatttctcaagctttctcttctgccaaggatgagagaattcttcttcaagatagaaaggttttggtcctttcagaataacctcagaaaagcagggccagagcaggaagtgagcgtttgacacgctgttgtgtgtgacaaacggtcatgaattggtgtgtgagtgtgacttacatctcggcagctgtgggtagcagatgcatggcggatgagcaggttgagagcctcagtaggtaaagggatgggccccatttgctcttgcagtagctgccgggaatggcgggcgggatgcctgggatcctgggctgcccagaccggagcagtgagcgccgcacccccttgtccgcctgcagccttcaggagcacagcgggccgaggccttcgtgagggccttcctgaagcgcagcacgccccgcatgagcccgcaggcccgcgaggaccagctgcagcgcaaggcggtggtcctggagtacttcacccgccacaagcgcaaggagaagaagaagaaagccaaaggcctctctgccaggcaaaggagggagctgcggctctttgacattaaaccagagcagcagaggtaacccgagctccccacgtctttctgcccgcggtgcttacccttcttggtgtgtgaacttggctgagtggctggggaggcagcctggctccacctaagctaagggggcctctctgtcgtctgccacaagagggcagccttcctttaccaatctgggctgtgttcagcgaggcgggtgagacaggactcattgtctggcctctctcctcaccttcaggagtaagacccgtgcaagtacatctgttgcccatggcaacaggctgtttgtccttcggctttgttagacagaaaagaggaactgatatgtttttagtgtgtattactttgtagcttttgatagagccagacagtcacccactcgggtttcattgccaaagcaagatgttgcccacacgtttcagaagtttccaaaaggaatgcatcactgtcctgtcctgtgggaggatgtcttcctccagccgacccgccatccctccttggtgacgggtctgagtgtgggtgtcttggggctgtctgtaggcttttgcttggagatcaacggccaaatagcctcccacgctccagaagacgcttaaagtatgccatgctgttcccggccccactcaggagatcagctgggcctcaggtggagaaggggctgctgcctcccagggtttgcctcccgggtggagcccaggttgggtttgagcttaaggtcctcatttctctaacctaaggctttgtggtaacggattccccacaggatatcaagactggagataatggcccagaagaacgctgttggggtccttgcccctgctccccgcttcttctccccaccacttgcttgcccaccttccagaccagcctgctgcctcacatgaggacctgcgtgacaaccagcaacccctgctttactgggggcttactaggttcaatttcacgtaacagaaaacctcaaaataacagtagcttcaacaagactcacgtttatttctctctcatgaaaagaagtccaggtggacaccgccctgggctggtgtggtcctaccaatgaggaaactgaggttagagaggtgtaggttcttggtctcggttatcagctcaattgctcatcgtcggatttgcacatagttcctaatgatcccaggttgcagttgttggcatcaagtcaagctctgtgctatttggacattgtcatcccaagctcatgttgtctaactttttccctgtttctgactttgctgcagatacagccttttcctccctctccatgaactctggaaacagtacatcagggacctgtgcagtgggctcaagccagacacgtaagttgcattcctgaagctttgctctttggggtggatctcaagcctctgatcattgtaaatgcggcttcaggaaccagcgttggtattgcctggctgcagacggttaaagacctagttgcttcttttggaactttttatcatgatgtaaaccaagggcttctgtttaccctgcaggcagccacagatgattcaggccaagctcttaaaggcagatcttcacggggctattatttcaggtaatttacctaagagcgtgtagcacatggccatccagaggttcactctgtcactctgtggagacccggggcgtgtgttctgttggacacactctttaccgtgtggattccctgagatggcccccagtcaccatcatccccacgctaagggtgggagatgcttctcgctggctgtcttagccagtccggccatttgctggacacaccctaagtggtctctgtgtaccttctccacacagggacccctgttggtaccctaaagggcacagtggctgcgagcactcacccacggcctgggatcttgaacacagaatccctttcatccaatgctgtggtttcaaatgtcagctacacctgacagcccccaaggtgacatctccagcgtaggcctgtcccctgaactccaggctcaggcatccagctgcccacttgacatagccacctggatgttcagggggcatctcagactttacatagccaaagctgccaccgattctcctcacagcaacccctcctggtcttttccatctcagttaattactcagttatttacactggttgttcaggccaaaaacctaaacagtgtctatgtttcttctttcctaatctcctcgaatccttcggaacatcctactacttaaattcagccactgtcattccccagattacctcagacacagctcctcaccgcaccaggcagccagagtgccggttacgtagaaatcagagcacgttccttccctgcttcaagtcttctggcagcgtcccatcgtatgggagtaaacctgcctccttgctgtggtctaaggcctccccgctccctggggcagcaggcctcccacactgccttcctcctgccctgcctcagggcttcgcctctgctccttacctctacccgggagttctcctgtgtgtgcacagtccagcttctcattgttcagccctgctccaatgccactcccctcagggtctaccattgcaaaccatgaccctccacacattgccctgtccctactcttcatagcactcgttgctgtcagaaagtagaatggtgtggttcaccgtgcatcaccctgccttgctagaacccgggctccgtgagagtaggatccgggaccgcctctttccgtgctgtgtccctggcatctcctgaggatggtgcaggcattccacagctgcttggtgactctgtccgctacactgaggctcgggtcaggacgagggaggggctgctgcttgtgatggtggctcatctcgcagtgctggctgctgggcagctctgcagccacactcacgttccagccagcatcctgggcagtgcatggtggtgtttgtgcagatcctgcaagggagacctggctgcatcagagcagccagcccgtgggccctgatggtgctgggcacatatgtgacctttaattccagaatcctgcccaagacccctgtggccacagaccctccgaaggacacctcataggaacagtccagaggctgcaaagccccaggggaagcctggattcttgttggttacatcagggcccagctgttgagcccccaccccctgggtgctctgttctttcatctgctagctcagagggtgggatcagcacccccaacccctgaggcctgcttctctgtggttcccccagcaccacagaggcctgagcctggaactgtcctttttctttgcagtgacaaaatccaaatgcccctcttatgtgggtattacaggaatccttctacaggaaacaaagcacattttcaaaattatcaccaaagaagaccgcctgaaaggtatgtaggtgtttctgagggcattgcttgcgggctgtggctcccagctactgcgttagccttttcctcaaggctccaagagtttgatttgacccctcaagtcagcgcagattgcagatacttgctgaacctgcattaaagcctgcagagaccatcccctgcacccgtggctcccccaagaggtgtgtgtcagtgcagcctgcaaccccggccagaaatggccaaggggaaggaagacctgctcggctgtgcctcaggggacctgggtctgtttaggccccaggagagggcctccacctgccccaaaggctgctgctcccagaggaatgtagccaaacaggcagcagggtagaaacaggagtggcgcctgtccctggagttctgagctgtgtccttggcgataacacttgggttccatccgtggccagcattgctctagcagatactttgggtcagccaggatttctacaccccgccttacccacaaatccagagatatcaaaccatagttagaaggttttgttcctttaatttttttttttttttttttggagacagtctcactcttccacccaggctggagtgcagtggcacaatctcgactcactgcagcctccactcccggattcaagggattcttctgcctcagcctcccaagtagctgggattacaggcacgcgccaccacgcccggctaatttttgtatttttagtagaggcagggtttcaccatgttggacaggctggtctcaaactcctgaactcaagtaattcacctgcctcagcctcctaaagtgctgggattataggtgtgagccaccgcgcccagccttcttcctttaatttttgagcttggtttttcttgttgcttcccttattttcctacatatccttctacctcacattgtaaacctcggaaagtggtgtaatagtttctccacagagcataaggccaggagcccatctgaaagttaatgtgggaaaaccagtttctggcaggtgttctgggactttctggttctgggaatttggtgtatagcctttgaccctgaagattaggtgccaagctacatttagcatgtgactagattgacctgtggcagaataaccacaggcaaccctaatgcccctccccttgtgggtttcccgtttcctattagcttatttttttcattcaatgtgttctgaataatattctacctaaaagtaaaatattaataaatatttttcctcatctttttttctcctgcctttttttttttttttttcagttatccccaagctaaactgcgtgttcactgtggaaaccgatggctttatttcctacatttacgggagcaaattccagcttcggtcaagtgaacggtctgcgaagaagttcaaagcgaagggaacgattgacctgtgaattctttgccgtctaaggcagttgtttatgacagctgaaaactggacactccctaaatgtccacctttcagtgaagagatagttaagccaattccatttatagaccacctccagccagtgacgctccgagttgaggatgttgaacaacatgggaaggtcgcagcgtactaagtgaagaagtcagaggacagaggaatttctctttctaggagattttcattttgtgtgactcccatggggaggaacagactggcaggaagcacaccggggttaacactggttgacttgaataggattattcgatttttaaaaatacttttccatgttttctgagtgctctatgataaatcagttgcatctgtgataatacaatacatatgtggacataaacagggatcaaataaaggaggtattgctgcagtccagccaggttgaaagggaaggggggtccccaaaggtccattggatggcaggtgtctacagaggctcgcctttgggtggaactctgacccacctaaggtttactttgctatttcaggaaggttgaagaggattgaagggtgagttgctaagtgacttagggtttattcacttcaggaatcacagctggggtggaccccaggagcagagtactgcatgcagctgtgcccatgcatggttgccccagcgtagtgagatgggacctgccgcagcatgcccactcctgagctgccaggctgagccatggaggactgaaaggaggtcgcccggcatcacctcccgaggtgagacctgctgcaaaagccaagccagcagcattgacgccctttgatatcttcgccatttttgctgctgaaagacttggcttttcagtctgaccctggccctctgtgaccatgtgtctgtaaagccagtgggtcaggcccttccatgcagggccagaggaaaagcgggcccagggctgcagtgagagcggggcaggggaccagcctaccagatgggttggaaacatggctcagaaggaccaactaccccttccctttgaggagcaagtctctgccgatcagcaaggcaaggccaggagccctcctggcgaaaggcaggccacaaatctgttctcccccaggagaagtagcagtgccagggctttgcgtttctggtaacttccacccaaaccacaccagagagaaacaccgtagtggagaagggaagtgggagcgctgactgctgtgtgccaggagagtagaaaggcccaggtctgtgccaccacccctccccaaagctcagtgcacccagagtctcacagggaccaacacggtgcctcggtcctgcttccatccatgcaagtgtcctccgctcaccagggtgttctgaggcagctcaagtgctctcccccaagcagcacgcagtcaccgctgccagtgatgaacacacgcacgggctaggcacatggagcccaagcacactgccacctcggacacgggccccggcccagcgactgccttgtggtgtggccgtcctcatctgccacaggaagacagacttcgagggacctcttgcctaaggcctcgctgactcaagggtagaattgagatttggacctaataggctccagaactgtgctttgagctacagggtggctgcaggatgagacggatgcagttcaaagtgcaggatgtgctgcctttattacctgctttcccgctgagcaaatccctgtcttgagtgggaagtggcatctattcccccagccatctgaaaatgctgtgttcataaccaaataggtgctgtagcttcctagccatcccgctcttacccgcccctctgcaatgtaaaaggcgtccactgttgtgtaaatacacagttgctttccagaaaagttgtaggtaccacttgccatgtgaaatctgtttttcatttagctcagactcaagtttctgtgtgagtggcggtttaatttgtagatacctctccctctcccccaaggagacatggtgagggtgctcaccggccactaagctgccgctgtgcctgcctgtttctaggatacactgttgccctcatggcccacccaggggtcatatctcccaggtagaggagggaaaggggagggcccagctgggcgggacatggttcctgatgaggaacagctgcagaaagcatgatctgaggcccaggggccgtggcaggggccagggctgccatgtctccacaggctgtggcacagcttgtcatggagggtaatgtggtgctttttggcccgatctctcccatgtccactgtccaaggagcaggaccctggcagagctgaggccttggccatgtggtcccacgggagacagagccacattcgacttgtgtaagcctccatgcaccagagaaagtgccaaagaggagagagtggttagcaactcaggacaggacccagaggctgcaggact

SEQ ID NO: 16999 - DNA, 19012 bp, Human
  misc_feature (1)...(19012): n = A,T,C or G
atgtatttaacagtgcttttctaactagtgcatatcaaaatcacctggaggtcttgttaaacctgatccctggcctaactcccagagattctgatttgtgggagggacttatgactttgcctctcaaacaagcccccaaggcatgctgaagctgctggtccttatactgcattccaactagtagtggtttaacaaacaccagatcatgtgatgttatttggaaatgtgataaacaaggaaacaacaaaacaccagatcggtgcttactggtgccacaaactattctaagtaccatataaatatcaactcctagtcctcacggccatcctatagtgtagagactcttaccatgctcattttacagatgaggaaacttgaagtacagagcagctaagcaacttgccctaggtcacttggctagtcagtagctgaggcaggacccatgcatagctggaacctgctgtgttcccactagaacccagagcgcatctctgtgactttggaggataggcatctgctgctccgcccaagcctggcatgacccctggaaaccactccctgagatgctgcgattgctcagctcctcagatgtcccaggcagtgatgtgacaggaaaggaacagcaggtgcagagtctcaagagggtctgccaggtataccagctgcttaaactaggaactgcaaactcagatgcctatggtggccagactctgagagattctagctagataccggaaaatatttttcgtaaagccaatcatctcagtctgttattccccccacccccgccctttatttttttaaagagatgggagtctcattaggttgtccagactggcctcaaacacctgacctcaagtgatgtgccttcctcagcctcttgagtaactgggattacaggcatgaaccaccatacccggctatttccccccgtgtgatagatgcatgaagcaagaaatcatttacttttaccttatctccactgtaagaagaagactatatgtcttatatatagaagaatatatgtcttatatagttaatacttggtttcctttttgaggagtagtaggagtgtagaggctaaagtagactggcctgtccataagaaatacccattactcaattccagccaatttttaccacaacaacaattgagctagaagttcaaatctagatttttatgtgttatctcttgatttttaagtattggtaactaattataaaaatgcatttgtaggctgggcgtggtggcttacgcctgtaattccagcactttgggaggctgaggcgggcagatcacctgaggtcagaagttggagaccagcttggccaacatggcaaaaccccatatctactaaaaatacaaatattagttgggggtggtggcgtgtgcctgtaattccagctactcgggaggctgaggcaggagaatcacttgaacctgggaggcggaggttgcagtgagccgagattgtgcccttgcactccagcctaggtgacagagtgagactctgtctcaaaaaaaaaaaaaatgcatttgtatacatacaaacatgcacagacacatgcacacatgcgtgcacacacacacacacacacacacacacacactctttctctctctcgctgtcgctctccaactctgttgggctcagaaacagccagtcagtatctggcctcgttagttgggccgtcagtccactagtcccgtagtcccaagcattacacaggcagctgctgcgcaagggtaggcccactcttctctagaactttttgtttaaaaagcaaaaaacaaaacaaaaaagcatgagggatacaagaggctttgctgatttttctgtgggttcataagtaagcttgccctttctgtgagtgtgcccatgtgacaggcaccaggaggcacttgggtggggtcaggggagcaaacagtagggtcactgcctctgggcagaagtttacgactggggactcacctcagctcactctgtccctcccccaggatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggtcagtgtccccgccctgcctccatcctcacacccatgcgctgtacctgggctctctgctcggctgggcaggcccactcccctagatggcagcagatacaggcagaagtggtgatcctaggggtaagacgccatgtagggaagcagggaggcactgccaagttcagtctgaggctggaagcggggtcacctatcagagcaggacctagactcatgcctgtacttactcgcttgatagtgacagttcacctatgtgtgacccagtccttgcttctgaggactagatggggagatgggacacacatgctaaagtttggctttaaagtaatctaccagatttttcagatgatttgggaaaatcaacctgattacacaagcaagaattaggtcactgttaaagatgatacggttcttgacccttaaaaaaacaagagaattgagctgcatgattcataaggattcttgcagctcctaaaaattctgatttcacatatgagatgtaaaaaggtgatatataattaaaatccaaataagtgaaaatgaggagagttatgggctctaagaaagaatccagcctggaggaaggaggtggggggtgggggcactggtgatcaaggaaggcttcctggagaagtagagcctcaagctaggccttaaaggatggggaggactttgatgagaagaggagtgaggcaggcagtggggagtgtgagtaacttttgccagcccctacctgctcccctatgcagcccagctggtgtagtgggtatgttcaagggagtgataactaatagctgacttttggcccctgattgtaatggcaaatctcattcacatgcattaactcccttgatcccagcaacaatcctgtgacagaggaggtattaatatttccattttcaaaagagggaagtcaggttcagagcatttcagggacttgtgtgggatcaagcatcgtgtgagtcactgagcctggactgaaacccaggtcttttgttttgaaatcttctgttcttttcctaaacaaagcttgggcaggtggaggccaaagggacctagtgagtggagaagtaggacttggatagggctgggatccctcagggtacacatctttggggtgcccagccctccctgcagcctgtccccttctcttgggggttatggtgacaattcagtatgtcttgcaggactgtagctctccagagggtaatgggtccccagaacccaagagaccaggagtgtcggaggctgcctctggaagccaggagaagctggacttcaaccgaaatttgaaagaaggtaggatgtctgccctagttagaagcagaggcctgaggcagggaggtgttaagacggttattcctcacccctttgctgtcttccagtggtgccagccatagagaagctgttgtccagtgactggaaggagaggtttctaggaaggaactctatggaagccaaagatgtcaaaggtgaaggcctgttgggggtgggggagatgtttgaaccccatctctcttctcctggtctggccacgcagcctggctctgtagggcagttcttggtacatacctatcctgtgccatctggctcctgcctggccttaggggtcatcaccatccctcgcctggaggccccaagcattaggtctcactcatcccatgcaggagaggcctggtaggaatcaaatcccatgactctgaatctgggctctcaccaggcacccttgtgacttcaggcatgtcattgccacttcccgagtctaaccgcaaaatgagcagaaagttccctttcactctaattaattctaggtcagttggacctcactaagtgagtgaaaagtagttactaatgggctgctgcttgggttccttagagtgatttttttttttttttaagatacagtctccctgtgtcgcccaggctggagtgcagtggcacaatcttggctcactgcagcctcaacctcctgcatgatcctcctatctcagcctcctgagtagctgggaacacaggcacctgccaccaagccaggctaatttttatattttttttgtagagatgacgtcttactatgttgcccaggctggtctcgaacccctgggcctaaacagtcctcccaccttggcatctcaaattgctaggattgcaggcatgagccacccactgcacccagccagaatgatcatttttgcattgtcattgatcacacccacagagggaactttaaaaccgtacagatgcccaggctccacccccacctattgaatgggaaccccagggtatggtaggggcctgggcctctatacttctcaaaggatccatgagtgattccgatgttgtttttttttttttttttaaaaaaaaaaaaaaaaaaaaaggtctatggccaggcactcaggaataaactgctgcatcagacaggagctaaactggaggtcagggggacactaacatttattggttgaggaccatgtgccagatcctggactaagagctttgcatatattagcgcttcttcttctttttttttttttttttttttttttggagagagacagctcgctctgttgcccaggctggagcgtagtggtgtgatttcggctcactgcaaagttcacctcctgggttcaagcgattctcctgtctcagtctcccaagtagttgggattacaggtatgcgccaccatacccggctaatttttgcatttttgtagagatggggttttaccatgttgttcaggctggtctcgaactcctgacctcaagtgatccacctgtctcggcctcccaaagtgctgggattacaggcgtgagccaccacacctggcctctattagctcatttatccctcatagtaaccctctgaggtgattattattatgcccacttaccaagattttgaaaaccctaaagtgcagagaaattggtaacttgcctaacagctcacagacaggatgggttgaaatgggaatttgaccccagacctgtcttgcttcaaagcctgagtgtgtcccactggatccctccgatgggatggttgtccaccctgaccctgtgtggcgctgagcactcgaggacattgaagaggcctggggctctggggctgacatgtcccactgtcagcattttcagggggcctggaattcatggctaataggggagaacttctaggctagtagttgccaggtagcaacatgaagagcccccttcaaggcaagcatcttgtgtcatcatctctgtggctcagcccctaatggtcctgggacatagcaattgctcaataagtttctgatggatgggtggatagatggatggatgtatagatgaacaagtaaaaagtctcaatggggtctgtttcactgtggagcagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcaggtaggtcctgttcggtgggtgtagctttctttccaggaaaaggagtgtgtcaggacctagagaaggctgccttagggacaggcctcaccagtgcaagctggggcctgggggcaggctgggcagggtctgtggccaggggctgtaggattcccacctggactgattcatgagcccttgtacagggttaggggtgggagggtatgaaagggactctgcaggaagagcagcttgcagcttcctgcccagcctcctggtcctggagggagggatgagcttcctgcaaaaggagaaccaattctgagggctgactgctttgctccctactgccaccccactccatggcttgccccactgtagaaagcagggtgtggttagggctgggcagactgggcaccagggctaatgtccgtgaccccctctgcctactctttccctctcccagattgcaaagcagcagcagcagctgattcagcagcagcataagatcaacctccttcagcagcagatccaggtaaccggaggggagacccggagaggcacaggaggcagttgagggagttgacaccggcctggagggtgctggggacaggggatgtgcaccaagttaaagagccagagcagaatcactcaggcctgacctgaggagggttatttctattctagcccccaacctgtcttccttccctgattaaagggaggagcccggcatgtcttcctccccagctgagacctgagggcaggtagacaggggcccacagagttggcctagggtcaaagggatcctttggaaaactgtccctgctttatcccctgtgcctcttgtccatgggtccattctctgtgccatgggctgaccatagctgggtagctctttgggtccctggggactcacacagggtttctttgccttcagcaggttaacatgccttatgtcatgatcccagccttccccccaagccaccaacctctgcctgtcacccctgactcccagctggccttacccattcagcccattccctgcaaaccaggtgagtgtgagaagggaggttccaccactgcggccagcctgtcctgaggtcagggaaagcgccctggagccactctcatccattaatttgctatgtggactttctgggcctcagttttggatctgtctggtagaagaatcatcctctttttctgaatcttgctgaatttctctgaacttcactgggagaatgaaaaaccataaagccctttccagatgtaaaatgatgtagcaatccaggtctagtctctccaactctagtacatttactgtgtcagagtattaatatctggaatattgccaggtgtggtggctcacgcatgtaatcccagcactttgggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgcctcattccccacagctcaccctcacacaccccaccactccatctctacttgcccaaatcctgcccatcctgcaggcactagcgcacacctcgggtcccacagggagcctgctctagttaccccagctggagcagagtttgctggtgctctgtctgtgtggccctcatcaccacctgccatgcacttcatgatttctacatgtggcctatctctccacctggatgctgggcctgggagtgaggtagggtaggcaggagtgccatgtcgagaagaaggaaaggctgtggagtctagaggccctgggttcaaatcctgatgctgccatttcatagctctgtggacaacccatttttcttcttatttttatttttttagttttgaaaattttaaattctttttttttttttttgaaacagagtctcgctctgtcccccaggttggagtgcagtggtgcaatctcgactcactgcaacctccgcctcctgggttcaagcgattctcctgcctcagcctcctgaatatctgggattacaggcgcgtgccaccgcacccggctaatttttgtatttttagtggagatggggtttcaccatgttggtcatgctggtcagggtggtctcgaactcctgaccttgtgatccacccaccttgtcctcccaaagtgctgggattacaggcgtaagccaccacgcctggcttcaattcttaataatagagatgggggtcttgctatgttgaccagattggtcttgaactcttggcctcaagcagtctttctgcctcagcctcccaaagtgctaggcatgagccaccacacccagccccatttgacttctaaggttttcatttctttttctgtaaaatgggatgatgatgtattcagcccctgttatatatcacataccatgtattattgtcagatgatacatatgagacgttctacacaacaggcagccgcttttgtgccctgtgcccagtaggtacaaaataaaagtagctgttggatgaataggtgttttaccctctctcattgtgccattggatgggactctagaatctgggaaactctatttagagtgggttgggaagggcgggaacccagtgaagatgccagtcagtgtgcaggggcagtgtggagtgaggggataggagcctccaagcagtgctttggggctggggagggcagtggttggaaccaagctggtccagtgccgagccattgcccatcttgtggtgctgggacctcgtcaagcagggtgtctgctgttctgtgctcatccaggacttttctccttgctgccttttccatagtggagtatccgctgcagctgctgcacagcccccctgccccagtggtgaagaggcctggggccatggccacccaccaccccctgcaggtaccgccctctacccactggcctggggctccctctcgagcttatgacggccggctgccgtgttagggaactgcggggtgtggactggtgagccctggcatcctgtgttcttgttcacccgctccttctgcgtccacttttctgtctgtctccttgtgtgttctgggtatgctcacctcacttcctctctgtcctgctgtgggagtgtcctttggtgtctgtcatcctctgacctgctgggtctccctcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggtaagcctcctgctgcctgcacttgtccctcagccctcttaggggagagccggcggcatgatgcgaccttgagcaggtcccttctcctccctgggttccagattttatcaaatgaggggttagacttgctcttagcagaagatccccttcttcctctccctcatcatatctgtctgggcattccaagcatcagggattcaggccagagtcacatagttccagggggtactgttgtcatttctagtctattgacatgcacaataactagccagtgtaagtggcatatccctgaggacatgcaatgcagccgccctgtggaagaacaggagggaacactaactcaggtgcctcatgggagggcatggcgggaagctgatggagtttgggctcatgctgggctgatgccctcagcttctctcgcttctcttccctctcttctgccctctcccacaggcttccttggtgaaggggacgctgtcaccaaagccatccaggatgctcggcagctgctgcacagccacagtggggccttggatggctcccccaacacccccttccgtaaggtatggtcccccactcccttgagcctaggggcagcaacagatggtggccaggagtggaagacacagtctgaggccaccaagagaggagcatggggaggagtggggtgatgcagaggaggctgatgtcaggttgcccctgtcaacctaggacctcatcagcctggactcatccccagccaaggagcggctggaggacggctgtgtgcacccactggaggaagccatgctgagctgcgacatggatggtgagggctcaggcgcagggctgatgcgcaggagggcccaactctgtattccaccagggccagggctgtgtctgcctctgatctcttccctcccttggtctgttgggtcctttccaggtgtgtgtgcctctgctgtcccattatgtgtctgtcggctctgtctctgagtctgctttcctaagttttgtgactgctgagtttctgctctctcttgaggccataccgctgtgattttcttgtgtgtctgtctctggttccctggctgggcctctgcggataatttgctgtttcttctgccccatctgctcctgccttgctcctcctcggctggctgctgtgggagcctcctcagtgcctcctgctggtcaagtaggggacgtctctctgctggccctggggcactctcctgaccccagacaggctgcttggctgacttcactcctgtctcccaggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggtaagggccagtggctggggccatggttcagtgtgacctggttgcaggagccagctgggtctattcagggcttgcttggtgatattccatactgtgttggactccagtggaatctgacgacaggggtgcaggagttgctggggatgtgagggcagctgggtcctggggtcttatatcactgaagtgttcggtagcacctgtcctcaagaactcaaggagtgtgcgtgtgtgtgtgtttacattctttagtactcctgatctaaacctaacctgttccactgtttgtccagacccttgctctggcagaaaacaggagagactagtgttcctgggctgtcactagaaagatttttttaaattatatgtcctgattggtggccacggagggatgttgggcagggcagatggagctcgaggggccagttgttttcaagactgaggctcctccagtgtcagcgcaggactctgtcaactgagacatcaggtattttgtcctgagcagggagcctgtctgggttgttgaaggtctgaggtggctgctcttttgtttatgcaaatcaggcaggccagaggctcaaggaagttgctggattgttaggaacatgggtgggtactgagtcttaagctggcagttggatatccctatacaggccaacttcattcatttgcccaatatccaaggagcacccgtatcgggccaggcccttgctaagtgcttgcacatatattatcttatggacccacctggggatcaaggtcttctcaggtcctgcatggggctgggggtggtcagcagagcccagcactgactgcctgcccctggggggttgggtcaggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatcccgtgagcaggcccccccgcaggcagccaggagactgtgtgtacatgtgtagctctcatgagtggctgggtgtcagtgtgtggcctgcctttgtgtgtgaccccaggggtgctgtgtgtatgcgtacgtgtgtgtgttatctgtgtatagctgagcctgcacgtgcgacccgactgtgtatggctatgtatgtgactgtggtgagcactcagtggctgaggatgtaggaatgtgactggaggactggccacgtggacctggagaaagtgcctgtagatcccacggccgataaactcaatagaaattcagaggtgctagaaatcaaagtattcatcacacagaaaggttcctgacttgactaaagcaagcaccctagtctattcctttaaacaggacatctcccagggcatttaaaatatacaatttctgcctggtatagtgacacacgcctgtaatgccaacactttgggaggctgaggcaggaggatcccttgagctcaggagtttgagaccagcctgggcaacatagtgaaacctcatctttaaataaaattagccaggtgtggtggttcacacctgtagtcccagctactcaggaggctgaggcaggctcaggaggatcacttgagcctgggaggctgacgctgcagtcagctgtgattgtaccactgttctccagcatgggtgacagagcatgaccctgtctctaaatataagtaaacaaaacataaaatatacaagttctaaaaactggattcacacatgatcctccaagaatattatctgttgaacacatctatggccctaggtctgcaggtcatctgcagggtcgtaggtgccagtgaatttggccatcagaaagcaggctgggggcagggtatataagtcacagccaagagtgtgtggagtgggagtgcacgctctgaggaggcctggaggggagatgggtttggggttgaatcaagtgtgcatccatcaccgttccccttctctgccccacagcccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtacgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcagaatctggcccttgtgcaggggaggagggaggctggcctaagtccagaattcccaaatatgccaccagcctgggcaccactgtcccctggtggcagcctgcaggagcttcaggcctggggcctcagaggaattggcttaatgcaagggaatcccaggccaagcttgtgagtgacacatttcctccacagagcccacgctgaatgcccctaccttgacgaggtgaggccacccggatcctaagaaagaaggcagtagtaagagcactgtaataggagtcatgaagctcggggtctctctagaactggccacatggctggggttggggagtgggagccaggtctctcctttggggcctcattgtcctcatctgacaacaagattaaaccttatacctggttcttaccattcagagaagtagccctttgagactctaatgaaagctgtggatccttttcttagaaaagggcccacaaaggtttaccctgaagcccatctgaggcccctacgatgctaattaatgaagcagggtctctaatgataatgcttcagggctctctatccatgacacatgctttgagtgaacacttcagacctagttatcccattaggagaagtaataggcctgcaagggctggatgacagactgaaacacctcaaaaatgcatattaaccaggctctagagagacacatcttgtagtgaaaaattaatcccatcagtatagagtggggacagcaaaaccgaatggcagtagttcttgtggaagagttggacttgggctgcattaatagaggcttgtgttcacaacaggggaggtgatggtccagtgtaccccacacagacctagtcccaggggtagcgtgcccttcctcgccccttcactagggaagtctcacaatggaggggccctgaagcaggcaccccacatggaggagcacaggagggatcctggtgcacattgtccttagaggaatagtcagaagggtcaggtgtgtttcctctagaaaagaagacagagttggacagaaaggacaagattgctttctccaaaactgccaggtgggcaaagtgtagtattgcacaaagttcatgaggcagaacttgagctcctggatgaggttcaagactgtcttgacataaagaacaccttttccacaaaaaagagtgaacttcccaactcaagtcctcaagctcttgagtactggtggagggatttctagattggagagggtagtggtgagagagggtaggtgtggtggttgattctagggccacaaagttgggagggtgtggaatggagactgcccaagaattaagggcccagccatttggtatggggagcgtcctgaacgctggctggctgttttttccccagcccgggttctcagagcctcctctccttcgccctccccacgccacgtctggaaaagatgcaggcagaggtgggaggaggagctggcgacgcgctgacccctcggtggtcacgatggagagctgcccattgcacctcccactcccctcagccctctgccctccggcccttcgctctccgccctcctctctcggcccgcccctgcgcgtcccggcctcctccactccactggtgggtccaaaccatgtcctgccagtctcaagactctcccagcctggctcattcccacctgtcggtcctgagttcctcttccctcccgcaagtcctcttgtcttgcctgccttattccctctgctgagacacagttgcgggtcctggagccccacccctgtctcatgagaggcaggatggggccaggtggttggagaggccaggagcagagtgctgtggtcattaccaggaaagctgggctacaagttcgtcccctccgtgcgtctccggcagagaccgaggggcagagcccgttgggaaggtgaatgtgcccaggagtcctttaactagagctctttgctaagagtcctggaaggggcccgagggggtggaacccggatcacactgggaggctcccaggc

SEQ ID NO: 17000 - DNA, 57638 bp, Human
  misc_feature (1)...(57638): n = A,T,C or G
ccttccatttatttatttttatttaagttgtggggtacatatgcaggtttgttacagaggtaaacttgtgtaatgggggtttgttgtacagaatatttcatcacctaggtattaagtctaggacccattagttatttttcctgatcctctccctcctcccactgtctacactctgataggccccagtgtgtattgtgcccctctatgtcttcatgtgttctcatcatttagctcccacttataagtgagaacatgtggtacttggttttctgtttctgcattagtttgctaaggataatggtctccagctccatccatgttcctgcgaagggcatgagatcattctttttcatggctgcatagtattccatggagtatatgtaccacattttctttatcaagtctaccattgatggacatttaggttgactccatgtcttcgctattgtgaatagtgtggcaatgaacatacatatgtgtatgtctttataacagaacaacttatattcctttgggtatatacccagtaatgtgattgctgggtcaaatggtatttctgcctctaggtctttgaggaatcgccacgctgtcttccacaatagttgaattcatttaaactcccaccagcactgtaaaatgttcctttttctccacaacctcaccagcacctgttattttttgactttttaataatagccattctgactggtatgagatagtatctcactgcggttttgatttgcatttttctgatgattggtggtgttgagctttttcattatgattgttggctgcaagtatgtcttctttcgaaaagcgttggccgggcgtggtggctcacacctgtaatcccggcactttgggaggccaaggaggacggatcacctgaggttgggagtttgagaccagcctgacctacatggagaaaccctgtctctactaaaaatacaaaaaattagccaggccagtctgtggcccaggggttggggacccctgttttaaggtattgcagaattgtcccctccacacacagcgaagtgtaaatccgtttaatctctgaactatctaaagatgaatatgctgctgctctcctgcaataaagggcaatgacttaaaagaggtgggggtggagaggcagaaatgtcctctgttttactgctgtgtaaaactggtcacgccccttagaagcaccaccacatgcctaactgttgttgataattaatttacctgatgcaagtgagtgaaaaatttaaatgatcataatttacgttgcctttaaacgacagaacaatttaagtcctctagttagctagttcctttaaaacacaccccacatccctaccagaatcactgcccatccccccccacccccccgcccaaacagcaatggttatttatttctaacataatccggggacccttgccccttaaaataattaaataatatatgccatattttctctagaaggcactagatttggcatcaaaagacttgctttggcattcaagaacagtgtgtttgaggaggaggcgtttatcttccctgagcctcaatttctttatctgtaaaacaacaaagaacatcaaagctctttgtaatttcttcctctttcctcaaataacactttgctcattactgcgtttttagaacttatatcctagcgttaagtggaagcttaactggaagctccatgaaggtaggccttcctttctgataacctagcgtaagatcaataaatgtttattaaatgaggcactttacttcacaaaggatatggcattttaacggttacaagcgttcccagtcaacgcatccacaaagcattaggccacctataaactaggaatttaaaaggcaccaaaatcctagaagtcctaggagggcgtggtgacgcaagcaggtgaacgctggccgatgctgacaacccactcctgacgcgcttccggtgcgacgctgtctctccatgccaggactgagttgtgggggagggaggcggttagcgggctttagcgccttttctggcggcggtagatttgaagcgcttcaaaggaccggacccagagaagaggaaaactctaccggtgcaggtaagtggtatgaggctcaagttgttctggcggcgtcatttcagcagtccctgcgtacgaaagcgggaagggcctgggaagaggggcggagccggcgcggctgaccgggttgggtttaccgtctttccctcgaggtatcggggctgcttgggcccagaggaagtccctgaggaccgcagcagtgcctttgccgctgttgcagaaggagaaggcttgcagtcgagccccggggcctggggacggtccttcctctgccagcccccgccctccccactcaggcgcacacctccctcactgacgcattttgccgcacaagctgtaacatggcggcagcgactgcggcctgaactctagggagccgggttgatttttaaagcttcaaaatcctaagactcagcactgttgcggggtaggtggcgggactggtggggaagggggagacagcctgacgtcctgtcaggctagggttggagagtgacgggcgaagagcctgaatcacagggattaaaattgaagactagctttcctcctctttcgaccttttcctctcacagcacagtggctgtcgtgcagttaagtggcagaggccactttgttaagcatttttctaaaactcaagtccagggtcttgagctctcgcgaagttcccccgtgtttcggaggagctgtgagctgcgcaggccttttaggaggagataattactctttaggaggaagatgatgatttcggggctcagtatgcctgaaggggaagtatgctaatttggttcttggttagtctttttttttttttttttttttttgagacggagtctcgctctgtcgcctaggctggaatgcagtggcgcgatcttggctcactgcaacctccgcctcctgggttcaagtgattcttctgcctcagcctcccaagtagctgggactacaggcacgtgccaccatgcccggctaattttttgtgtttttagtagagacgggttttcaccgtgttagccaggatggtcgatctcctgacctcgtgatccgcccacctcggcctcccaaagtgctgggattacaggcgagagccaccgcgcacggccagctcatgtttagtcttaaggagcaaagtctagatgtgctggcaaggagtatgcacaatcgttttggaaatgctataaaagcaccattttgtgcattgattttaatttctttccacgatagccctttctgtgtgtaaccaacattttgcagtagtgaacacaaatacaaaagtatttgcttttatagtttggtactaacatagttgtccaaagaacaattagatgttttagaaattaggggggcctgatattaactttcagtagttaaaaccaggaaaaaagagtgagtgtgtgtgtgtgtcggtcacacacacgtttttgtctttgtgtattcccatttggtaacaggatggccggtaattgctactttgtaacaatgacgggtgggggggtgaacattttataaattttgaaatcgtgctataaaatccagaaaagatacatttagaatggctgcttctctcctgtttttaatatatcctgaaaatttacccgttttagcactccccttttttttatgttaacgagttgggacagaattatttctgtaacaaattacatggttctgtgtcttaaacaagagttcattgtacattgtttgactatttctttatgattcagaattattgatgctctgagatcctatagggtcttgtagtaggattctgcgcatttgaattgttggtttcctttttaaggcttttctaggcagtcagttgtcaggagtgctcctgctgtcaggagtgtataagtatgtaaacttcttaggttagaaaaatttggactttctggcccaattatctttctgagcttcagtttcttcacctacctgcaaaatgacattttgatctccaccttccatcaactgtgggcttgaaaattaaatactcagctttgttaaaattgtgtgtgaagttggctttcattaactcagtggttcctttatgggtgaagagtgttcattacatttatttttaaccatatagtcgatttactgtggtgcttattattgtggtcttgcagtattggtgacttctacatatttttgatattttgccttaaattagattttctgtgaggcagcatcctcttctttatacaaagggaaagtggaagccattcataataaagtacttctgttaggacactatctggggttaattctttaaatagtagttgcccctttagttaggcttttttccttcctattagtttataaatagagtatttaaacataattataacatgttgtctatttttagaatcccagtgtactaagatgtcatgaaggaatacatagataattaatgcaagtgacctgaagagtttgttgcaagtctttctgttgcattgtggcattgcatgctttttgcttttatttatttatttttttcagacagagtcttgctctgtcgcccaggctggagtgcagtggcatgatctcagctcactgcaacctccacctcctgagctcaagggattctcacgcctcagcctccctagtagctgggagtacaggtgcctgccaccacaccgggtaatttttatatttttagtagagaaggggtttcaccatgttggctacgctggtctcaaattcctgacctcaagtaatccatccgcctccgcctcccaaagtgctgggattacaggcgtgagccactgtgcactgtgcccagcctgacttttgcttttttttttgagacagagtctcgctgtcttgcccatactggagtgcagtggcgtgatctcggctcactgcaacctccgcctcccgggttcaagcaattcttctgcctcagcttcctgagtagctgggattacaggcatgtgccaccacacccagctgatttttgtattttttatagagatggggtttcaccatgttggttaggctggtcccaaactcctgacctcatgatctgcccaccttggcctcccaaagtgctagtattacaggcgtgagccaccgtgcccagacctttttgcttttaatgttaggactaaacttcaattttcatgttgcttaagtgtcggtgattttccctggtttaatgcataaatggtcaccataagaactcggtatttttatttctgtagggaaaaacttgcatcctgaaatttactacagacagtattcagagaaaactgctgttattgggagtttgtacttctagcagcagacaagaaaacttttgaactttgttttagaataatggcttaaaatgatcacacgcttactgaaatttgattatataacacttataaacaccaatcttttatattaaaatgattattttaaaaacatgaatgatggccgggggtggtggctcacacctgaaatcccagcactttgggaggccgaggcgggtggatcacctgaggtcgggagttccagaccagcctgaccaacatggagaaaccccgtctctccgtttctacttagaatacaaaaattagctgggcattggtggtgcatgcctgtaatcccaactactcgggaggctgaggcaggagaatcgcttgaacccgggaggtggaggttgcagtgatccgagatcacgccattgcactccagcctgggaaacgagcgaaactccatctcaaaaaattaaaaataaaaataaaaatatgaatgattccttaactcgttttaaaaatgaacgaagcatattcgtgtgtgtgtgtgtatatactaagctcttgttaattattgtatacattttagcttataattaaaccattgaatcatggttatatggtgaaaagtaatattaagccattatgtggaatatttgtgagtaaactagtttttaccgtgaaattgtagaaagtactaaatcagaacttttgcttttttccatttgtgagcttgagccactcatttcatctcttttgtcctcttgttcttgatctataaaatcagaagattggatcaggttatctcttagagttccttgaaactccaaatgttcttatttttttacgtaggaattactggattgaataatggggttagaactgtgtgtatatatgtatatatctttgaaaactgggggtaaatcttttttcttttttgtttttggttttggtaaatttattattataagaacttagatcaggcggagtgcagtggctcacgcctgtaatcccgacactttgggaggccgaggtgggtggatcacctgaggtcggagcttgagaccagcctgaggaacatgaagaaaccctgtctctactaaaaatacaaatttagccgggcatggtggcgcatgcctgtaatcccagctactcggaggctgaggcaggagaatcgcttgaacccaggaggcggaggttgcagtgagccaagatcgcaccattgcacttcagcctgggcacaagaacgaaactccctctcaaaaaaaaaaaaaaaaaaaaaaaaccttagataattgcaagtacaacattaagagtattagccgtgagttcccagttagtatttgcttttgtagtttggtagtgacaaagatgtattatatttttatgtctctcagatcgtatatatagtaagtgcgtaatatccttatttaacactgaattaggcaacattatgggttatctctgtaagttttctagaggatttaagaatttcagaagtgtctatactctgctaatcatgttgctaccagtgcagtggtttgcatcagggtggtttgtgtccatcagaaacatcagtggaagggacactacatgaaatagcataattgtctgtcttgacacctcagaatgttagcttgtttctactttattcattagcaacttggcatttgtaaatatactcaaatgtttttgatgcggtgcattttcgtttctcatttgatctatatgaactacattaagagtaggctaaagaggctggtaggaatgttaaattactttccttgaaagtaatattaaagatctgctatagttttaattaatttaacttacatgatttcacttaagaggtggaaatcttatatataaattgtctcctgtttcatcaaatttagcagataagaataatcctttctttcttggttgtaaactgaagtggattctggttttggggtttttttggggggggttgtttttttgggaaacaaaacacttcctagtagatctagggaatgggttctgtttcagttgtggaggaggcagagaggatgattactggtggtaggttctgggagaatttactgactacagatatatgttagcagtatccccatttaagaagctagcagtccgggtgcagtggccccatgcctgtaatcccaacactttgggaggctgaggcaggcggatcacctgcgattgggagtttgagaccagtctgaccaacatggagaaaccccgtctctactaaaaatacaaaattagccgggtgtgctggcgcattccagtaatcccagctactcgggaggctgaggcaggagaatctcttgaacctgggaggcagaagttgtggtgagctgagattgcaccattgcactccagcctgggcaacaagaaagagcgaaactctgtctcaacaacgacaacaaccaaaaaaaaaaaagaaaagaaaagaaaaaggaagcaagcagtacatgtttaagaggataggcactggattataatagagtctagttctgttcatgcctcaattaacattctttttatttgataacgtcactgtgtttggtgttgaagatacaaaggtttcgaattgttggagtttatgataaaagagtaacatttaacaagggaggatcatttaaaccttagaaagtcagggcctggagcggtggctcaagcctgtaacgccagcactttgggaggccgaggcaggcggatcaccaggtcaggagatcgagaccatcctagctaacacggtgaaaccccatctctactaaaaaaatacaaaaaattagccgggcgtggtggcgggtgcctgtagtcccagctactcgggaggctgaggcagaagaatggcgtgaacccgggaggcggagcttgcagtgagccagaggtcacgccactgcactccagcctgggtgacagagggaggctccctctcagaaaaacaaacaaacaaacagaccttagagagtcagcgtgaagttcccagagagtgaactctggctaactaattatctggctaatttgcatcttaaaaggacacacgggaatcagtgaggagaatcctaagggtcagagacttgcttggcatcttaatcgttaaaaataatttactcagactaggcaatatatccacaaaaaaatttttaaaaattagctggaggtggtggctcacgcctttagtcccagctactcgggaggctgaggtaggaggattgcttgagccactgcgttccaggctgcggtgagctgtgatcttaccactgtgctccagcctgagcggcatagcgagaccctgtctctaaaaatagaaataatttactttgtattttttctagattagaaactcggtgctatgctgacttcctcataatgtgtgaaacttccaaataactttaaaatataataaagttaccatatgcctacttataaatgccatgtccgctactatatattttaataattagttgcctatatttttgtcctgtttttcatttagtcatgttattttaggattaatatggaaaatagtttatgtatgaaactacaaggataaatttttttacacatgaactggttacctcttactgatttttttatgaaatgtgtttgttgcagaagtttataaatgatagcactgtgatatttttaaattgtattaccttattattgaaatacaaaagtgactatattgttgataaatattaaaaataactttaatcacctgcataggaaaaacaagaatataataaaagtattaaaagctatagctaagttttagaattttgtgcattttgtatgattaatttttttcagtgagcttattagctttattgcttatcttattaaaaatgtgttttcattatgatgaaaaaagtagattcagtatattatacttaaatttctgaaggagtcaagcaggtgaggtaagtacatgaggtcaagtagacaataaattttaacagctaataagcaatagctagaattaggtcaaactagaacatatatatgtcatctgttgggagcagactatgctgattgctgtgtagaaatggggcacagtgccacatattgtgattttttttttttccaagaaaaatttgtctggattttagctgtagttcatactaaacaaatttgcagcaaacaaatcacccacagattactactacactgaaaattttgattatattctagtatttttaggcaattcatgattttttttttttttttttttttgaacagagtctcactctgttggccaggctggagtgtagtggcatgatgactgctcgctgcagcctcaacttcctgggctcaaatgatcctcccaccgcagcctcccaagtagctgggaccacaggcctgggtcatcacacccagctaattgtcattttttttttaatagagatggggtcttgctgttgcccaggctggtcatggatattttatttaaaattgtaagggcttaattttcccctgaatcatgtttttggtatctcctagcattattttttctctttacttttacttgaaaaaaaatgaaaaattgaccagatgtttgtcttactgcatctggtttcagatgtcttttttctttttttttttttttttttgagatggagtctcgctctgtcacccaggctggagtgcagtggcgcgaactctgctcactgcaagctccgcctcccgggttcacgccattctcctgcctcagcctccagagtagctgggactacaggcgcccaccaccacgcccaactaattttttgtatttttaggggagacggggtttcaccatgttagccaggatggtctcaatctcctggccttgtgatccgcacgcctcggcctcccagagtgctgggattataggcgtgagccaccgtgcctggctcagatttcttttttctaatagagatgcgttctcattatgttgaccaggctggtcttgaactcctgggctcaagtgatcctcctcccttcgcccctcaaagtgctgggattacgggtgtgaaccaccgtgatttcaggtattatttaataatcgaggaaatcataattatagaggaaataggatatactgtttctgattagtaattagtaactttttataatgattagtaattagtagcatttcagtaatgttagcgacacagcatgtgagccatcttttgttgtcaccattgtttttcattagctgctaatattaaaacatttacatattcaagggatttgtgtagtaattttaatagtaatttgctgcctttcatctttcttgcatttgaggcatatgtgatttgtcatttcaggaaaactaatcaatttctatgaagagtgtatccttgagtgatagactctgaatacatcttatagccatttccacacatgtacattataatgttagaagactgtgtgtgtatatatatatatatatatcttaggaattttttctttataatagcagtacatttattatttattttatttatttatttatttattttgagacagagtcttgctcttgtcgtccagggtggagtgcaatggcacaatctcagctcactgcaacctctgcctcctgggctcaagtgattctcctgcctcagcctcccaagtaactggaattacagacacccaccaccatgcccggctatttttttgtatttttagtagagatggggtttcaccacattggtcaggctggtcatgaactcctgacctcaggtgatctacccgccttggcctcccaaagtagcagtacatttattaaagaaaactagaaagaagtagtgaggcaaaagccctctccagtcttacagacacacacaataatgatttatttcctttcactctttttttgtcttcttgtaagtctttgcctgagcttgaaggtcgggagtagtttacacaatcatcattatgttgcatatgctgctttatatctttttttttttttttttttgagacggagtctcattctgtcacccaggttggagtgcagtggcgtgatctcggctcactgcaagcttcacctcccaggttcacgccattctcctgcctcagcctccaggtgggactacaggcgcccgccaccatgcccggctaatttttttttttttttgtatttttagtagagacggggtttcaccatgttagccaggatgatctcgatctcctgaccttgtgatctgcctgcctcgggctcccaaagtgctgcgattacaggtgtgagccaccacgcccggcccactgttttatatcttgattatttttccaaattattaatcttcataagcattgctttaattattgttgaaccagagacaatttcacttttttgtgatattatgataggttgcttttgattatatgttgctaaaaagagcaccagcgtagccaactttatacctgaaggctttctgaatttagagtagttcctcataatagatttccaacagttgaattttactggttcaaagtataaacacttatgaatttctcatattcttaaatttcaaaggagttgtatatgatcactagtagtagtataaattcctgtttccatttgtacatgtgttgagagttattcttttaaaagatctttgctgttgataggcaaaaaaaaaaaaaacgcattttattagtacttttttaaaaataattgtttcctgattacgaaattgaagaaaaattggaaaacaaatacattaaaaattacccttaaacccatggcccacacatgatgattgctaacattatggtgtaaatcctgtctttttaatgtgcttactgatacgtgtgaaattgggattttatagtctgtattgtttactaacttgcttttttcacctggtatgactattttgtcattcatgaacaatctggtaatttttcttcttcagttttactctttcttttctttttttttttttttttttttgagacagagtctctgtcacccaggctggagtgcagtggcacaatctcggctcactgcaatctccacctcctgggtttaagagattctcctgtcccagcctcccaagtagctgggattacaggtgcacatcactacgctcagctaatttttttgtattttttagtggagacggaatttcaccatgttgggctggctagtcttgaactcctgacctcaagtgatgccttggcctcccaaagtgctgggactacaggcgtgagacaccatgcctggcagttttattttattttattttattttgagatggagtctcactctgttgcccaagctggagtgcagtggcatgatctcagctcactacaacctccgcctcccgggttcaagcgattctcctgcctcagcctcctgagtaactgggattacaggtgcccaccacctcatgcagctcatttctgtatttttagtagagatggagtttgccatgttggccaggctgttctcgaactcttgacctcaggtggtccacccgcctcagagtgctgggattataggcgtgagccactgcgcctggcctattcatttttatagtaagttttttcagtgtcttaaaagttacccttttcttaatttttaatttttgtgggtacatagtaggtatatttatgggttacgtgagatattttgatacaggcatgcaatgcataatgatcacattagactgaatgaagtatccgtcttctcaagcatttatcctttttgttacaaacaatccagttatactctttatttttaaatatacaattaaattttttttgagtatcgttagtcaccccattgtgctagcaaacactaggttttattgattcttaactatttttttgcacccattaaccatcctcacttccagtccccattaccctctcaagtgtctagtaacagtctctctactctcttatctccaagagttcaattgtttaaatttttagctcccacaaataagtgagaacatgtgaagtttgtccttctgtgcctggcttattttacttactataatgaccttccagttccatccatgttgttacaaataacaggatcttattctttttaatggttaaatagtactccgttgtgtatatgtatcacagttttttgttttgttttgttttttgcttttgagactgagtttcgctcttgttgcccaggctggagtgcagtggcgcgatcttggctcactgcaagctctgcctcccgggttcaagcgattctcctgcctcagccttcccgagtagctgggattacaggcgtgtgccactacgcccggctaattttgtatttttagtagagatggggtttctccatgttggtcaggctggtcttgaactcctgacctcagatgatccacccgcctcggcctcccaaagtgctgggattacaggcctgagccactgcgcccggcctttttgtttgtttttttgagacggagtctcactcttgcccaggctggagtgcagtggcgcgatcttggctcactgcaacctctgtctgccctctgggttccagaaattttcctgcctcagcctcccaggtagctgggattacaggcacacgccatcatgccctgtgaatttttgtatttttagtagagatggggtttcatcatgttggccaggctggtctggaactcctgacctcaagtgatccccctgcctcagcctcccaaagtgctgggattacaggcgtgagccttcgcacccggccgaaaattgtgttttgagtggcctaaacccctagatcccagggaaactttggccttagggaaaagcagatggtgccagaagtaatgccagcagaaagctcacctcacctcctttagactgctcagtgaggcaggaaagcggagaactttcttgtaacactcagcagcctgaagggcctcactccccatgaaacctaaagaaaattgaagacttgaaggctccaggagtcacctaatgcagcagtcccccaacagtgtctgcctttggagccacgcaaccagcactaatatctctcctggtccatttttttttctgagacggagtcttactctgttgcctgggctggagtgttgtggcgcaatctcagctcactgcaacctctgcttcccgggtttaagcgattctcctgcctcagcctcctgagagtagctgggactacaggcatgcgccattacgctcagctcacttttgtgtttttagtagagacaggatttcaccatgttggccagggtggtcttgaactcctgacctcaggtaatctgcccaccttcgcctcccaaagtgctgagattacaggcgggagccaccacacccagcccacatattctttatctggtaatctgttgatagatacttaagttacttccaaatcttggatattgtaaatagtgctgcaataaacataggagtgaagatatctccttgatatatgatttcctttcttttgagtgtatacctaggagtgggatatgttataataatttttaatagataatatattcatgtggtataaaattgaaaatatgaggttataaagtgaaaaatcttagccctcttttccagttacccattttctctctccctagatgcctttttgttaagcaaatacatacttgtaaaatttaatttaattttgtttttggagatggtctgaggctggagtgcagtgatgctaccatagctcactgcagcctcaaaatcctcggctgaaagagtcctcccacctgatcctcctgagtagctaggactgcaggtgcacgtcaccatgcctggccccactttcgtttttctctcgtttttcttttttccttttcttttcttttttttttttttgagacagagtctcactctgtcacccaggctggagtgcactggtgcaattttggctcaccacaacctccgcatcctgagttcaagcaattctgtgcctcaacctcccgagtagctgggactacaggcgtgcgccaccacatccagctaattatttatatttttagtaaagacatggtttcgccatgttggccaggctgctctcaaactcctgatctcaggtgatccacttgccttgacctcccaaagtgctgggattacaagcatgagccaccacgcccagctctctcttcttttaaaaatatacaaagacagtatatcctacacacttctgtaccttgcttgtttgtttgtttgtttgtttgtttgtttgtttgaaatagaaacaaagttctccctatgtttcccagcctggtgtttcaatccttctgcctcagccttcctaagtgctgggattataagcatgagccaccatgcctgggcaaccttttttttttttttgatacagggtcccactctgtcgcccaatctggagtgccatggcacaatctcagctcactgcaacctccgcatcctgggcccaaatgatcctcctgcctcagcctcccaggtagctgggactacaggcatgcatcactatgcccagctaatttttatattttctgtagagacggttttgccatgttgcccaggctggtctcaaactcctggactcaagcaatccacctgtctcagccttctaaagtgtaagccactgcatctagccttttattttctttttcttttttttggagaggtagtcttgctctgtcgcccaggctggagtgcagtggcgcgatcttggcccactgcaagctctgcctcccgggttcacacctttctcctgcctcagcctcctgagtagctgggactacaggcgcctgccaccacacccggctaatttttttgtatttttaggggagacggggtttcaccgtgttagccaggatggtctcgatctcctgaccttgtgatccacccaaagcggcctcccaaaatgttgggattacaggcatgagccaccgcgcctggcttattttctttttcatttaacaaaataagttaacatttacagattttaggaaatagttctccctatcttggagacagcagtaaatgaacagatttctcattctttctaatagctttgtactttctacaggtatacagtggtatacctgatttatatttattaaattattttgtattatatatcaaattatatatacatttatcaaagtattataaatatttatatgtatataaatacaggtaaatatttatatgtatataaatacaggtaaatatatttatataaatacaggtaaatatatttatgtaaatataggtaaatatttatatttatataaatacaggtttatatttctataacctgttcctcctttatggacatttaggtttacagccttttactactacaaattatggtacattgaataaccttgcacatatcttattttgcgaatgtgtaaggatgtacataaagtaaattcctagaagtggaattactgagtcagagagtcttaaatgcatttgtaatatggatatttgttgtcaaattggcaatcaagtaattctatcagtttatccctttaccagcagcaacaataaatgaggtcattttttatttttgtcaatccaattggtgaaaaaatgttacgtttgtaattttaatatgtaagattatgatttctcatagatagtatttcatttcatgggggtattttttaagtaattcttactactgtacaattatcttttttcatgtggcatttaacacattttttcatgttattttaaaaagcttattttcttaggcagtccatcacaaactaatttacttaactattgtgttagacatttaagttgtttgtgcttactgttatttaaaaaaaaacccaaggactattttattttaaatggttgcctttacagatattccagtacatagaattagtaaaatgttaaaaggtacaatgaatatgaatatattcaagattcttggcctgtaatgccaagttgcttatcaaaactgctggtgccttttatgtttttttttgttatttcactttttgtgaattctctgctcatatacccttaggtgtcctttgagctttaatttgatagacggacagtgaaaggttttggttgtcacagtgactgatatttaatagggcaagggttgcttaaggttctgcagtgagttggataaccctactcaatgaattgccctagtgcccccattcctaagcactgcttaagaaaattaatattctcagcaactatgacaatgtattttccccaatttttttctttttaatttcacatagacaaatagaaataatttttttcataagttcaaatctgtttatctccattatttacttcattagtgaatctaaaaagctgtttcatatccagggttcaggtaaatattcgcaagtacttttcttagtttctattttgtggggaggtacacattttgtgagaggaaaaaaaaattttttttttttttttgaaacggggtctcactgtcacccaggctggagtacagtggcttgatcttggctcactgcaacctccgcctccctggctcaagtgatctttccacctcagcgtctccagtagctggggctacaggcatgtgccaccatgcctgtctaatttttgtattttttgtggagacagggttttgccatgttgcccaggctggtctcgaacagctggacttaagcaatctgcctgcttcagccccccaaagggccgggattacaggtgtgagccactgctcccagcctcctaagctctttacatgttaaacagcagcactagttgagtacctcttacccaaaatgctttggaccatattattgcggatttctgactttttcagattttggaatgtttgcaatatacttaccagttaaaccttccaattctgaaaatccaaaatgctccaatgagcatttcctttgggtgtctttttggcactcagaaaatttcagatttggggttttcagatttaggatgctcaatcatgatgtagtaatcatgacagtgagacactttaaaaatgtcattgaaaaacaaaaacaaaaataagaaaaaagaaaaaaatatataattgaagatttaaattacatgcttacctgagtttctttcataagtctgctgtatacaacctaggaaatgcaaaaactaaaataaaaatcacctataactcatttacttagagatagactcaatattttcatttatttcctattttgttttactgtgcagatacattttaaacttttatgaattttaagttgaaaaactaatacatgaacatattcttattgcaaaaattcaaaccttatacgtaaagctgaaggcccccaatgacttccattcctagactcagtcccttttgcagagattctgtgaggagtttggtatatatagtattttcaagatctctctttgtagaaatagggtattgttttatggtgttaaaagaaatacttatgtacaatttacttttttgtttcttttgaactaaacagtaggtttcttggcttgtgttacaatgaaactgccatatagtattaaatagcattttataccgtaatttgttcagtttctccccattgtaagatattttgagtgtttccatttttttgttgttgttactgcaattttacattctcacttatgcctatcctctcacatttattcattcatttaataaacactgatttcttgtcatatgccaagcactgtttgagcagtaagaataagactgaaaattcaggtttatcacatcatggaacttatattctagtgagagaagatggatataaaaattgaatatcaattagcaataaatgcttggaagaaaaataaagcagaataagaggatgtaaagtgttaggaggatgagagctcctttcttgaatacagtagactaggaatgggcctctataagaaggtgatacttgagcaacaaagggatgaaccatgtgaagatggtttgagagcattccaggtggagagaacagcaaatgtaaaggacctgatgaaagagtaggctgttgggtggcagggggaacaagcaggataccaatgtagctgaaataaagttgaggaaaatattagaagatgttaggaaatgaaagttgaggaaaatgcctagaggtgaacaggagctaaaatatttagagccgtataattgaaattacagtagccacaagccacatgtgctttttgagcacttgaaatgtggctagtctacattgagatatgcttcaaggataaaatatacactggatttccaaagacttgtacaaaaaaaaaaaactcagtaacatttttgtttagtatattttgaagtggtaatagtttggttgtacaagttgaacatcactaatctgaaaatctgaggtccaaaatgtaaactttctgagcatcacaattgaaaatttcacacataagtacttaatacaaactttgtttcatgcacaaaattattttttaagttgtataaaattacacatacaattcaggctgtatgcataaggtatgtttgaaatataaatgaattttgtgtttaaactgtgtcccatccccaggatatctcgtgtatgctaatattccaaaattcaaaaaaaaaatctgaaacacttctggtcccaagcatttcctataaaggatattcaatctgtacatactgagttaaatagaatatattaaaattagcctggtttttgtttgattgtttgagtctcgctctgtcccccaggctggagtgcagtggtgcagtcttggctcactgcaacctctacctcccgggctcaagcaattctcctgcctcagcctcctgagtagctgggattacaggcacccgccaccacagccggctaatttttgcatttttaatagagatagggtttcactatgttggtcaggctggtctcgaactcctgaccctgatccgcccgcctcagccccccaaagtgctgggattacaggcgtgagccaccgcacccggcccaaaattagcctgtttttgtttgtcaaaatgtggctactgaaaaattttatacctgggtggctcatgtttttattgagcagtgctggtctagagccttaaaatccatgctaaaacttttcagatgaatagtaagacagttttaggcaggggaaggatatgataaggtttgtgttttaaaagaatcattccactctggctattttgtgcagaagaggcagtacagaattaagagtaaaataagagaaaccagttaggaggctattggaatagcctagataagaaatgataatggtaaaggtaatgagaacttttgggatagtttttgaagctagagccaaattaccttcctaatggtttggataatgaggtatgagggaaagtggaaccgaagatgacccccaggttttcagcctcagcagctggcttggacaatgataatgtttactgagtattcaagggaatggaggtagaagaataaagagttttgtcttagatatattaattatttttaataaagtaaatttttattgaaatataacatagcgtacatagcatatgaaactgtcatttttagagtccatcattttggatactatttacacttagtgcctttgtttcttctacgggtaagtatcatcttccaccaagtattacgattcagcattttaagtccttaaaataaaatgccttatcaaaataatgtctgttaaataatagctttctgttatggaaataaagctgttacacagagtatctctttggtattttttgtgtctataccagcatatcagtaaaggctgttgctcagaatcagcaagtaccctcatatgtaaaattgaatgtgcttttactcaaaatgtaaatctaccacatatactatttaacaatagttaaatagtatattaactatatactatttaacaatagttaaatagtatattaactatatactattctttttcttcttacatgatttttgcttcttaaaaatctcacattttaatcagaactctcatttttgttttctaggagcacagggatcagttgtccttgtttttttttggtcttttcttcatttgaaggtaatctgcttattgagttcactaatcatacagagtaaatacaattttctgtttgagctattaatctgtattccggttgataaatagaaagttgattacataataatggttaaggcttaactttcaagtcttttctaattgcttcacaaaatgcaatctaatctctaaaaagaaagcactaataatccatgtgatttacctcatagaaataaatatcaaaataaattcaaactatatttctaatattgtttcacagaattttttttccagaaatttgtgaaagatctttgctattttagtctgcttgtctgaaactgtattttactcacagattaagtattggagccatgggaataaaggttcaacgtcctcgatgtttttttgacattgccattaacaatcaacctggtaagaatattagttgacatttataaatgggtgtttaatattttaaattagtaaagaagtttaaccaactaccttctttttcagctggaagagttgtctttgaattattttctgatgtgtgccccaaaacatgcgagaactttcgttgtctttgtacaggtttgttcacattttcaactgccctaatagtagtctcagttgactatggcttgcttgcttgcttggttttttttttttttttttttttttttgagacaggatcttgcaacgttgtccaactggactagaactcctgggctcatcaatccttacacataagcgtcctcagctgggatacaggtgtgagctaccacacctggcatagcttgctttaattttttatttactctattttagatttctccatgcatattacttttctcttaacatgaagattacacagcagtgactagggcgtgaaagtaattcttagaaatattatggctgggcagccaggcgcagtggctcatgtctgtaatcccagcactctgggaggccgaggggggtggctcacgaggtcaggagttccagacgagcctggccaagatggtgaaaccccatctctactaaaaatacaaaaattagccaaatgtggtggcgcacgcctgtagtcccagctatttgggaggctgaggaaggagaatcacttgaacccgagaggcagaggttgcggtgagccgagatcgtgccattgcactccagcctgagctagaagagcgagactccatctaaaaaaaaaaaaagaaagaaatattatggctgggcacggtgtggctgggcatggtggctcacacctgtaatcccagcactttggggggccgaggtgggtggatcacttgaggtcagtagttcaagacaatcctgtccaacatggtgaaaccccatctctactaaaaatgcaaataatcggccaggcgtggtggctcacgcctgtaaccccagcactttggaaggccaaggcaggcagatcacctgatgtcaggagcttgagaccagcctggcaaacatagtgaaacctcatctctactgaaaaaataaaaattagccaggcgtggtagtgggtgcctgtaatcccagctactcgggaggctcagacaggagaatcacttgaaccctagatggaggttgcagtgagccaagatcgcaccattgctctccagcctgggcaacaagagtgaaactctgtctcaaaaaaataaataacaaaaaatcagctgggtatggtggtgtgtgcctgtagtcccagctactctggaggatgaggcgggagattcgcttgagcccaggaggcggaggtggcagtgagccaagatcactccactgcactccagcctgggcgacaagagtgagatcctgtctcaattaaaaaaatagaggccaagtgtggtggcccatgcctgtaatcccagcagtttgggaggccgaggtgggtggatcacttgaggtcaggaattttgagaccagcctggccaacatggtgaaattcagtctctacgaaaaaaaaaattagccgggtgtggtgacaggtgcctgtaatcccagccactcaggaggctgaggcaggagaatcacttgaacccaggaggcgcaggttgcagtgagccaagatcgtgccaccgcactgtagcctgggtgacagagctagactctgtctcaaaaaaaaacctaaaaccaaacattagttgtaaaggtatattatttgagagtgatttctacattctccagaaataacgtgggtgattttttaaatgaatttttaaaaaaaaattcctgaaaggaatgaaaatatgattttaagtctgcagggttcaagaggggcatattttacatttattttgctttcatactactttgatttcctttctattaaatgtcctatttttttatctctataggtgaaaaggggaccgggaaatcaactcagaaaccattacattataagagttgtctctttcacagagttgtcaaggattttatggttcaaggtggtgacttcagtgaaggtgagacttggaaaaatcatgtattattttctgttaaatatcacagatctcaaagttagacaagtccctagaagttttagtccaatattcttgtcactctcactccatttaatctttggtcaattagaagtactcatagaaatatgtaaaagaaggaagctcataggctgggtgcggtggctcacgcctgtaatcccagcactttgggaggccgaggtgggcggatcacgaggtcagtagttcgagaccagcctggccaacatggtgaaaccctgcctctactaaaaatagaaaaatttgctgggcatgatggcacgtggctgtagtcccagctacttgagaggctgaggcaggagaatggcttgaacccgaaaggtggaagttgcggtgagctgagattgtgccactgcactccggcctgaatgacagagcaagactctgtctcaaaaaaaaaaaaaaaagaaggaagctcatagaaaataattttgcctttgacacatgaatttcagaaataggcttctggatacaaaacaacactgcattcatctcagtaatctgtcaagtgtttctgtttgattttgtcacaagtggtaatccttactacaataaaaatttttacttttttattgtaaaaatatcaaaactatagttttaaaaaactttgaaaaaatgttaacctgttgcaagacctgcataatcataattagaatctgaaagttcttttttaaaatatattttaatagtcttcgtcacattcttgctatcatagcataggggaaagaaagtaatttgggaccttgtcgttattgacattaatatcttttatgatttgctgcaatcttcgaatattgttaattcaaaattattcaaaaatctactttacaagaagtattttgtttaggtatcacctttgaggagcttactgagagttataagagtatgtttttcatttttaggaaatggacgaggaggggaatctatctatggaggattttttgaaggtaaaaatgtttacatttatattatgttttaaatattttgtcttttattctattttattctctatggaatcaataacattattcattaaagggtatactaatgtctagctgccttcaactaatctgaaggttaattttctggtaaaaaaaattgctttttatacagatgggtattttttcttcttaggacatttttacaacatgatttgaaagggtttcaatgatctgtacttaattcttagaattttaatgatagaataggaacttccgtaggtcaatcttaacttttattaaaggagattcagcaatatttcttacaacatccaaattttaggtcattttttctatgaacatttttaaaaaatctttgatattctaaaatttgactataatattttccaaaaatttaagttttcttgctggaatttttttgttgatgtgaagaccatttggaaaatggtctataagcatatttaatgtggaaataatttaatatttttcatccttcacttttaacatttagtagcaattttgtttcccattctacatgatttgttcttaatattctaacccaagattggaaaacaaattcctccttttgcggtaagtgatgctatggcagaggttaagttaatgagtccagactaaataatactctgtgtgctcagaaatgaaacagatgaaatgtaaaagaatctaatctggactgtctcactcttttttttaagagatgggatctcactgtgttgcccgggctggaatgcagtggcttttcatgggtgtgatcatagtgcactttaggttcaagctcctgagctccagtgatcctcctgcttcaacctgctgagtagctaggactacagccacactactgtgctcagctgtttcttgctttttaaagatagtttcatttttttatttaaataaagtggtgttatcttttccaaaaattgtgaaggacaaatataaatggaaaggaaggggattgagataatatttgggttttataagcaaataatagaaaattaataatatttgaatcttaaaaagatgagaggggaggctgggcacggtggctcatgcctgtaatcccagcactttgggaggccgaggcgggcggatcacgatgtcaggaaattgagaccatcctggctaacacggtgaaatgccgtctctactaaaaatacaaaaattagctgggcgtggtgatgggcgcctgtagtcccagctactcaggaggctgaggcaggagaatggcgtgaacccaggaggtggagcttaacagtgagccgagattgggccactgcactccagcctgggcaacagagcgagactccatctcaaaaaaaaagatgagaggggaaattgattcatatttgattctcttctttcataacctaactttattatctaagtaagttgtgtgtggcactaaataatacatcagatatgaatagaagtgaagatgaaatttttttggaggttatatctataatgtaactgaaaactttacttctctatagacgagagtttcgctgttaaacacaacaaagaatttctcttgtcaatggccaacagagggaaggatacaaatggttcacagttcttcatgtaagtatttattatctgatgatttaaaacatcccatttttgggccgggcacggtggctcatgcctgtaatcccaggactttgggaggctgaggcgggcggatcacgaggtcaggagatcgagaccatcctggctaacacggtgaaaccccgtctctactaagaaatacaaaaaaattagctgggcatggtgtcggacgcctgtagtcccagctacttgggaggctgaagcaggagaatggcgtgaacccgggagggggagcttacagtgagctgagattgcgccactgcactccagcctgggtgacagagcaagactgtctcaaaaaaaaaaaaaaaaaatcccgtttttggtctgtcatttctctgtgtgcctgccattgattactaataaataggagaggaatctatgagggacggaattgttgaaggaaggggaacaaataattgatttttttgttgttgtttttgagacaaggtcttgctctgtcacccaggcgagtgcagtgttgcaatcatggctcaccacagcctcgacctccctggctcaagcaatcctctacacctcagcctttcaagtagatgggactacaggtgtgtgccaccacacctggctaattttttaatttttttgtagagacggggtctccctgtgttgcccaggctggactccaggctgggattacacatgtgagctatggcacctggccaaaattgttgaagagggaaaattgttatagaggggaagttaaattgttctgctaatgttttgaaataatggagacttgtcaagagaacacaggagccaggttaaaggtttcccactagccaaattaggataatttcagcatcaaaataagtaacagtaatatcagtttatggtcaaataggaaccagcagtctacactgatataaataaatgattaaataatgagagagaagggaagctgttcccttattagaatgtcaactaataaatttaaacggaatggtggagttagaaaagtcaccattttgtaatcatcacagtaatgactgacccaggcaagaatcttctattgatgctaaatttagaggggtgatttcagtgagaaactagatgtttacagagtatttctccgtaaattacttaattacaaagaataaaatgcagtcagttctcactattcatagattctgtctttgtgaattcaccttctcactaaaatttatttgtaacctccaaatgctaaggatttccaattccaactacaaaaaaaattatgaccaggcctgttgtcagtaatgcctgtttttaaaatcctatcttatgggtataggtttgttctgttcggtagccttgaaatctcttgttctgtgaggaatttaatctgtcagtaccatgtggattattctgtcatttccctattctgtatttgttaactgttcaacagtgagaaatctggcgcctgattatcttcaacatttctgttctttattgattcctagaatgaacagttgccatcccatactgctgtaaagaaagaccaactaactagagttcactatttctttatccttattttcgtttttagactgagtgtaggtagttaaacaccaagtttaaaagtgacttaaattagttcttttttggtttggctttgtgattcactcaaaatgtgttaggtttattcctttctggttatatttcattttgttctccttcctacctagttttgatattttttttttgcatttttttaagtttatgaaatagtaacatttccaaagtcaaaacaaaaagaatactgtgaagtgtctctcccacccaacccttccactccattcccatttccttttttttttcaccccagttccatctatacatgttaataaccaacctaatttccagtttatcttcctgtatttctgtttgtaaacataagcaaatacatgtatacattttctcactttccctttcttacaccgtagatggcataccatgtatactgtttcactcttcacttaacagtatatccttaaaatactccataacagtttatagagatcattcttattcttttttgcagctgcatagtactctattgtttgtgtataccatagtttattcaaccaattgcacataatgtggatctctgattttctttttaaacaaaacaacttatggctgggtgcagtggctcatgcctgtaatcccaacactttgggaagccgaggtggcgggtggatcacttgaggttaggtgttcgagaccagcctggccaacatggtgaaacccagtctctactaaaatacaaaaattagctgggtgtgcttgcgggcgcatgtaatcccagccactcgggaggctgaggcaggaaggtggaggttgcagtgagccagggtcgtgccactacactccagcctgggctacagagcaagactccatctcagaaacaaacaaataaaacaacttataattacctcttcattgtaaaaaaagaaaaagaaaaaaagaaagaaaacacagataagacacacacacaaaaatcccattcccagagcatctttctgtgcattaaaaatgtttgtagagtgtcgttctatagtcaacttttggctataatataaatctctgcacatcactaaatattagctttttaatggctacatgttaatctcttgcttgaaagtactgtgcattattaatcttattttgggacatttggtttgcttcctgtttttcaaactgctccaatgaacattgttgtgcctatcatttgatgcagttttaatatttaagaagtttacttaatgaactatttacacatttttaagccttttcatatatattgttatgttgattttcaaaaggaaaggatagtttactgtagcaccagtagtatgtaaatgctaatttcaccacattctcaacagagtattataatttattttcctcttttaaataaaatctttcctgcactaaccaaaactcctatgttaagttcatataatccttcatatatatattctcagaatcttccctctaaatgtttgttactccttatatcttcctatttcgtaggtaacccttcttctgtgttctgttttttaaaggaaataacttcaatttttagagagcttcagtcttaaaaaaaatttttttgtactataacatatagaagatttgccattttaaccatttgtaagtgtacaattcagtcttgtttatagctatttatttatttatttatttgagacagagtcttgctctgttgcccaagctagagtgcagtggcacaatcatagctcactgcggcctcaaactcctaggctcaagtgatcctaccgcctcagcctcccaaagtgctggggttataggtgtgagccactgggcctagtgagtcatgtgtattcacagtgttgtacaaccatcaccactatttccagaattgtttcattgttgcagagactctgtaccatttcccctttcccccaatccctggtaacctctatgaatttgcctgttccgcatattttatttaagtggaattccacaatttttgtccttttgtatctggcttgtttcacttaaaaatgtttccaaggtttatttatattgtaacatgtatcagaactccattttttttttttttttttttttgagacagaatcttgctctgttgcccagcctggagtgcagtggcagaatctcggctcactgcaagctccacctcccgggttcacgccattctcctgcctcagcctccccagtagctgggactacaggcgcctgtcaccacgcctggctaatttttgtatttttagtagagacggggtttcaccgtgttagccaggatggtctcgatctcctgaccccatgatccacccgccttggcctcccaaactgctgggattacagacgtgagccactgcacctggcatgaagtccattttttatggctgtgtaatattccactatatgtatataccacattttttgattcatctgttagtggacatttgacttgttttcacattttggctattgtgaatactgctgcagtgagcattggcatttgagtttctttttttagttcttttgaatatatacctaggagtgaattggtgggttatatgctaatactctgtttagctttgtgaggaacttccatactgttttccatagtggttgcaccattctacattcccgttagcaatgtacaggagttatttatttttccacatccttgcccagcacacttatttgccacactatgtgtatctgtaaattaccatgaaagcaccacaagctgtaattttttaattttgggattacaaataagttttagtgagcaggcagacttgcaaataaagttatcagtgaagtgaggatcaactatatctaaatgcaaatcatatatatgcattgtgactataacatgttatatgaatacacatagtgtacacctaggtttttacatttctaggtgattttagtgagttgaagtgagcatagtgtcacaatgaggaaacaatagcaggtcattaattttataattaggtaaacctaaaaattcagctatatgttataattttttcagtggtattgtacatgctttcaccaaagattagcataaattatgctccttttttcgaatttctaatagctttttgataaggttttttaaaaataaaaaatcttataaaatgctaatctttaattttcataccagtgtttttagtacgtattcaagtagcaacctttttacctacatagctttaaggttgatggtggggagtgggattttttaaaaataatttcgtttgccaaaaaatgcttattttaattttttttcccaactcctaatccagatctcttgcagctaattaaaaaacttgtaaactctcagcggggcaatgactcatacttgtaatcccagcactttgaaaggtcaaagtgggaggatcgcttgaacccaggtttgagaccagcctgggcaacatagtgagacctgtctctacaaaaaatacaaaaattagccaggcatgctggcatgcacctatagtcccagctacttgggatgctgaggcaggaggatagcttgagcccagaatgttcaggatgcagtgaaccaaggttgtgccagtgcactgcagcctggacaacagcatgagaccctgtctccaaatcaaaaaaataaaaacaaaaaaaacttgtaaacacgatatgaaccatttctgttcaagtccaacagtatatgtctgaggatcataagaatatagcccgtgcttaactgtttaaaatgttaagattgaaaagcattattgttaaactcaaacactggtggaattgtttcataaattttgatatgtctacatgtagaacattatacaattatgactattcagtaagaactcaagtgcaagaaacatgaatggttagaaataacactgaaatgtctattttagttacataaaagttttcagcagtaagtagatattgcttttataattagaacaagtttgataaatacattatgtggaaagcattttgccttctgttctacttaagattgaggtaatatgattatattaagatagcagttgatgtctttgttttcaactttgtttccaatacagttattttctttttctttttagagatgctaactttgtttttctctgactttgtttttattcttctatctgatgatttccaaaagaacaacgaaaccaactcctcatttagatgggtaaatattattttatttattttacaacctgttttaaattaaccttgaaataaaaagcttttatttaataattttttacttgacactttaggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaaggtaaaaaggaagtacatatttctgagaatacttacacatacaaaataagcagagatactctaaatagttgacatgaaattcatactcaagctgaaagaaaaatgaggtttttgttttaaaatgtatttctgtgcttttattttttacttttttaagttgacaaaacttgtgtatacttactgtgaacaatatgatgttttgaagtatgtatatgttgtggaatggctaaattgagctaattaacatttattgcctcacataattacccctttttgtggtgagaagaacacttaaaatcttagtggttttgggttttttttttgttgtttgtttgtttgttttgagacagagtctcactctgtcacccaggctggagtgcagtggcatgatcttggctcactgcaacctccgtctcccgggttgaagcaattctcctgccttagcctcccaagtagctgggactacaagcgcccaccaccacacccagctaacttctgtatttttagtggagatggggtttcaccatattggccaggctggtctcgaactcctgactttgtgatccgcctgccttggccccccaaagtgctgggattacaggtgtgagccactgcacctggccagtgattttcaagaatacagtacattgttattagctatagtcatcatgttatacagtagaattcttgaactcattcctctgagctaactgaaattttatatcctttaccaacatttgtccaacacatttccttctctaatcccatgggaaccaccattcttctctgtacttctgtgacttcaacgtttttagattccacatgtaagtgagttcacatggtattcgtccttttgtgcctggcctatttcatataacataacttcctctgggttcattcatgttgctccagatgacaggctgaatagtattccattgtgtatataaaccacatttttaaaaaatccgttcatctgttggtggaaacaggttgattcagtatcttagctattgtgaataatgcagcagtgaacatgagagtgagatatctcttcaacacactgatctcatttcctttggatatatacccagtagtgggatttctggatcatatagaagttctatttttaattttattattatactttaagttctgggatacatgtgcagaacatgccggtttattacataggtatacacatgccatggtgatttgctgaacccatcagcccgtcatctacattaggtatttctgctaatgctatccctcccctagaccccctacctgcagacagaccctggtgtgtggtgttcctctccgtgtgtacatgtgttctcattgttcaacttccacttttgagtgagaacatgcagtgtttggttttctgttcctgtgttagtttgctgagaatgatggtttccagcttaatccatgtccctgaaaaggacatgaactcatccttttttatggctgcatagtattccatggtgtatatgtgccacattttctttatcctgtctatcattgatgggcatatgggttggttccaggtctttgtattttgaatagtgctgcagtaaacatatgtgtgcatgtgtctttatagaagaatgatttataatcttttgggtatatacctagtaatgggattgctgtgccaaatggtatttctggttctagatccttgaggaatcgccacactgtcttctacaatggttgaactagttcagattgctaccatctgtattacagtgtccttatgtgtctacgtcgtctcgcgtcatctgtggtcgcctgactttttaagcatgactctaatgggcgtgagatgtgtatctcattgggtgttttgattgtcatgctcggagttacctgtgatgatgagcgttactctggtcgtgtgtgtggggactagattgtctcctgtggtgaggtttctggtcgtatgctttgtgcgattgctcgattggcttggcatgatgatgttctgtcggtctgtggaatgtttgttatagattctttgttagtatctttttgtctgtgtggattgtttgcttttatttttgtccagttctttaggtcggctggttgctttcttgggtcattgttcgtttgtcgttggcgaatttggttgtattttttgtttatagttctattttgtgagcttgtgttgctggtgcgttttctattgtcctttggtgttctcttttctcggtaatttttgtgttttgtggttggtgtgttttctttctgtttattgtgatggttcttgttattggnnnnnnnnnnnnnnnnnnnnagcaaaaatgttctcccattctataggttgcctgttcactctgatgatagtttcttttgctgtgcagaagctctttagtttaattaaatcccatttgtcaattttggcttttgttgccattgtttttggtgttttagtcatgaattctttgcccatgcctgtgtcctgaatggtattgcctaggttttattctagggtttttatggttttaggtcttatgtttaagtctttaatctatctcttgagttaatttttgtgttaatttttgtataaggtgtaaggaaggggtccagtttcagttttctgcatatggctagccagtttcctaacaccatttactaaataggaatcctttccctatttcttgtttttgtcaggtttgtcaaagatcagatggttgtagatgtgtggcgttatttctgaggcctctgttctgttccattggtctatatatccattttggtaccagtaccatgctgttttggttactgtagccttgcagtatagtttgaagtcaggtagtatgatgcctccaactttgttccttttccttaggattgtcttggctatacaggctcttttttggttccatatgaaatttaaagcagtttttttctgattctgtgaagaaagtcagttgtagcttgatggagatagcattgaatctataaattactttgggcagtatggccatttttacgatattgattctccctatccatgagcatggaatgtttttccatttgtgtcctctcttatttccttgagcagtggtttgtagttctccttgaagaggtccttcacatcccgtgtaagttgtgttcctaggttttttattctctttgtagcaattgagaatgggagttcactcatgatttgactctctgtctgttattggtgtataggaatgcttgtgatttttgcacattgattttgtatccggagactttgctgaagttgcttatcagcttaaggagatatggggctgagacgatggggttttctaaatatacaatcatgtcatctgcaaacagagacaatttgacttcctctcttcctatgtgaataccctttatttctttctcttgcctgattgccctggccagaactttcaatactatgttgaatagaagaggtgagagtgggcatccttgtcttgtgccagttttcaaagggaacgcttccagcttttgtccattcagtatgtattagctgtgggtttgtcataaatagttcttattattttgagatgtgttccctcaatacctagtttattgagagtttttagcatgaagagctgttgaattttatcaaaggccttttccacatctattgagataattgtgtggtttttgtcactggttctgtttatgtgatagattacgtttattgatttatgtatgttgaaccattcttgcatcccagaggtgaagctgacttaatcgtggtggataagctttctgatgtgctgctggatttgatttgccagtattttattgaggattttcccatcaatgttcatcagggatattggcctgaaattttctttttttgttgtgtctctgccaggctttggtatcaggatgatgctggcctcataaaatgagttagggaggagtccccctttttctattgtttggaatagtttcagaaggaatggtaccagctcctctttgtacctctggtagaatttagctgtgaatccatctggtcctgggctttttttggttggtagtctgttaattactgcctcaatttcagcacttgttattggtctattcagggattcgacttcttcctggtttagtcttggaagggtgtatgtgtctaggaatttatccatttcttctagattttctagtgtatttgtgtagaggtgttcatagtattctctgatggtagtctgtatttctatgggatcagtggtgatctcccctttatcattttttattgtgtctatttgattcttctctcttttcttctttgtctggctagcagacatctggccagaatctattttgttaaacttttcaaaagaccagcttctggattcattgattttttttttttttaaagggttttttgtttctcttatttccttcggttctgctctgatcttaggtatttctcatcttctgctagcttctgctagcttttgaaatttgtttgctcttgcttctctagttcttttaattgtgatgttagggtgtccattttagatctttcctgctttctcttgtgggcatttagtgctataaatttccctcgaaacactactttagctgtgtcccagagattctggtacgttgtgtctttgttctcattggtttcaaagaacttaaaataatttcgttatttacccagtagtcatttaggagcaggttgttcggtttccatgtaattgtgcggttttgagtgagtttcttaatcttgagttccaatttgattgcactgtggtctgagagacttgactgttaggatttccattcttttgcacttgatgaggagtgttttacttccaattatgtggtcaattttagaataagtgcaatgtggtgctgagaagaatgtatattctgttgatttggggtggagagttctgtagatgtctattaggtccacttggaccagagctgagttgaaatcctgaatatccttgttaattttctgtctcattgatctgtctaatattgacagtggggtgttaaagtctcccattattattgtgtgggagtctaagtctctttgtaggtctctaagaacttgctttatgaatctgggtgctcctgtattggtgcatatatattgaggatagttagctcttcttattgcattaatccctttaccattatgtaatgccctctttctgtttttgattttttgaggagacttcattcggttttctaataatggctgtaccgatttacattcccaccaacagtttacaagagtgtccttttcttcacatcctctcccttgttttcttttttttttataatagccattgtaacaggtgtgaagtgctatctcagtgtagttttaatttgcattcctttgatgtttagtgacattgagcatttttgccatatacctgttggccatttgtatgtcttcgtttgagaaatatctcttcagattcttttcccatttttaaatcaggttgttttcttgctgatgagttgtttgcattccttatatattttggatattaacccattgtcagatgtatggtttgcaaatattttctcccattccagaggttgtatcttcactctgttgattgtttctttggctgtgcagaaccctgttagtttgatgttatcccatttgtcttatttttgctttttgttgcctgtggttttggggtcatatccagaaaaatcactgcccaaaccaatgtcatggagctttttccgtgtgttttcttttagtggttttacagttgcaagtcttatgtttaagtcattaaaccatttttagttgatttttatatgcattataagggtctgattttatttttttacatgtggatatctagttgttccaacaccgtttattgaagagactgtcctttccccattgtgtgttcttggcaattttgtttttttaactgttttatcctacttctcattttcttcatttaccatgaagtcagttaactttttctgattattaatttgcaataatttgcccttttgcttccactgagtttttgttgttgttgttttttgtttgttttttaactgtagttgtctaaataacctagtaaataaatactctggaggaagagactctggggctagatggcaattcaagagaggaagatagattaggaaactttaagggaataaattattttttctttaagcactacttagattcagaagcatccaacatgtttgagaaacttcttttatttagacgagaccatttgatgctgacatgactaatttgatatattgtctgaaatggtaagaactttaaatattttaagtctttatatttgaaatatgtggctgatactattttattacagataatgggcttgacattctaaaagtaatggagtgagattaccttcaaacctgtatagaaagtagtaaaaccttaaactgactctgttcttactaatctagggaataataatatcagtaattagtttcttagagttagcacatgtgagagtcatctgtaatgctttctgattctcacagtaactctatagtattacatatccctattttacagacaaagatagtcaagaagattaagttctttactgtgtcaggaaaagagacctcaaacccaagttcgagaattagaactttttctgttatatgttactgactcattaaagtttaaatgtccttaaaatttcttaagaattgccctaagtagatgattctcatctcaccttctaggtacactgatttcctctataatatttagaaacaggtacattttgttttgttttaattttaaaacatccgagatgggcatggagaaggcaaaatgattatttaaaaaaattttttttgtctgcattccattttgagtctgctaattttattttcttccatgtgatgtcaaataaatattcacaggtaagttattgcaataaattattgcagatgtatgcttcagctcatgggatttcttgatgtacatgagactggctatccttatttacaaacaacaggtgtaatgtatgccttttttcttgaagattcagtaaaaaacaagatgttgagaatctttgagtaatattctacaaatccaattatttacattaaaaaatactaaaaataaaaaaaatctgtaatgatgtttgttactctaaaccctgaacctactgatgtttaaactttagagtgtttttagtacagtaggaatattttaggttaaggcattattcttcccaagtcatctagaaaatcttcatcatttattctctacttgacaactaattttttttttttttaatattttagtctttaaggacacttgtattaggatctgttgcctccttataaaagttaagtggccaggcacggtggctgacacctgtaatcccagcactttgtgagactgaagcaggaggatcgcttgagcccaggagtttcagaccagcctgggcaacattgtgggactcttctctaccaaaaaaaaaaaaaatttttttttaattaaccatgtgtagtccctgctacttgggaggctgaggcaggaggatcacttgagcccaggagttgaaggctatagcctgggtgacacaacaaggccccatctctaaaaaatatataaataaataaagttaaggatgctgcgtggtttatatgttcagaaagagattgaggtaataaaagagtttttggccaggctctggcttacgcctgtaatcccaacaccttgggaggccgaggtggacggatcacttgaggtcaggaggtcgagaccagcctggccaacatggtgaaaccctgtctctactaaaaataaaaaaaaagaagtttgcattttaaaccataaacagtagtcatagactctctaataaatttgttgtaaagattcttttggtactaaaagggcagtacttgaatatttgcctaaaggaggaagtaaatgaatgtagctctttatatattacttacatctttataatgcattgtcatctgaagaaataaatgatggttttgcccatgccattggggccaggaagttgtgctaaaagttgatgtaacatccaactgtatgtccctcaaactcatgctaacctagcataccttgcccttatcagtttcagcaatctgagatttggccctttattaatatgtatctgcccaggagtttctaaaaggtcagatttgttttgagccagacttccaatggctactctgttctgaatcacactgtgaaaagaggaaaagatctttagtttgaaaacacacacttgggcccctgttattccataatccttcagttaccattcagaacattggtcagagtagattttgtcatgcatcttatatataagcagagctatatcttacatccacttagtaagtttgatggccttcttaattaattgggaacagtcaaaaagcattgtaacactgtggtatttatcatcattatatttaaaaccttgtatgagagatttacacctgttttttttaacttcctgaaagaaaacaaaaagacttctgaagaaatctgacagtcttggtccatctatatgtgttcttggggagtctgggcaatcaatcttcctgggcctttctctctttgcaattttgagattggagatccttctttttgtgactatttgagtgtgccagagaaaattcaaagtcaaggagaaaaaccttccagcagatgcagagatggaacactggaagctaataaaagctgcatcccctgtagaggctcagcaaagggctgtcaaaagtcagagtggaggatagaacacagaccagtaccttgattaagatatttcctagtttttcaggagctgacgtgacctcagatcatgctgttcaattcagagttcactgcagttgttaacccatttatgccggaggttgcaagttttttgtgtgaaaaatcagatcttggcaatgaccttgagaagtaggatatacataactcccacaagcttagcgtaccaataatgaaactaagagatgagaggattgctatgttacatagtacacagaaacacaagaacagagttgtggcaacatggcggtaagtagttgtatgagaagaaatgggaggaggcagattgcctgacaatacagaacaaatagcacaatagaggaagcagctggtgaatcttgtactcaggagacaagtgaagaggaacactagagattcatttctatggtgacagggtcccatttcagtgtccttattctgaaagtaattttggcacttttattggaaaatagtgagatgttaaacttagaaacggtttaggagatgcaacccataatgtgaaatgaaattgtctaaagaccattttaggaatacttttgttctttatttcaaatcttattttgatggtgatttcagaatttccttcattttcaagatttcaagtgaaatttattggtgtaaaatctgtgggtctcaaataaaaaacaaagcagcattttgttaccttaggtttttacaaataaaatattctggagttatttctggttttgttttgtttttttgagactgtcttgctctgttgccaggctggagtgcagtggtgcagtcatagttcactgcaacctcgaactcctgggttcagtcaattctcccacctcagccttccaaatagctgggactacaggtgtgcattgccacacctggctaatttttgtatttttggtggagacaaggtctcgctatgttgcccaggcaggtctcaaattcctggttcaagcgatccttctaacttgacctcccaaagtgctgggattacaggtatgagctatggaatttggtttttaaccttaatattatactagtaagttaaatgactaattgataaggttacatcacaccatacccccaagtaaaggtcagtgaagaagtttgggaaatcattatacttaataataagcaaactgcgtaatctaaactaattaaccagaaatggcccaagttgaaagtgttattactctttgtaattctttttcatccattatgattcttaacttgcattgtggtttttgcttttagtgctatttcattttaccttaacgatacttacatgccattaaaagaaacgctgaaatcaattttgtgtaagtagttaggaagtagggttttgtttgtttgtttttgagatggagtctcgctctgtcacccaggctggagtgcagtggtgcgttctcggctcactgcaagctccacctccctggttcacgcgattctcctgcctcagcctcctgagtagctaggactacaggcgcccaccaccacgcccggctaatttctttttgtatttttagtagagatggggtttcaccatgttagccaggatggtcttgatcttctgacttcgtgatccgcccacctcggcctcccagagtgctgggattacaggcatgagccaccgcgcccagccggaagtaggttttttgaagagtcagctgaaaacaactgttgccgtattcggaatttaaaattttaatttgaaaatattataactgagaaattattgtatatatttatggtatacagcgtgatgttatgatacatgtatacaatgcagaatgattaaatcaagctatttaacatagctgtcacctcaaatactatttttgtggtcagaaatttgaaatttattatctcaggaattttgaaatgtacaatacattattattaactgttctcaccatgctatgaaaatagatctcaacaaacttattcttcctgtcttaactgaaactttgtaccctagttttaaaaatttaatacatttatttggttcgaaattcagaaagtataaaatgataatctgtgaaaatctctttccatgagtttccattctcacattttgtacattattccacgtgtgtgtgaatgttgatcttgtagaatgaatttcctagaaatggaattgccagtttgcagaggtcatgcatttgtaatttggtagacactgctaccagaatataagaggataagttgccctacaccctgtataaaactacgtattattgtaaactctttcacctttgccagcctaatggattttttttttaacaaatgctagtttcaattagcatttctctgaggagtgtgatgttagtgtctccttaagagctatttatgtttctttttatatgaaccgattgttgattcctttaccgcctattatttaccattcttttattcttcctttctgaagttcaagcctcctcctgctatttcctttctctttggagaacttcctttaaccaatttttttttttaaggttaggtctactggtgacaaaattattctagttttctgaaaatgtctttatttcatcagggtttaggggatggtttcaggatgaaactgttccacctcagatcatcaggcataagcgtttaataaggagtgctcagcctagatccctcgtatgcacagttcacaatagggtttgtgctcctctgaaaatctaatgctgtcactgatctgacaggaggtggagctccagtggtaaggcttgcttgcctgccactcaccttctgctgtgtgacctggttcctaacaggccacggatcagtaccagggaccatggctcttcatctccatgttctgacattatgttgactatgtatattggtatactgttcagttaaataatacttgtgactttgagaaggatacagtttcaatcatattctcaatatgccttaatcatattttaaaatttaggttaacacacattctgaaactcaagccacagtcttacagaatcaatattgatattgtgatatctcccaattttttgcctttttacccttctgtcctttaatgccatctctttctcaattattttctctcattttttttctgagcagacttatacaaaaaggaacataaattaaatttgccaaatatcaaaagagaggaactttttattttttatttttttggaacggagtctcaatctgtctcccaggctggagtgcagtgacgcaatctcagctcactgcaacctccgcctcccagttcaagagattctctgcctcagcctcccgagtagctgggattacaggtaccctctaccatactcagctaatttttgtatttttagtagagactggttcaccatgtgggccaggctggtctcgaactcctgacttcaggtgttctgcctgctttggccttccaaagtgctgggattataggcgtgagccaccactctccactgaactttttaatcttagagcttttttatttgttaaatcaggacggagtctcactctgttgcccaggctggagtgcagtggtgcaatctcggctcactgcaacctctgcctcctaggttcaagtgattctcatgccttagccttctgagtagctggaactacaggcgcccatcaccatgcctggttaatttttgtatctctagtggaggcggggtttcaccatgttggccaggctggtctcgaacccctggcttcaagtgatctgcctgctttggtgtcccaaagtgctaggattacaggtgtgagccaccaccatgcctggcctattttcctcttatagttaatgttttctgattctcgggcagattatattcctataaaaacagttataaatctctttctggccttccatttcatttatttactttgaggaggagtcttgctttgtctcccaggctggattgcagtggtgcaatcttggcttactgcaatctccacctttggggttcaagcgattctcgtacctcagcctccctagtagctgggattatgcgtgtgcaccaccacacttggctaatttttgtatttttagtagagacagttttgccatgttggccaggctggtctcgaactcctgacctcaaccgatccactagccttggcctcccaaagtggtgggattacaggcatgagccactgcacccagacttttcattttatcatgttatcttgcttcactagaatgttttcttcaaaagtgatatgtaaattaaataattgtttatgaaatgtatttaatacacttggtaagtgggcttgctgttgtgtggtatggtgttttgttgttgttgttttggagacaggttctcactctgttccccaggctagaatgcagtggtgcgatcatggctcactgcagcctcgacctcccaggcttaagtgattctccctgctcagcctcccaaagtgctggaattacaggcgtgagaagccatgcccctagccagtgggcttgctttttttttttttttttttttaatttcaaacactaaatgggcttgcttttaaagtaaatcaactgtgatgtatttctcataggaaagaatctcagtgcaaaataaatagaaatcagactggtgattaaagcttttttaattgtggggtaaagagttaccatattttaacaagtatattttatgtttaagtgtagtatttttattttgcttgcacaattttatgtttttatttcattgtgaatttattttctgtgttagatttccttaaaatttgattttttccccctgcatatccctcaggtttattagtttagcatatataagtagatttttcaggttatatgttttttcatacccactctgtctcaccagcagcataggtattggattcaggttaacagttgggctcgtgagacaaaattagcttcaccaggcactaaggttacttacccttaagaaaggatatagggcaggaaacggcatggctggtacatcaacagcatagaggcgctgtcatgatttccaggcacagcttgcgtatatcccaaacatctcacacttgataatatacctgttccttagaaacataactgggtaaggaaggattatcttagttcagtgaagccattacatctacggtctcttcagcttttataccttgttcccattctcaagtgcagcaacatctcatcagtactggaaaagcagtctgcacagtgaaccagaagtccttggtcaagtacaagtaacttcagccagattttcatgtatcttgggtttagtatattcctgtaaattatcagttacaaatttcaaggatgattcaggcgcagcagcacatgtgcctgtagtcctagctactcaggagactgagagaaagaggattactagagcccaggagtttgaggccagcctgtgcaacatagcaagaccccatcttcataaataaacaaggttaggcatggtagcccacacctgtaatcccaacacttacggaggttgagacaggaagatcccttgagcccaggagttcgagactagcctaggcaacatggggagaacttgtctctacaaaaataaaaattaaaaaaattagcagggcatggtggcatacacctgtgtttccagttactcaggaggccgagacagaagtatcacttgagcccggaaggtcaagactgcagtgagctatggtctgcactctagcctgggcaacagagcaagaccctgtctccaaaaaaaaatccaaaaaaaaaaaaaaaaaggcaaggataaattttccaaataccaaatcttcagatgttcctgaggctaaggtggggctaaaggaaaggtcgcaaatcagctgttaaccctttcaactaaggttctgtaaccaaacaaccaacagataatccaaagaatatattttctttgttttccttgactttttattgtggaacatactaatttatacacaagtgaataaaataatataacactttttctttagctagcttcaggagtttatttatggccaatcttgttttacccatcactagccacttttccctttcctattattttgaaacaaattccaggcataatattttatcaataaatgttatttctaaaagatgattcttaaaaacagtaccataatgatacacacatacacattcctaaatactaaaaatcctgacagtgttcagattgtaattgtttcattaatgttaattaattttttgctgtgtgaatcaatccaaatgaagttcagacattgaaattggtcttgtaagttgtgttttgtttcttaataaattccctcaccatcttgttttatgtttccttgaaatgtatttctcagaaaaggtaggtcatttgtcatgtagcattttctataattgaacatactggattttactaattgagtccttactgtgttatgtaatgttgatcagatgcagttgtgacttgaaattccttttaatgaaaacaggagtcacacaggacaagttgtctctgtgttttgcagcagccatgggttatcagtgcctcacaagaagttgtaaaacgatattttaacactataatttctttttcatttattcctggaatgcttctgacaaagagctatttcccttcatccatttcattagccagtggtgcagtttgtaccacaaaggcaagataaatgctttatactttatgagtatcactgtgaactaatgtatttctaatataatctgatatatctcaatttattgtagttctcatgtatatatcaatattgtcccatctttggccccagttagcctcttcaaatccaccatgatttgaatgagtatacctttagatgggtcaagctcctcccaatttgtagtatcttcttctaattcttgttatgttacaccttctagcttcacttatttatattaattgatcctttaaactctgagttttttttttttaccctttttaaagttactgcttccttaactgaaataaaatttcaatttaaaatgactttttgtagagtccccaaaacattctattcatcatgggcaattgacttccctctgttatgagtctcctcttgagctaaatttcttaattattagaagactgcttgggcactgaaatataagcccatgccagtgaaatccatttcttatctctccatgttgctgtaaagcagtttttctgttatttccctgcactagttctgccaatcttgataataagagggaaagtggaaaactacaagattagaacatgggactcttcattgttattctgtgcttttaaaaaaatttcttattcagatgtttgttaacattagtttagcattttagactcacctattttttaaagttctttggattaatagataaaactttgaccagtgaattctggagatctggactctaatcctgagtcttgactcctttcctgtacttcccagttcacatagctggatgatctaagtgctaaatactgaacttagtgagaatctgcagaaaatttaaatctccttccacaaagtttgtctaaaaattgttgatcaaaacctttttgtttttattaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagaggtcttaattttacttttctaatgctagctttatattctgatttcctttctgtaaatctgttaggattttgggtcaattatatgaaactgttaaaatagtgagaaatatagcatggagcgtaggacttttgatattccacagtctatagattaaattttgggtacgttcattttcttttgaaacaaaacctatcagttcatttttttgtgtactcaatgaaataatacagctttggtgttacagatttgtgtgttttataggaggattatgggatttatgaaaattgcagaaaaccaccagttgtttttcctattttcagtagcagtcccctttgctcttacgatagcataaggatagaaagcagataatgtcagtgtattttactttcttttccattttgcttgaaataatctgtgtttgtactaaaacttgtcttcatctgcctatggctcaaatgcagttaatttctttacccatgttttaaagtattttaaatttatcagagtgcattgctcacatagtttcatattttttatccattttgtaggaaaatattttttgagagtgtgataatcgaaacgttttgttttgtttgttttttgattggttagttggtttgtcagaggaatagaagatttttcccatgcgatcacatctttggtaaggacaggatgtttatattatagtgatataaaggaaagaaataccaacaattggatacttccgtaaggacataataaccaactgtaacttgttttgtgtgtttctgtctgttaagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtggtatgtgaatgtgtatattttgccttacatggtttaccatagaacttttctttttaaaaagttatttattttaaacaagatttaattggtgaccttgtcccaagattgaaatcttttttataaaatgttcttccgcaaagttcttttttgccaaccacataactagaaagggaaattgacttacattacaagtaggttctgaagtaaagttacacataataaacactaatacaaaaaagagatgttaagcagcattccaagccaataacaagatactctttaaccagtaaaacaagatagtgttttatagtgttatttgtgtacagtaaactcttaagcaagtaagaatcttggtttttcagtttgtctaataggaaaaactgctgttttccttacttggtttacaacattgtaataaaaatggatgtcatgttcaaatcctgaaaaaagtttactacataaatctacattattaatatctgtaatgctaatggttctttatcagtcattttaataactatgtccaggctgggcgcagtcgtcacgcctgtaatcccagcactttgggaggctgaggcgggcagatcacgaggtcaggagatggagaccatcctggctaacatggtgaaaccccatctctactaaaaatacaaaaaattagccgggtgtggtggcgggtgcctgtagtcccagctactcaggaggctgaggcaggagaatggcataagtaaacctgggaggcggagcttgcagtgagccgagatcacggcactgcactccagcctgggtgacagagtgagactccgtctcaaaaataataataataataataataataactatgtccaaaagtagaaaaaggaatattgaaatatttttcttagttatgatcagaaatacattgtcataatacaagtaataaaattcttggccaggcatagtggctcacacctataatcccagcactttgnnnnnnnnnnnnnnnnnnnnccagcactttgggaggccaaggtgggcagatcacttgagccaccatgcccagctaattttttgtatttttagtagagactgggttttactgtgttagccaggatggtctccatctcctgacctcatgatccgcccacctcggcctcccaaagtgctgggattacaggcatgagccaccgcacccggcccagattcatttttattaaagtaacatgtctggccaacaaaagtttttaaaaaaatgtgttaactttctgtttgcttccttctagtaatccacctaactcccagcctgcttcataccagagacgacttttagttactagatctggcaggaaaattaaaggaagaggaccaagggtaggtgattctttccccagagatcttcacaatattgcatttgtcttccttaaataattttagggtgtttcttaaatattattttaatgtgcaagtaactaaaatttaggggagatgcaggcattgaattatatattctctttcttaagcagcttctgtatgttggtacttcccaacagaaaatccatgagatatgaatagattttacatttacatggtataaaatgggatcgaggtctttcttgtctcccgtgtttcttggcaatcactgtatctctattcttgttaaaaataaataaaaattaaccctattcttgtattttattctttttttatttactagagtgtcctcatcagaatttaaatatcttgtgctttcaaaactttatagaaacttggctatactttcctgtcttatgtcttcacttcctacttattcctcaagcattttagttgtcttccactaccgttgttctgctgaaaacagcacttgatacataatcagctccatgtcacaaattccagtggattcttttcagtcttcatcttacttaatcttgctccttgtaatattctttccaccccccctttttttttttgagatggagtctcagtttgttgcccagactggagtgcagtggcatgatctcggctcactttaacctctgcctcccaggttcaagcagtcctgcctcagctccccctagtagctgggattacaggcacatgccaccatgcccggctaatttttgtatttttagtagatacaaggtttcaccatgttggccaggctggtctcaaaactcctgacctcaggtgatccacctgcctgagacagggtctcattttcacccaggctggagtgcagtggtacaatcaaggatcactgcagcctcaaccttccagtctcaagcaatcctcccacctcaccctcccaagtagctgggactacaggtgtgcatcaccacatctggctaatttttgtatttttttgtaaaaatggggtttcgtcatgttgcccagactggtcttgaactcctgagctcaagcgatctgcctgcctcagcctcccaaagtcctagaattacaggcgtgagccaccgtgtccacccatttacctaacctttaaatactgtagtacctcagggttcccattcaaatcttctcacactgcatatactccttgagcaatctcatgactcccatggctggtaactgtcaaatttttatcggcatttttcagctccaaagactcatttgactaatgagtacctcaaacttggcttttacaaagttgagcacaagctcttcctcttcaaatctgaaccttctttaggttactgattttagtgacgggcaccaccacctgtgcagttccttcccaagaataatctgattctcccctttcagtttataccttaactatgcaagtaacttaactatggtaagatacatgaatatatcttacccatcaccgaatactgtcatttctgcctcctaaatattcagaaattcatgtgtttcaagctttacccctgccatgttaattcaactccatcatattgtctgagctgtaaattttgatagttctcaatttttttaaatctcagtacctctttcatgttaaaaattactgaggacccaaaagaacttctgttggtgtgggttatatctatcaatatttactctttcaggaattagtactgagaaatacttgaaacataagaatatataagcacacattccattagctgtgaaagtaatgatatcaaaacatgtaaactgaataacactattgtatgataataatgaaaatggaacaggcaaatattgtgatattattatgaaaatagttttgaccccgagtctttagatcctagatcccactttgagattcactgtctgatcttttttttaaaatagtagccagaattgtcatttaaaaatgaaagtctgatttttgtgccactcctttaccattgatcttagggtaaatccaaaataactacaatgacctatgacactacacaaaacctagtccttgcttacctcatcaatgttatgtagtactactttcccttgcagtttttagatttggccatgtttggtctgtcttctcatcatttctaaagcatgctatgtttcttcttaactcagaaccttcctgtcagcatcttttcccttttccttttatacccattctattatagctgcatatatgtttaacatatgtgattatatgttcattcacatgctctccaagtcctgtagaatatgagttccaggaaagcacactcatatatcttggctcactaatgttctctcagtatgtaataagagtgtttggtcatcctaagggttgaataagtgaacatctacacatttactctgttttccccataatatgagaaatatttgctttgaaacattaagtatatataacatttagattggaacttggcaacttatgagttgctctagcattacttggttaggactcttccatggagaagacgtatggctagcagctaaagtttttgtgattaatgtttcttggaatttgcaacatgacaacttaagtttctctgcctcattgatttcctatatgaaaattgggaaattttagtaattttcagggtatagaaatatcagacgttttattttaacctggaaacatatacttttaagctactgtttcaatgctttttatattttttttattttgtaccccttactacctcctgaccctcaccccagtacttccctccctcccagcacccatgcgagtccctctatacttctgtacattaatttttccccattttaattttctttagcgttatcgaactccttccagatccagatcaagggatcgtttcagacgtagtgagactcctccacattggaggcaagagatgcagagagctcaaagaatgagggtatcaagtggtgaaagatggatcaagggggataagtaagatttaactattattatttcaaatgtaatgataagtgtttgcttttactattatacataaagttattgtcattttagttattgctgaataccttaagaaaagtagaatatcattttagctaataatatctacagttcttttcctaataacatttccccaattctttttcttattttttaggagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagaagacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacgatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaacactttggtgtagtactgtgtgctgtgtttaactattttatgtatgcattactgtgttgcaacaattagccaatagcatcctaatttgtttagtcagccatttggaatggttgcaatgcattgttgcaaaagcttgtgtttctcatgattaaagtaactttagaagccactagaagacatcttgtatagattttctgattgcgttataaatagaggtttgcagcggtttcttttaattacacagaagcagggtcctaataacctgagatcttaaatcatcacttttgattttatagtaatttgtgctttaaaatagatgtatttatattgcacttcatactctattctttatagttcgagccatagcttgtttcctattaatgcttttcctgtctagttgtgttttacttaactgcctataaaaatcgtaagagtaatttttttcagttgatgtactgattgagcttgagttgctgttatacagcatttgacaggaactataccttggaaaatcagattgtgattctcagttctgtgttgcttttggtttgaagagttttgggaacgttttaattattaattacccttctctaaactttaaaaaaaaaaaagcttttctcattaaaacataccatttgtgcaggtccttaagctatacagattctaaaaattgttagtattgagacattaacttctaagatttctcttttttggcctccaacctatatagaattgagtgttaactctgcatggattttgtttgttttaattgaactgacttctctaactctcatagctgtgagttccaaatggcaagaaaatgcatcttttctatatatgtatcacgataggctatagcatgtttatgactctggtttctttctcttcaggtggttttataccattactgttaatgttattttaacttggcatgtataacattgccatatagagtagagtagaaagttgcaaattttgatagtttacagagttaaacactaaacatatccaaagtccatttagagttttgggtgttgtattttgccatttttgtgatgtgtggccttttattctgtaatctcttctaaataaaacattgaacatccagcaaacataaaacctgcctcatttgaaaaggaatttcaaaattccaattaataggattctctagagagttttgtactttaatatttgtcagtgtagtgtcaactctgttaccaaggtagcttcttggtaaatccagtagctactcaatgctatttgtactgaataaagcaattattaacatgatacttcccactattgattaatgcaatattgatatatttggcgttgtggtagctgttgcagaatgaatagtgtaatgaccataagattgcttggaaaattgtaatacagatatccacaatgaattctttccaaaatttttttttccgatgataaaagtagtagatgtttattataaaatccaaggtgattgattccttagagactgaccacaaacccacattagggataattgagtctgagtgcccaagctatataacgttatgtagtttaagcaagttattgtttgtcttaatttcagttaactgcattttaaaattgttgttataaactatttgagctttaagaaaggtgctatttaagaaaggatttctaataacagttaaatatttttttaagtccatgctaagtaaaaattcttacatgttgtctgatcccagagctttatctactaaaaattatacataaggatttccaaatcttagagtttcaaaaagtaaccatagggaaaaaaattgtagtaatttctataggcaatattctgtttgggttatcaaaagagcaactccatgctccgcattatttatagtccttattttaaagttttattagctctctttacagaacagatgtgaaggagttgagaggacaatcaactagattttatttttagaatataaagaacatttttaaaatgattaaacagcattaactgtacct

SEQ ID NO: 17001 - DNA, 22605 bp, Human
  misc_feature (1)...(22605): n = A,T,C or G
tggctgttagattatttttccacagttttcagaagtggatgaggccattagaatcttgagtattgcccatttccttatgtgtgcctttgactatagataaaatagatgcatgacaattatttataagttgattgatttttcttgtcatttaaatcatcttgaataatagagttggtagagctatcccatttttgaaattattttgttttgtcaataactttttgttaccagcatgtacacttgcattgttgactctccatataatacctttaaaaaaattttttttgtggtaaaatatgcataacataaagtttaccatggtagttttctttcatttgttttgtttttgtttttttgagatggagccttgctctgttgccaggctggagtgcagtggagcgatcttggctcactgcaacctccgcctcccgggttcaagcaattcccctgcctcagcctcctgagtagctgggactacaggcgcccgccaccacgcccggctaatattttgtattttaatagagatggggtttcaccatgttggccaggatgttcttgatctcctgacctcatgatccgcccacctcggcctcccaaagtgttgggattgcaagtgtgagccaccgcgcctagaccatggtagttaattttaagtgttcaattcagtgaccttaagtgtgttcataatgttgtgcaaccatcaccatgttgtctaaccattagcactatctgttttgagaacttttttttatcatcccaaattagaattctgtacctgtcaaatagtccccagtaatcctccctcccccagcccctggtaatctgtagtctacttttcgtctttttgaatttgcctattttaggttcctcatataagtggaattatgtggtatttgtccttttgtgttggcttacttcatttagcataatgttttcaaggttcatctgtgttgtagcatgtatatacaggttgaagcatccgttatccaaaatgcttgtgaccagaagtggtttggatttcagattttttttttggattttggaatattcatagatacttaactggttcagcatccctcgtccaaaaatccaaaatcagatggagctcagtggctcatgcttgtaatcccaacacgttgggtggccaaggcaggaggatcgcttgagcccaggagttcaaccagcctgagcaacacaagaccctatctctccaaaaaaaaaaaaaaaaaaaaaaaagatgaaagaaaaaaaaatccaaaatcaaatgctccagtgagcatttccttttagcatcatgtcaggctctaaaagttacaggttttggagcattttggatttcagatttttggattaacctgcattaatgctcaacctatatgaaattttattcctttttatggctgaataatgttccactgtatgtatatactacattttgtttatccattcatctgttaacagacacttaagttatttccacattttgggtattataaatagtgctgctgcgaacattggtgtacatgtatctgtttgagtccctgtttttagttattttggttatatacctaggaatggaattgctgatcatatggtaattctgtgtttaactttttgaggaactaccactgttttccacaatggcatcaccattttacattcccaccagcaatgcacaaagatttcagtgtctgtatccttgctaacacttattttccattttttgagtttttttgttttgtttttttaataatagccaatcctaatgggtatgtggtagcatctcatggttttgattttattttcctgactattgatgatgttgagcatcttttcaggtgcttagtggccatttgtccgtcatctttggagcaggaacaatgtcttttcaagtcctttgcccatttttaaattgaattttttgttgttgagttgtatataacaccttttttgaagtaaaaggtgcactgtaataatccagactgtgtttctcccttctcaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattataggtgggtttaaattgaatataataagctgacattaaggagtaattatagtttttattttttgagtctttgctaatgccatgcatataatatttaataaaaatttttaaataatgtttatgaggtaggtaatatccctgttttataaatgaagttcttgggggattagagcagtggagtaacttgctccagactgcatcggtagtggtggtgctgggattgaaacctaggcctgtttgactccacagccttctgtactcttgactattctacaaaagcaagactttaaactttttagatacatcattaaaaaagaaaaccataaaaaagaatatgaaaagatgatttgagatggtgtcactttaacagtcttaaaaacaatcgtgtgtatagcatagaattgcttggattggataaacagtggcattatatattttaaaaaataaaagttttgaaagattgaagaatttgggcattacagttctcttaaatctgacaaagctgcataaaactattaaaataatcattattatgctattttatattctatttctttgagggtttagttttccaaaaactacatattaagcaaatgaatcactcagtggctatgtcatataataacgagttagcctagttataagaagtttaacattttatttaagaacattgttacagcatgtttactgtatagtctagtaatagaggaaaagacatttgggtgggtggtagtggtagtatttttatagaggagttaccaaatttcagctctattatccaagtttacccagctaatggtgttcggaaccgggaatttgagccaattctgactctgttgtctgctctgctccttcttttgtgctgtgtctttgaaagtcacctaaaattgtgagggaatgtaatttcaccccaaatttagagtttatgcacttgttatattgaaaatgattaacatgtagaagggcttttaatggaataagtggtgtagtaacttcagtgttgcctacctagaaatcaaaatctttctagttgtccactttgttttttgaaaaagtaatatgaaaattatgttaatgctttaattcaggtttttgtaaaatattttttatctttacacatttaacatacgtttctaaaattatagtctgttatatagcactttgggtctagaatttttcagtagtttctgttttactattatgatctacctgcatattaacctattaggttatagttttactatacttctaggtatttgatcttttgagagagatacaaggtttctgtttaaaaaggtaaagaaacaaaataactagtagaagaaggaaggaaaatttggtgtagtggaaactaggaattacattgttttctttcagccaaattttatgacaaaagttgtggacaggttttgaaagatatttgtgttactaatgactgtgctataacttttttttctttcccagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacaggtaagtaacactgaaataaatacagatctgttttctgcaaaatcataactgttatgtcatttaatatatcagtttttctctcaattatgctatactaggaaataaaacaatatttagtaaatgtttttgtcctccttgagagggcattgcttcttaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgcaatctcctgtggaccaaaatgtcattatgtggtacatgactgtactaagaaattgatccatctatattccatcaatttgtttagggctttttctggttacatttacctgtgagcccagaaaaccagttttgtagaaattaacttctgtaatgctaggagttaaaaaaaattgctgaacaacttttacattgttaaacatttaaaaacaagcgttctagaagtttatcaaatttcataaaggtgcaaaaatgtaaatgtaaatcattatccagctaatatatatgttgtatttccctagtaggagagcatatgtacctcttcctagttatacaaatttgatatatagtaaagaaacagtaaattctacttcaagtcattttgggaggattaaaaactgaatttctctagtttgaccattgtacagatttatctggcaattttactaaaacctgatttataggttaaacttggtgtatatcatatatcactttactttagaggaattaagatttcacataaatccatttccaggttccaaagaccaggaagaggcttggtttttgtttttctttttactgtcttcacagtctccttgacttttcttaggagagaaggtactgagaaaacatgattctaatatttattattttttcttccaacattttcttatgaaacattttcaaatacaaaattgagttttatttaaaacatttgcaaatatactacctagattctaccattgttgttttatatttgctttacttacaacttttaaaagatgctttttataccactgaacattttagcttacatttcacaaagaaaagaaaaaatttaagagactttgcataatgttttaaggggttgcagtaaagaagtgcttcttatattttcttatgcatacaaatcagctgggcttattaaaatccagattctaattcagaaggtttaggtggggaccgagtctgcatttctaacaaactcctaggtggtatttttcttggtacttggaccatactttgagtagaaaagcagtagaggacataaaaagagtcttgttagtcccactttgttgctgtccacttctcatttgataatatcctaaaatagctttgtctcctttttggtggttgtatgattactacctcagaagtactaattgattcttgctatttgaccttaatactttaatataacacagcattcatatttgatcagaaaactatctggcttccttttataagagatttttaggttttatacagttttgtggccttgggtttttttgtttgatttgtttttttgaaggtatataatatgtaagtagataaacaaatttgatttgtagacatttttatgtggatcatctaattaaaaatggagggatacagtatgaaagaatacttgtacttcttaacagagcactcaacctttcttttacatcctgtttcactgatgttattatgtaatttatgttgctaaactataaattagatatttaatttctgttctttgatttccttttattattaaatggacttgttgatttgcctagaaattaatttgcctttcaaaagtcttattaatcttcctccgttgaaattaatttgatatttgcatgcttctggaagactttaaagagctattccgagtaactgtagagattataaaatgaaatatgggaattttaataaattttacatctccagttactggtgaaaatgtcaagtcctcctttctgcagagtattttgttactcatctgttattcagcttatttatttatttatttatttatttatttttctttctttcttgtttttttttttgagacggagtcttgctttgtcgcccaggctggagtacagtggtgggatcttggctcactgcaggctccgcctcccgggttcacaccattcttctgcctcagcctcccaagtagctgggactacaggcacccgccaccatgccttgctaattttttgtatttttagtagagacgggtttcactgtgttagccaggatggtctcgatctcttgacctcgtgatccacctgcctcggcctcccaaagtgctgggattacaggcatgagccaccgcgcctggcccttatttgttttttaaacaaaattagtgtgcatatccttgttgtattttatcggcaagttgttttatgccctaacttttggggtcttgatcatgagcctaaaacacgtaaacacccaaaaagaattatattccggttaaaggaacaaaacattcatttagaagttctcatccatgtaaatcagaggctggcaaatattttctgtaaagggccaagatagtaaatgttttaggctttgagggccacaagtggtatctgttgcatttttttttaattatgaccctttaaaatgcaaaaatcgttgttagcttgtgcatagtataaaaataggctggccgcatgcctgtggctcatgcctgtaatcccagaaatgaggtgggaagccgaggtgggcacaccacctgaggtcaggagttcgaggccagcctggccaacgtggttgaaaccccgtctctactaaaaatacaaaacttagccaggcgtggtggcgggtgcctgttatcctggctactcaaggggctgaggcagtagaattgcttgaacctgagaggcagaggctgtagtgagcccagatcaagccagtgcacaccagcctggacgaccgagnnnnnnnnnnnnnnnnnnnnnnnnnnnnnnnnnnnnnnnnnnnnnnnnnnnnnnnnnaccgagcaagactctgtctcaaaaaaaaaaaaaaaaggctgtggctgcatttggtccattggctgtaatatgctgattcctaattctctgggtaactttagtgtttgattagctactagaagttaggttaaacttttgtattttacaggctaactttaataatcttaaagtaaaacttaacatagttcatggaaaggaaatagaaattttaccctagtactcttttttttttttttttttttgaggcagagtctccctctgtcacccaggctggagtgcagtggtgggatcttggctgattgcaacctcctcctcctgggttcaagcaattcttgtgcctcagcctcccgagcagctgggactacaggcacgcaccaccacacctgactgatttttgtatttttagtagagacagggtttcgccatgttggccaggctggtcttgaactcctggcatcaagtgatcctcccatctgagcctcccagtgtgctgggattacagacgtgagtcactgtgcctggtctctagtatttttttttttttttgagacggtctcactgttgccaggctggagtgcagtggcgcgatcctggctcactgcaacctccgcttcccggattcaagcgattttcctgcctcagcctcctgagtagctgggactatgggtgcacaccaccacgcccagctaatttttgtatttttagtagagacggggtttcaccatgttggccaatatggtctcaatctcttgacctcgtgatctgcccgtctcggcctcccaaagtgctgggattacaggcatgagccactgtgcccagctgtactttttaagataagaattgcagggtatatatttttaccaacttaataacttataattttaaaaagctaattacttggctagaatataatgcgttacatattctttacactcagttcagtccatatctgaaaggcaaatagaattattttctgctagtacattgtgtagtccctatgttcctagtgtataaggactgttacctagttcacatttatctgggttgttgacagattttcctggtccctttggacagtgcatggccatgttggcaaaagctgtcaaaattgaaacattgacaccatgagaattgtgtgttttccagtctgctaaaatcaaaagtgggagggttcagtaaggtgaataacagaagcagagttttcggggtatctgttactcctcattcggcttttctgctctctgggggtctcaatttaaatataatgtgaaaattagttttacgaacctaaaaatgttgagtgattcatttcctggttttgttgttaatttctagatatttaaattaattgttagaagaaccccgttaaagaatgctttgcaaaacaacctccttatgtgctatgtctctgtttaatagtagttgagtttgtgtacatgagatcaatattttgaactatagctttttatgagttaaaaattgacggaacagttactgtgcacttgctgtgcaccatggtagtctcccaagtagtggtttttctgcatttcaatagtacatgagataggctgtgggtggcaaggtttcttgagaaagtgagggatgcacagttgggttttagaatacatcttgttcctccatgcccttccccaccaaaaggctggtagtcttgcatttgtatatagttagggtatttgatgtgttgcttccttgacagagttttgcaagaatttgcagatttaacaggaacaaaaacttacttaaaacaaaatctcttagtaaaagcatagtctagcaagatttagaatgatactttggctaacagtactttctctatatggagtgctttgtttccatagcctcacaagtatgttttcagataatagttgagttgaaaatgttgtcaatctcttgattttaaaaaatttactatttaaagttgtatacttttgttcctacgtattttcagttgttcttaaagtttaataagtgacatttgaaaatgggtatatgtgtataaaaacaaaagtaggctaggcacggtggctcatgcctataatcctagcactttgggaggctgaggcaggcggatcacaaggtcaggagtttgagaccagcctgggcaatatggtgaaacccccctctactaaaaatacaaaaattagctgggtgtggtggtgcatgcctgtagtcccagctactcaggaggctgaggcaggagaatcgcttgaacccggaggtggcggttgcagtgagccgagattgcaccactgcagtccagcctgggcggcagagcaagactccatctcaaaaaaaaaacaaaaaaagaaaaagttaaaaaaacaacaaaaaacccccacaaaatgagtatatgtggcaacaagtcctattctcaaaaaaattattgtgtgctagttaagagcttaatgagtagccagtcggtattaaatatctgtttcagctatattttatctttaaaaattatctacagattttggaatgtgaaaaactagtgttttgtttcataggtatatactgtaggcattttaaaaataagagccagtgccagtggtttacagtgtacacaaggataatgttctcatgttctcttgatgtcagtatgactttaaagcatattatcaagaaataactaagtctgaaaaactgtggtaaataactggtactctaaaacctaagtttcttattactaaaaataagaaatggtaaaagtcaccctgtgctgttaattatatgagccactgaggtcctgacactgaattcttggtggtggataataatctcttctttttaattattggcttccaattctctctgcattgctggaaacaaaaatcatatatttcactattggtggtggggatgctgtcactgaaaaagtagacacattcatattgattttagaaataagttaaaatcaaaatttgcttctgctaaattagtagaggaccaatactgtttttctccttcatagtatgttttggtacttctacattgacattataacttttttttttttaaacagaaatagaagtttacattcttagaaaatttatgaaaatatgagcttttacctggtttgtgtgtgtgcgtatatatatacacatatttttaaatttcttacattgattttcaaattgaaagagaaccatttgtgaaagtatcttaacagagctcatgctttacattttacatgctacaaagttattttagtgccttaaattatttatgttgcttattaatgaaaattttggatacataattttttcaagacaaaggtaaaaataataaaccctttccttctgaggattaatgataaatataaactttaaaacgattaaaaaaatttttttagagacagggtcttgctctgttgcccagactgaagtgcagtggtgcagtcatagctcaatgaagcctcaaactcctgggcccaggcaaccctcctgcctcagccttttgagtagctgggacttcaggctcatgccaacatgcctaatttatcttatttttagtagagatgaggtctcaaactcctggcatctcttgccctctcaaagtgctggtactacaggcattagtcaccacacctgacacttaaaatcttttatatacaggtgtaagtgggtatctaacttaaagtgccaacgaatgtagttgaaagtttgtagttggcttagctaactagttaactaaattgattccattaaaaataagactgctcttagaatataatgatttttgttattcattaaatataaatatatcactggatagtatatgttaatgacttgagatacgcattttaacatataatcacgttacttaaatgcctgcctttgaactgaaacttaacattatgaatttaaattaaagtttgactttagaggtaaatttctgtactttactaaagcagttcttaatatacttctgagatttctaaaaattagtgtgccctaaagaattgaggtgtgtttttcttaactactgtaggcagtagatgtacagatgacttctgcatgcaaaaattaagccctagccattggtttacttcaactaatacttagttgccaattctctgtgtgtgattgaatttaaaactacaaatggtactggtgatacattaactttttaggtgctaggtccactttgttacatttggttcagtagaaacattgatgttaccaatctcagaaagctaaaatatgtatgccaatccccaaattaggtaatttattcttaattttaagataaaagaatagaattcccttaaaattaaatgtggagtaaaatataccagctttaaaaaatattcacctttctgttagaagaatgaacataatattacatcttttaatttgcactatatatagattaatatttctgtgtatttctctgtgcccctactttgatggtatgcttttctgaacaaactagcagcacagttaactaagcactttgccccgtttgatgactgcctaattttctagattggaaaatattaaaaacttttatctccatatggccaatatatgattgtacctgttgtcatagctctcctatgtttaagcaagaaaaaccctattaagagtatttaaattagaatggaaggcacacagccagtatgattgaacactgttctaaaaattatttttaagacttgtagtaaggccaggtttggtggctcatggctgtaatcccagcccttaggaggccaaggtgggcggatcacttgtgctcaggagtttgagaccagcccgggcaacatggcaaaaccctgtctctacgaaaaatacaaaaatcagtcaggtgtggtggtgcttgcctgtagtcccagctatttgagaggctgaggcagggggatcacctagcctgggaggtcgaggctgcagtcatgatcgtgccattgcactccatcctgggcaacccagtgagaccctgtctctaaaacaaaaaaataaaaaaagaacttgtagtaaggatacaaaatgctcctattttgtgtgtgtcctttaattcatgatgtttttatattatggtaagcagctctcatttaagattttaataatgtaattaaacatgtacagaagacccagtctcagcttcacttgtataccctggaaatagactgaaaggtgttaaaatttaaaataaaactcaaggttccagtttcttgactcacctttgagattcttttatgtttttgttgttttttaacaaaggtttcacgtccatattttaccatttttcttctcattctcccctggaggagggtgtgggaatcgatagtatataaatcacttttttcctaagtcaaagaagtaatttaaagctaacttcagtttaggctttaattccaggactagcaaactaaaatggttgcattaattgacaaacagatgctaatacctgtgtttaggcttgtcataatctctcctaattcctaatttaaaaattttaaaatttaattccattagaaaacaaaactgacttttaagaacaaaccaggattctagcccatattttaaaactgcatcctcagttttattcaaacagtctgatgtctgtttaaaaaaaaaaaaatctcaagctcataatctcaaacttcttgcacatggctttcccagtaaattactcttaccaatgcaacagactttaaagaagttgtgttttacaatgcagagagtggaggatgctttttatacattggtgagagagatccgacaatacagattgaaaaaaatcagcaaagaagaaaagactcctggctgtgtgaaaattaaaaaatgcattataatgtaatctggtaagtttaagttcagcacattaattttggcagaaagcagatgtcttttaaaggtaacaaggtggcaaccactttagaactacttaggtgtagtattctaacttgaagtattaaaagataagaaacttgtttccataattagtacatttatttttaatctagtgggaattaattataattgagacaattttgatggctgtagtagactaatctatatttggcataaagtctaatgatttaatgagtcttaagtaaactaaatatttggaaactgatatttacctttgtttttaagggaaaagttttgagataatcagcagcctttttttttttttttttttttttagtagggagaaaaagatatgagctatagtagacagcagtaatattgaatggcccagaaggtgggaaaaagccactcttaaatgtattttttcttttggatattttacaagcaaataataacttctgcctaagttcgccatctcagtggcatcagcagcacagcactttcttatcccagtgagaaaccggggaattttaggatgactcctaccgccctcttttccccctggtttggaagtatccacaaattcctgtgacgttacattctgtgtcttttatgtcatcattagttcaggcccctatcatttcttgttggactgttagaacctcctatttggtttaccagttgctgccattattcattgtgaaaccggagagatacactttaaagaaatgtcattgttggccgggcgcggtggctcacgcctgtaatcccagcactttgggaggcctaggcgggtgatcacctgaggtcaggagttcaagaccagcctggctaacatggtgaaaccctatttctactaaaaatacaaaaaattagccgggcgtggtggcacgtgcctgtaatcccagctacttgggaggctgaggcaggagaattgcttgaacctgggaggcagaggttgcagtgagctgagaatgcaccattgcactccagcttgagcaacaagagcgaaactctgtctcaaaaaaaaaaaaaagtcattttagctatagaataaaatctcatgttccacatgtgttgcagatagtccttactaccttcccaccactccagctcttttttggtcttatatctaaaaacgtcatcttgcctgaatttcttttgttcttctataaataaataccatgttatttcctaccttcccttgagtcttggctcttgtttggaatgccagtatttttatccctagtcttactaattagctaacactctcatgattccccagtctcctactctctaaaaacctttctttaaacccttagactaggcatggagcccttcctgtgtattcccagaatactattcttaactattatatgcttcccatgttatgttgaaataactaacctcttctgtttcattcctatattacttgacagcaaaatcttagccagaattacatatttttaatctttgcacacccattgcctagtaaggttcctgggacatagtaactacccagtaaatatttattgcgtggaattctcattttcgtttctaaacccgtattaaactctgtcttgctcagaaaatacttcactaggtatcataaagttcatggcagagcttaagctttggatgcatattgtttgtaatatatcatgttcttaagaataggcaataaaattacagttttcaaaaactactacatttattatatttattacaagttggtgttctttattacatgaattttaggtatttcccaaaagtataaaatatacatttgaatagtagactcaatcccaaaagatactacgtggtgtactaatctactaaactcagaaacaaagcatgactggcattaatttttgttgaaatttatgaactctgaatgtttttgaatatcattctgtaaagcaatattttgcaattaaagcaattttgcatgttaaattttaccacaacctctaaaatattgcaaatttaacaatacagtttgaaaagttacacattttaaataacagtaccatgaccagatttaggtggtggttttaattttttattttctcctcctattgtctcaccattagatgattttaaaaatagaattgtttagagtaaaataagtgttatgctctaatttatatttaaaatgaaggtttaagcacgtactattctaaaatttctaatttgtgcaaattatgttttatacagtgactgtaggtgaatgtcacaattgtttgatgtgacgaatccttgtttttcagtacacgtggaagtaattcatataaaagagaagtatacttggtaattaaaaatttaaaattaaatacaatttaaaaaaaaatttatttgacaagctggctgtggtgtgtgtgcctgtagtatcagctgcttgggagcctgaggcaggaggattgcctgaccccaggagtttgaggttgaagggagctatgatggtgccatggcactgtagcctaggcaacagaaagagactccatctcttaaaaaaagtaaaaataaaaaaattttggcacagggacagtggctcacacttataatgccagaactttaggagtccacagcacgaggattgcttgaggtcaggagtttaagaccagactgggcaacgtaatgagaccccacctttaggaaataaatacataaataaaaatttgagaatgataaacatatataaattagcttttcttagtcctgaaaaagataatgttatgtgtatgtgtgagaatgattagttctcatatgagaaaaaaagaattcattgctctgtgtaggttgtgacatttccttcacgattgaaattaattaatttttttttattacttatttatttttaaaatagagacaggttcttgctgtgttgcccaggctggtctcaaactcttggcctcaagcagttctcctgcctcagcctcccaaattgctgtgactgtaggtgtgagccactgcactgggccaaaattacttaattttaacaagatgatgtagagaggagagttcattgcaacataagcctagaatctttgtcagaatcttaggaagtaatgttttcaaattctgtgttttcaccataaaatgtgtcttctctgtgtccatcacatggtttttcattgttttctgctttaccattttagtaccattggcatttttcttcattgtaaaagtagtagaaatggagtagattacataaggatgtgatcagagggaatttattcattcagggtaagggagttagatcctcttttaagattctatcacattctaagggtttatgattctaaactgtcaagtaaattgtcaagtgctggcaagctacagaataatttttattgtatcattggaaattttcccctctatatgtgttaaagagtttagcctgaagggatacatacacatacatatatgtaatcaaaccttgatggtattgtattgctgataaattatttcttaccacttttcctttctcctgtgggagaaacaaaagcatatgtttgtgtagtatcagtaatgatattagagagtgggaaacatcagtgagtgcagtttggggactttattggagactttcactagtgctcaaataaataatgctggtttttatcctactgtttgcttaatgtggactagcctcttattcccattctatgtttacctctcttaaaatattggtcacgctttcttgaattatagatctattaggaaaattcatgaactgtagctaattttcattgttcatgctccagatttattttgaaatatcgttaatcttagtagtacagtaaaggagaaataccacttaacattttttgtttttttttctttgagacagagtcatgctctgtcacccagtctggagtgcagtggtgctatctcggctcactgcaatgcacttcgcctctccgggttcagcaattctcctgcctcagcctcctgagtagctgggattacaggcacctgctaccacacccagctaatttttgtatttttagtagagacagggtttcaccatgttggccaggctggtctgaaactcctcacctcaagtgatccacccgtcttggcctcccaaagtgctgggattacaggcttgagccaccgcaccccgcccacttaacattttaaattaatttcaagataatatcacttgaatatttttacacatataatttttttaatacatttatttacacagtttataatatcctacaaagtgattacaatgagtaaaaacccagttttcattgttcctaaagtggcttgatttatacaacttaatgtgttgggtatttgtttctaagactccctctgctgtctaggtttggaagtattgtgaggttaacagattttctttttatagttactactcagttgaacaggctttaaaatacagagagaatcatattttttcttcattttttgcttttatttatatttttcttttaattggagacatgacaagaattgacttgtgtatggatcttgcataatttaagtactgcaggtttaaaatctactctactaccagtttgagagtgccatttttcacactgtagattattaggttgaaaagtattatggcttaaaatcgcttttagccattaaatttaaataaccttgctttaatcataaatagatggtggtcacaatgactaactgttaaactctttgaagacaggatatttggctttatatggcaagcttttgaatacaacagaaattaaaactttatgggatagaaagaatctcctccaaattggtaaactataagacctttcaaatgatttagctaatttctccacaaatctgaggtattagtgttttttttaaagtggtattctcctgtgttggggtcactttaaacctttttcttaatgataaatatatgaattgaaactaatcccttaatatatatcatttgaaaactgaaataatatgtttagatactgtttacttgttgataaattattggaataggatgttcgaatactgtttacttcttggtaaatttttaaatccaatggattttacgtaagtatagaactggagctcaaatactgttactgtgtgtgaagatatatgaacatagtttacagttgcatggcttatatctaaagtccagaaacataaggacaattaagtgtacacacacacacatgcatttggattttgatgacttaggtttgccaatgtggaaaaaatagtagcaaattaagttctcctgtgaaaaagtcgttaccttatttaaaattctgtgccattggttatccttgtcttttgtgaaaattagtgttcctgtttataatattgacaaaacacctatgcggatgacatttaagaattctaaaagtcctaatatatgtaatatatattcagttgcctgaagagaaacataaagaatcctttcttaatattttttccattaatgaaatttgttacctgtacacatgaagccatcgtatatattcacattttaatactttttatgtatttcagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctcgaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgacgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17002 - DNA, 140224 bp, Human
  misc_feature (1)...(140224): n = A,T,C or G
aacctttcccaaaggtgggttcaggtcaaactattgtcttggtaattagtcacaatccagaatggaagctaacgtgaaatgtgggaatgattttgttgaatcctacagtcctttcaatggaccccaaagtcctatccccaggcaaagttgggaaaaaaaaaaacaaaaatcccctcggactacgactccctgggaaggctttccagatgttttaaattgcaggaaaatgaatttagaacataagcagatatctacacatcacctaaatcactagacctgtcctcaattttaaaacacacacacacacacacacacacacacaaagtacaccagtcggcagaacagggcattataggaaataaagagtgttagtaaaatccataatgctttctgttagaccttctgggaggttataattgcatttggccggctgcagccttgtcggagagcctggcttcttaatagtctcaaccctaaaaggagtaactgtcaaggggcgacccagctgaaatcaaacaacaaaaacgggaactgtaacccgcctgaaatgggaggaggaaaaggaagggagactcctgtattcatcagtcaacattaatgtcctttgttgttcacctttacacagaacagcgagagctatcctgttcctttttctccgaacgccagtgtcagggtatgctttcctaaaagctatctccctgcccccaagaaccaggctttccgatccccctccccatttatcactcagcagccctgtaccgccacaccgcccccactgcgctcacccggggtcgagagggtggccagaagtaaaaacactgctgaaatacccgttcttctccaaagaccaaagaaccgagcggcgcagatgttgaaatttaccaatgcccccgccccgcaacatacacaccccataaatccgggatcgcagagagggaggagggtcagagagggctcagcttgtcagagcggctctctccaggaccctgccacattccacactccgggaatgtcgatccgagccagagggaagggtttgcgcctccctactgttttgggggtgttctctctgcccgagtgttgttgtctccctctccacccagaggaaccgttgcagctccctgtcgctttggggaagaagggtaaggaaggagagaaaccccattcgcctcctcttccaacttgacacacacacacacacacacacacacgcccagtcgccactccaaactccgcaggcagagcccgaagctagcgggccggccgcgcgctcccccaagctgtcccggcgcttcgggaaccagtgcggggcgcgccgagcaggcggtgcggggcgagagcctggtgcgcagccctctgcctggagctggctcggcaaagccccgtaccagctgcgcgatgccaggattaggcattttcaaccgggcggagcgagaggggcgcgggggcaaggacgagaaatgcgcactcgctcgggccagagcagaataaaagttcgccccgcggagactcacccacgccgtatttctcgtgctccgtaggtatccacatggctaaaggggctccggggtcttcaggctttgtaatccccgcgccccttctccggctcacaacaatgcacagtccccgagcagcgctgcagtgccggagcccagcggcttcgcgcgggctgcgggcgctgggcaggatctgcgctggaggctcccgagcccagcgttgacactgcgccgcccgcagctctcccggcggcggctgctcacagtcctccgacgcgctcccgggtacccggcggcgcagtcattgttctgattcactgaactaagcgaacacgccggggcactctccggcgcacccccgcccgccagcgcctagtccagccctcccgtcccagggccccgcagcacgctgggaattgtagttcttggcctccccatcccggaagtgggcgcggcaaatgtggttcggggcggggattcagttttactgattgcgtcctattggtccagagcgcggcgtaggtgtggagaaaacattacgtcgacggggagttcgcctccagtagcgtttctactggtgccaccccgcctccgacccgccctgcggccctcccttttcttttctgccgggtaatggctgcttccaagacccagggggctgtcgcccgaatgcaggaagaccgtgatgggagctgcagcacagtcgggggtgtaggttatgggggtgagtacggtgccccggaggcgcggctgatgtgtcttcctttctctatgaccgggtgtgcaacggacctctggtctgaccctaggagcccttcagctctggggccacctgggttcgactgggccccacgggtggtggcccagcgggatgggttggagccggtggcggctacttggttggggctgcccggggatggcggagaaaatgccatgggatggcggagaaaatgccatggaatggccttcccctccgccggggaagctccctgagcgtttgtcttctggtttggagctcccagctttgagctagctgctgagtgggtttggttcagatctggttcgcgcgcgtgtgtttataattttgggattagcagctctttctcctcaccagtacactgccttggtttgcttggtttgacctcgcaggtgtgttttatttagcttccggagtatttccagtcgcagactggtggtcactgctctccactctacagatttgcccagtttgtggctgaggtgacctctgaagggaaagtgtgtgtatctcacaacctccctgtagatggttaactgctctgggtgttcttcagatttgtatgtggagcctgagagatcttcccagtctctgggtccttagagaaagaaaaggaaagtgatagataatttgcactcgtggcttcaaagaacatttgaaaagagttttgaaaaccatcacaactttggctgtacctgactttcaggttgtcctctgatccactgtaggaataaaaaaccaaattttgaaagctgcaggtggattgtgtttaggactcttttacctttagtctatccctcccccattccccccaccccatttttgtcttgatgtgtaatttagcacaagttgtctttttctgatgaacatggtttggggcttaaatatagttctcagactgttgcgactttgtttttcgatttatttgtttttgctttcacagttaaattgatatcatcttaagtatttacctcagcggcacagagttgaagtgcagttttttcccacttcccaacagtggaactccctactctgaaattattttagtacctctaccaaacaaatctttggtagtctcctgagttaaatattgaatttaacaccctaatggtttatttttgggttggttatatattgggctatctgatggtaacagactattacggtttcctagattttcaaagttccagagggctaccagtttaagatctaaactggtgaatttatctcacagtctaacttattttaaaaaatggccgggcacggtggctcacccctgtaataccagcactttgggaggccgaggcgagtggatcacaaggtcaggagttcgagaccagcctggccaatatggtgaaaccccgtctctactaaaaatacaaaaattagccgggcgtggtggcggatgcctgtagtcccagctactcgggaggccgaggcaggagaatcccttgagcccgggaggcggaggttgtggtgagccgtgatccaccactgcactccagcctgggaggcagagcaagactctgtatcaaaaacaaaacaaaaaaaaaggatatgcctttcaaaaatgtaaaatatttaaaaatatttatttttaaattttacaagtttaaaagtttttaaaagcacttcaaaccattcagaagtgtatgaagtaaaaaaaatgaaaattccctcacctcacagcaccactccccgagtattaagtgataagagtttggtacatattctttccaacatattcttcttcttctttttttttttttaatcctacaatccgtattctgttaaaccaccatattcttatatgacacacgtctgtatgatttgattttttttttttttttttttttttgagacggagtctcgctttgtcaaccaggctggagtgcagtggcgcgatctcggctcactgcaagctccgcctcccaggttcacgccattctcctgcctcagcctcccgagtaactgggactacaggcgccagccaacaagcccggctagttttttgtatttttagtagagacggggtttcaccgtgttagccaggaggtctcgatctgctgacctcgtgatccgcccgtctcggcctcccaaagtgctgggattacaggcgtaagccaccgcgcccggcctatgatttgatttttataataaaaagggataaatctatataaactgaaagatctgcaaccttcttttttctttcagcagtctatcatagaaacccttccacgtcagtacatttgtttcctttttttttaaggactgtgcccatcatattccaaaatatgattgtgccattctttatccattcccttataaatgaacatatagtgtgactttagtttttcagtaatgttgcaatgaacaactttatgtacatatattcttgcccactggttgtatattttgggagaaaattgctggatcaaaggttatgcaagtttaaaattttgacagatgccagactttcctcttaaaatatattcagcatacattgccacctgtagtatatgagtgttctttcccccatattgtcacaaactttgaggaaataatccaggaccaatgtttcaatgactagtagattgaattaagtaactgatagaaagcttagtttttgattccagtttgttttcaataaaagtgttgagtagtagtgaatttgcggtatctataacataaaaaaatttctcaccctcggtgagaaatacccagtattctcattgacttgtagcagtcaacaggagaaattaatggttgattttttatgtcatttttataagataaagttgtcattaaaaattctgcttaataacctatgtatcattctgttactttttccaaaatcttttcaaagccaacaaggtgtgatataaattttaggtgtaaatatttatattaaaagtatattttttgttaggcagtcatttaggttatcaagtatgtctttccctgtaaaaatcatacacctttttggatgagttcatgtcctttgtagggacatggatgaagctgaaaaccatcattgtgagcaaactatcgcaaggacagaaaaccaaacaccacatgttctcacttataggtggaaattgaacaatgagaacacttggacacagggcagggaacatcacacacccgggcctgtcgtggggttgggggatggggaagggatagcattaggagaaatacctaatgtaaatgacgagttaatgggtgcagcaaaccaatatggcacatgtatacatatgcaacaaacctccaagttgtgcacatgtaccctggaacttaaagtataataaaaataaaatttttaaaaaacatacacctttttgacttcttgaaaactgcttcttttaagagattttcttcttgctctgattaaaatgttagtctgtgtgtttaataccctgggacagtgaggcctaggaagactttttatagaaatccttgcaattcctcaaaatctctgctagagtgagtcagtgggtggggtgcaggcaggtgcaacactcactgagaccactgtgttgccagacttctgtggctccatccttctccaagaaggtccccacattgaggtcaaggatttttttgctttttttgtttttgttttttgtttttttttttgtttttttttttgagacagagtcctgctctgtaacccaagctggagtggagtggcacgatctcagctcactgcaacctccgcctcccgggttcaagtgattctcctgccacagcctcccgagtagctgggattacaggcgtgtgccaccatgcccagctaatttttatatttttagtagagacagagtttcgccatctaggccaggctggtctcaaactcctgaccacaggtgatccaccctcctcggcctcccaaagtgctgggattacaggcgtgagctactgcacctggcacactaggtcaagggttaaaggacactgctttacatacatctgaacagtaaccagaatttcaatttgtctcctaaaattaagaacagataataaatagattcagcatccctcacgtggtgtcattggcatttgttcttttgctgtttttaaaaatcagcaaggtagcacaattcagtaataatacatttaggaggcttttgtgactgaggctatttcttctgagtattaatctgtatctccatattgtaatattctgtcaaagtcaacttttttccctccgaatgggtgtttagtagttgatgattttgctaatgcttggattctggaccttattatctgatgattttggtaatgtttatcttccagagaacttactatctcatgtgtgatgtctctggaagaaagagggaagggtagcaggtgatgtaaactcctcattcttgtatttcctatttcaataaatggcatcaagtctaagctagaaacctaggaagcatccttgattcctaactcgccctcaggtactgaatttgatcagttagcaagccttatttttctgcgcctgtagtatattttgaacctgttccctctattcatagctacagccactgtgctaattccattactaaccctcaccattactgctgaattacctacctgcatctcccatgccccagaaagtgctcttgagaaccagttgtatgtgtgtttgtcagcctgattctgttcttggcacattgttaatgtttaataagtgtttgaccagaatggaattctagcctgaacgattgcaaaaccttcctgttgatctcactgactcttgactttacctcctttaatccacattgtaaaacaaatatattcatggatctccacttgaaatcttcagtgtaattctgctacatgtataattaggtccaaactctctgtgtggcatttaagattctaatctacttgtctagcctcatcttcagtcaccctgcttcctttcccatatctccattatccacttaccatgtcacactgtagttattttttggcaactttgtctaccccagtggacagtgaacttcttgaggtcaagagttgccttatttcacttttgtacatccagtgtttatcaaagctgcatacagtaaacattgtataacagtctaatgttagaatatgcttgaaatttattcaaggcatttagagtggctactattttgagcagaggaactgaaatagaataaaaaactgaatagatgttttatgcttgtgaaaggtatgcataccaactaaaatgcaaaatatcaggaggatgatattctgtcaaggtgatcatagttagcatttaaggatagtatttcagttttttaaaataaagttttaatgttgtttaaataataattacattttttaaaagaatactttagatctggcctttataactttaagcctgtaactgaatgacctaccacatggaccttgaattctgtctttcatcatctatatggctgttaccaattttctacaggctgtcattctatttctataaaccattaagtccagtctcatatatttgacatggcaatggaaagaggactagaccttattttgacaaaacggtatttaaattccaattctgacatttaaaagctgtgtaacataggtttattatatgtgctgccacatttatgaaaatatccgtataatacctgtcttgcagttattgtgattatttcatatttatatatttatgaaagcctagcatatttcctgttataaagtcagacctcagtaagtattagttgctttcattataaagataggcccaattataaagatctgcctgctctatcaagaactgcctgctctttgatactgtattcacttaggaagcaatctaaattgtggagtaaccctggggaagcttaggaatgtgttggtgataactgcttatgctgtcaatgctttcctggaatttgggagttgtcagagtgtctgttggtgctacatactagtattacaactatgtgctctgcaagcctttatattatcttctgtatcctctctcacttctatacagtgctactctactcacacccagctccccacccgcacacacacacattgacactcaaagtcatcaagaaactcaagtaacattgtatactggggttgcctcacaaggtataggccgtgggatgtcagagaagataagaattatagaaactactcttgtaggtcttgtttggtgacatggtttggctgtgtccccacccaaatctcatcttgaattcccatgtgttgtgggagggacctggtgggagataattgaatcataggggcaggtctttcctgtgctgttctcatgatagtgaataagtctcatgagatctgatggttttaaaaagaagagttttcctgcacaagctctctctttgctgccatccatgtgagacgtgacttgctcttccttgccttccaccatgattgtgaggcttccccagccatgtgaaactctaagtccaattaaaacctctttcttttgtaaattgcccagtctcgggtatgtctttatcagcagcatgaaaatggactaatacattttgtataaggttctgaagaggccttatttaaagcattcttttattttcctatgacaaatcaatgggacccaacttgtaggatatttagagaagagctcttattaaaagggatataataatgatgatgtgtatgatagctaacatttttttgagcactaactgtgccagatactgtttcaaatgcttttataggtattatctcatttcatcttcatagcaacccctaggtagtcatattacgctttttatgtacaaatgaggaaactgatgaaaagagtagcttgcccaaagtcacacaataactgagaaaagacttttatcctatgcacggttgtaatgatgtctcatagtaactaaattccattgaatgaggtctgaaacagacttttcttacacataaatatgctctaaagccaatgttaccatagaaaggcagtatggaatagtgaaaagattttaaaatcaggccagcttaggatcagattctggtaaacctctgaacttcagtttctcttctgtaaaatgagtaatactgtatctatattgctgggatgtggaaatgattaggtgagatgatataatagtctggtcttcaattgtgactgttatttcagtcataggtataggcacatctttggcatatgtgccagaagtgatacaagtggttttaatatgtcttctgcacttgaagagcaggttattattgagggatttgatgggtcagataccgaattacatacacttattgtgttgaccttgaccttcccattcatgcaaaagaatagtgctgccctttacaatacacactcatacacttccatctggaaaaactgtaaagaggatgtcgatcagattcatataatagaaatcatactctcttctaaatataaatcacgagtatatagaaacaagcaatgtgcataaactgctgtctccagtgattaaatcttcaaatgtttctattagctcttcttagagaactttgccacaaaattagggttcagttttgacttatttgataaacttatcagactctgaatgagttggcttttcattgacagtaccttaaagacttgccacctcatgctgaaacaagtatgttctactgacctacttgacccaaaggtgagcagggcagcttttttcagaagtggtgatagatttgactgatcagtcttctgtttttctttacttctcactgatcatctttgtaactagtggcatttatttgcaacataggcagctggggttgaatgatatctttggctataggaaccaagtaaagttttctagagctaaacaggatttaaacctttgcttcatggggtgaagggaggttgggaaagagggagtcaacaattgacaagtggtaaaatatttaaaattttataggataatgtgggatagtattaagctttctccatgagtagcatatttaaaataatcaatgtacagtattgaatcagtaaaatatgtagaaggaaaaactggaataggagtcagaagacctggattctgaatctgaatttgtagctttttagcagtgtgaacttggggaaaatcgtttaacctctctgagcctcagtttcatcaggaaaaaaaaaatgatgttgatattattgggaggtgtggtgagggcagagtatgttaaagcactctatgaatcttgaggcactatgaaaatatagggacaaatgatgctactgataaaagtctgtctcaagaggcagtagcgagtacaagcccaagctttagacttggataaactggaatcaaaaggagctgtcagctaaaagctgtatgaccttcagcaagtaataggacctcattattactattatggctgctgctgctgctactgctactactactacaaaagcttggatgtaactttaaaatgattacaaactaatcaaagaacattaaagctggaatcaagacaaatcccacattatacaatatataaactctgtaaggacaggaactgttaaatatacctttaacctcatcctctgggacagtgtcatgttgtgatggcatttggtggtgtttggcaactgtgaatcagcgccatgctgggctctatatgggatacaaatgaagaacccctagccttatccatgtggacatctcagtgtagttggtgggctctgcatccctgtctcaccggagctaataagagagtctcttctagttccatatagcactgtgggatgaagtggatacatttgattctgtgatatgcatgccttgccagaggcgctgagcatactaaagcttttacatgtgtttatttttaaaagaaaggaaattannnnnnnnnnnnnnnnnnnngaaattcttgttttgcctccttgtttctctaatactgtcctcatttcatgtttttttcttaactgaaagaactctcccctccctgcaagtaatcacagaggccctgcctttaaaaaactttttttagtgtttttatccaaatagagaggtttgtttttttactagtaaagatctcagaattgtaatcgtggttatttaacacagtcttctgttatgtaataagctgctattcaccagtaatagccaattagaaaagaaaatatcctgtacccgctaatcgtaattaccattataaagcaattaatagcagaaactgttgctgaactgtaacataacatcaatcaagctgtctttgccaaggcactgtacaactaattttctcaaatgaaggaggagaagggaaggaaaggaaggtgagagtctgcgggcttatttgaatttctttcaaaccagtttatgaatgacttttgaatgctctttaaatatgcatccactcacaaaggtaagtaatgctaataatgtactgcgacattgagttatttttccagcagcagtgatcatagacagtacagctttgcaaaaagctcactggacaaggaatcagaagaactaggttttttttggttttgtttgtttttgtttgttttttgttttttagacagggtctcactcttttgcccaggctggagtgcagtggcatgatctcagctcactgcaacctctgcttcctgggctcaagccatcctcccacctcagcctcctgagtagctgatactacaggtgtgtgccaccatgcgcagctaaattttgtattttttgtatagatgaggtttcgccatgttgccaaggctggtctcgaatttctgagctcagtgatccgcccacctcagcctcataaagcgctaggattttaatcccacttctccttccgactgactgtgattttagagaagtcattagcactcctggttaagatttcctggtttgtaaatgagggagtgagattatgttagcatcctttcaactccatcttccaaatatcagtaaaagaaagaggaggtaggtttacagcttgggagccgacataattcagtcctagcatctgtaaaaagaaaaagaaaaatctggatatggcctgaagaattagttgcacatgtgtgtgtcattgatcaggtgtatcaggttagaaaattggctgagaaccactgcagtagatgtcttctgggatcctatactctgagacaatatggattgattattaggatgcatcctatctcactctcctttccatttgtaataaacagtgcaaaactgaaagagctactgatagaactgaggtttcgttcattcaaaaattttatttagcatctgctatgtgcaaacttctttattctgaatgctgtagaatacaaagatgagaataacattggtcttgccatcaaggatcttatgacctaatagggaggatataagaagtacatattacaaggtagaaagtgctggggaacattagagtgatatacatagagttatgcaaaaaagagattattcccaacaggtggtactgggccttgaagtttaataatatttggacatgcagaaacaaggaaaaagtgttataggcctacacaaagggagggagcaatagaaaaactaagggcatatacaacaagtatcaagtcaatacattttgcctagagaaaatgataagtaaatggcagcaatggaaaagaagtctggaaatgtaaattgaaagtagatcatactgtctcagatcttagaacttgattatgcagactgaaactgcctttgcaaaaattatagcagaaaagtattgtagtgagagacgtctgacctaaccgactccatcttgcttctaacctccaagctgccggtgttcattcctggatatgggctgaactaactttgggaggagcttagttcatagtttaactttgaaacaaagagataacagccctttcccaaaacaaacccgcttcttgcctggcgagtagactgccttttgcaggactaactaaattaaccaccagattaaaaattatggtttagtagtcatgcagctagaggccacaaggttctaaacctcctcagttgttcctagggataacatcactattgtaaaacctaagattagtgtttgagatattttccagaccctgcactcagtgggtcagctggtaccaccgtatcaataaactggctcatccggtcttgtggccgccacccagaaactgacttagcgcaagaagacaagttcgactccctacgatttcatctctgacctgaccaatcagctcttaccactttctgattccctatccaccaaattatccttaaaaattccgatccccaaatttggggagattgatttgagtaataataaaactccagtctcctgtacagctggctctgcatgaattaaactctttctccatttcagttcccctgtcttgataaattgattctgggcagtgggcaaaatgaacctattgggtcttgaaactttgaagaaaaggaatgacaagatcaaagtttaatcaggtaacaatgtactggagggggaaagttaagtcaggagtccttgctaaagcaagagttaatgaagaaccacaatagacttcagtaacttgcccgttgttttttgtttcgtattttagaattttttaattgacaactaaaagtatgtattatgtacagcatgatgttttgatatatgtattaatatacactgtggaatggctaaaataagctaattaaccttgcatacttaccatttttttgtggtgagaacatttaagatctactcatagcagttttcaagtatacattacagtgttattaataatagttaccctgttgtacagcagatctcctgaactttttcctgactgaaattttgtacctttcgaccaacatctctccaatcttcccctccccctagcccctggtacctatcattcattgtactatctgcttctatgaatgtgaccattttagatttcacatacaaataagatcacacagtatgtatctttttctctctgtcttatttaacttcgcattctccaggttcattcatgttatcacaaatggcaggatttccttctttcgtaaggctgaatgatactgtattgtgtatatatatgcaccacattttctttatctgttcatccattgatggacacttagcttgattctttatcttggctattgtgaataatgctgcaatgaacataggagtgcagatatctcataggcacactgatttcattttcttcagttatgtacccagaagtagattcattggatcatatggtaattctatgtttaattttttgaggaacctccatgctgttttccataatggctatattactttacattcccaccaacagtgtacagagttgccttttctccacactctctccaatgcttatctcttgtctttttggtaatagccatcctaacaggggatatctcttcatgattttaatatgcatttctctaatgattagtgatgttgagcatttcttcatatacctgttagctttttcctttagttgcctgtgcttttggggtcgtgtacaaaaaatctttggccagactaatgtcaagaaacttttaccctattttttcttctaggagttttacagtttcgggtcttaggttgaagcctttaatctactttgagttgattgttatataggaggtgaaataagggttcaatttcattcttctttatgtggatatccagttttccttacaccatttattgaagagattgtcctttcccccattatgtattcttggcacccttatcaaagataagttgaccataaatgcacatattaatttctgagttctctgttctgtttcattggtccgtgtgtctatttttatgccagtacctggatttttggattttgttttcattttgagatagagtctcactctattattgctcaggctagagtgctgtgtctcccacgctaaagtgcagtggcacaatcacggctcactgcagccttgatctattgggctcaagcaatcctcccacctcagcctcctgagtagctgggattacaggtgtgcaccatcacacctggctaaattttaaaattttttgtagagggagatctcactatgttagcccagtctggtctccaactcctgggttcaagcagtcctcctgccttggcctcccaaagtgttgagattacaggtgtaacccaccaaacccagctgctatgctgtttagattactacggtttggtagattttgagatcaggtagagtgatgcctccagttttgttctttttgctcaacattgctttggctattcctggtattctgtggttccatatgaattttaggattgtttattctgtttctgtgaaaaatgtcattgaaattttgttagagattgcattgaatctgtagatcactttgagtactgtggacattttaatattcttctaatccataagcatggcatatctttccttttatttgtttcctcttcaatttctctcatcagtattttatagttttccctgtacagatcttacaactctttggttcattattcctaagtatttttttttttggcaagattgtaaatggtatttcttttttaattcgtatgttagtgtatagaaatgctgatgatttttgcctgttgattttgtatcctgcaactttactgagttcgtttatcagttctaacagttttttggtagagtctttagggttttctgtatataagagtatgttgtttgtaaacaaaaaaaatttaacatttgattgtgatggcttatccttgtctaactgttctggccagggcttcaatactgtggtgaatagaggtgctgagcatgggcatccttgtcttgttccctattttagagaaaaaacttttaacttttcactgctgagtatgttagcaaggccttattcagagacaggactagctggatttcctaggccgactaagaatccctaagcctagctgggaaggtgaccacatccacctttaaacatggggcttgcaacttagctcacacccgaccaatcaggtagtaaagagagctcactaaaatgctaattaggcaaaaacaggagggaaagaaatagccaatcatctatcacctgagagcatagggggagggacaattgtcaggatataaacccaggcattccagccagcacgggctaccctctttgggtcccctccctttgtatgggagctccgttttcactctattaaaccttccaactgcacactcttctggtccgtgtttgttaccgctcgagctgagcttttgctctttgtccaccactgctgtttgccaccatcgcagacccgccgctgacccgccgctgacttccacccttccagatccagcagggtgtctgctgggctcctgatccagcgaggtgcccattgccgctcccgattgggctaaaggctggccatcgttcctgcatggctaagtgcctgggttcatcctaatcgagctgaacactagctgctgggttccacggttctcttccatgacccacggcttctaatagagctgtaacactcaccatgtggcctaagattccattccttggaatccctgaggccaagaacccaggtcagaaaacaagaggcttgccgccatcttggaagcagcctgccaccatctcgggagctctgggaggaaggacccccggtaacattatcatatatggcagtggtccccaaccttcttggcaccagggactggtttcgtggaagacagtttttccacagactgggttttgggatgatccaagcacattacatttattatgcactttatttctattattattaatatttaccatgataaagaatcagtgggagccctgagcttgttttcctgcaactagacagtccatctgggggtgatgggagacagtgacagaccatcaggcgttagattctcataaggagtgtgcaacctagatcccttgcatgcacagttcacagtagggttcacactcctatgagagtctaatgctgacactaatctgacaggaggcagagctcagcttcactcacatgcagctcacctcctgctgtgtggcccagttcctaacaggccacaaaccagtactggttggggactcctgataaatggcctttattgtgttgaggtagattccttctatgcttttaatcatgaagagatgttgaattttgttaaaatactttctccacatctatggagtcatatattttttgtccttcatcctattaacatggtttatcacatttatagagtcatgtattttgagccatctttatatccctgagatgaattccacttgattttggtgaatgattctttcagtgtgctgttgaatttagtttgcaactattttgttgagtattttgtctatcagggatattgccctgtacttttgttctcttgaagtgtccttctctggctttggtatcagggtgattcagaccttgtaaaatgagtttggaagtggttcctcctcttcagtgttttggaagagtttgagaagcattggtgttagttcatctttaaatgtttggtagaattcagcggtgacatcgttaggtcttgggcttttctttcatgggaaagcttttgttactgaattaatctccttacctgatattgagctgttcacattttccctttcttcataattgagtcttgctaggttctatgtgtatagaatttatccatttcttctaggttatccaatttattgccatataattgctcatagtaccctcatgatcctttgtatttctgtggtatcagctgtgatatctccttcatttatgatttaatgtatttgaggcttctgtcttttttttcttagttagcttagctaagggtttgtcaattttgtgtatcttttccagaaatcaacttttagttgtgttgatcctttctattatttttctagttgttactgtgggactgagtactgcaagcctgcccttgggatatgaataggcatgtgtgatggttaatactgagtgtcaacttgattggattgaaggatacaaagtattgatcctgagcgtgtctgtgagggtgttgctaaaggagattaacatttgagtcagtgggctgggaaaggcagacccacccttaatctgggtgggtaccatctgatcagctgccagcacagctagaatataaacaggcagaaaaatgtgaaaagagagactggcgtagcctcccagcctgcatctttctaccatgctggatgcttcctgccctcgaacatcgtactccaagttcttcagttttggaactcggactggttctccttgctcttcagcctgctgatggcctattgtgggaccttgtgattgtgtgagttaatacttaataaactcccctttatatgtatatgtttcattagttctgtccctctagagaaccctgactaacgtagcatgtctcccagctgatccctggctaggcagcactactgtcattccacagctgatagaggctcgaagatgagattcggggccatttcaggatctgctgttggactgagggttgcaagctggcccaggggactcagaatggtgtgtctccctctgtgtctttgttccaggaacactgatctaggactgtagctgagaaggcctggagccaagttaaaggatccttttagggtccacagcagagactgaggtcaacaggtctgtctccctaggcactagtatgtgtgacttttcccagtctccatggtggatagttttggaagaggcccaaatccaaatggggctgtagccaagtccacagggagacagggtcatttccaagtccggagccaagatcacagttcatgagtctgccacctggtcgtaggtttgccctctcaaaatgacccttctaggtttttagactccactggggttttagaaactcctgcctaaatcccaaggctcccacaaaggcgcttttgtccagggatggctgcaaaattttttgagagaagcagggatataagcagaggacctcctattccactgtcttgccgacccagaattctctggttagaattttttaaactaggtattacagacaaccatagtcacaggaaggctttcagaagcaattggggttgcagtcttccttgtcacattcaaaagcaaagagctctgcccttgttaataaagtcagagcatagctgactcctgtaaggaaatttctgggattagaaaaatgtgctgggacagagcaggttgtatatgaagattctgtctactttaataagttgggttctgctcgggcactgtcatttagaatgcccagatgactgcaggcagagtatgccatagagattagacaggcatcagttagaatacagagaagtagagagatctggtagcgggtagtattaaagaaaaactagagctggacagtaaactggcagaaaaaatattttattcaggaactcctacagtagagcaggggtgtcctatcttttggcttcccctgggccacattggaagaagaattgtcttggaccacacataaaatacactaacacttacaatagatannnnnnnnnnnnnnnnnnnnatgaactttaaaaattgtaaacaaatttcataatgttttaagaaagtttacaaatttgtgttggaccacattcaaggccgccctgggctgtgtgtggcccacgggccagggattggataagcttgtgaggaaacaacacctcagtatagaactgggctcaattcctaatacaacatggaaaagtgggaatttatagtcaagaaataggttggagggtttgggagatggaaaatcactaagaggaagcatcagggataaggggggattcctgctgaaggcaggccagggtaatcagatatcacctgggggatggcaagaatttttttcagctattgagggtggtgagttattgaggacgggggattctttctaaactgatttagcaggattcttgataaaactgaactatgcaggtctggcaaggacggggcctagtcaggaaaagggttcagaggaacatgactaaaatatggtcaatgagtctttgttcagtagcaaggacacagctacaagtaaactggactttagggacaggagtcaagttattaaaagtcctgaaaaaaatttagggctgggtgtggtggtggctcacacctgcaatcccagtattttgggaggccaaggcaggaggaatgcttgaggtcagaagttcaagaccatcttgggcaacatggctagaacctgtctctaaaaaagaaaattgtaaaagcaacaaatatagaggaagatggattctggatgaggcatcaagtcaagaagtgatagaatcagggcaacagattaagagctcaattactggaaaaagaattaaagttgaggtttggtttcaagaagttagtcatgtgtccagtgactagcatcctagaaccaggtagagatgaggccaagaaaactgggttgatgcagagccattggcttgaggctggaacagagccaaaccaatggtgggcttagggactcctgccatgctgattagtggtattggcaggggcttagtgccaggcaagtcattacagttgcccatatggccactgaacttctaaccttgagctcattaatcctgaataatcagccagttgtaatataattctcaagtataaagtaataataccctttctttttcatgacctctaaagtacaagggatttgctgcagagaaagatccctgttcttgattatttttccttgtgaaatactttagagtttattgatagaacacattaaattataatgttaataattttctcatttatatttttagatgtcagtagttatagttgtttctacaaatagggcacaattctgtttttcttttctttgtgtgaatcccagagtacatccaaccatgcatatttacatgttcttggagcctaaatgaattaaaaattaaagacaaactaagacctttaggtaatggactgaaaagaaattcatttcacgcttttaagatattttaatagaaattcatgttctcttgtttttttcactatgctattgaattaggcaaggccaatgtaaatttagtatactatttatgtttttagggacagtattccaggactccatagaattatgagggagaaaagtattatgatactacatgaagaaaattttttgagcaaataatttgcaaatactgagctaaagttacctgactgttttacttaggactttagtgtgctaatttttgtgactgtccaagacataaatattatatcctgtttcccaaatagttgactatcacaacttttttctcaaatagcatctattaacatttcatgggtttctagtgttccatggaatttaatttgggaaatgctaatcagagttatctcccccttatttattaagaatgttaccatcccaaacagttccatctgtaaatatctccagaaaagatccttcatcctgtgtctgtaatagtaatcactgtcgttcatcttcatatgtttcctatttatgccccaggagtaagaaaataaatataggatgccaaagcacaggataaatacaagaaacaggtattttttctgcctcagggagatgtagcatcctttaaggaacattttctccattatatacaagaagccagagttgttttgaagatgtcccaggtatcactgaaattaatatttatataaacaaaacctaccactttagcacaatatgagaacatttactcttcaaatcagcatctttgtttctctagtttagtgttcctttgatagtacatttgaattaggatttgaatattgaacaacaacaaaaaagtttcctaagtaaccattttctgacctactgttccagagtactcaagcctgtgcttcttattaagtcaggtaaccgtagctttctaatgcattatttaaggttatgaaaatttaattcacattcctctatcagctttcattgacttcaagaatgtaggttagttggatttttttatattctctgtgtgtggtatcattgtcagaaatgtcagtttctgaattactgtttattaattaaatgataaatctaggcatctctttgatgtaaaatccaaaactagtatgatatagaggaattttttagtgaaagctttttttttagacagcttcaaaatgattcataggacccattgttattcactcctattagcaatattcagagccaactggcaaatttccatttcttcaggattctcacttacattaaatgtagtttcaaagtagaccagttgaggcaagcagagtttaaatgacacagctgcattgccctctttgcttgttactttttgctgaaattacatttgctgatatctcttgtggcaatacgttagtgaatcagactttgaatgcatcttatttatggatagttatcaaaattaattataactttgtcaacattagttgatccttgcgtgaaattagttgatcctgctgtgaaattcactcatacttcagaaattcgaacatattttcatatgcttgcaggctgcgtgtttttgttttttaaagttatgtaaaaagaaaaaccttagacaaatttaacagtttaatttagcaaagaacaatttgtgaattgggcactcctcagaattacagcagattctgagagactcctgtcctacctcatggtcaaaggagatttatggacagaaaacagaagtgaggtacagaaacagctgtattggttatcagcctttgcctaaatgcaatttaaacagttttgggcctgtgattggccaaaactgcatgattggcacaagagtaggttaccgtctatttacacatccaattaggttacagttcaccatgtagggagaaaacttttggccaaacctatctaaggagacagctttaggctaaacttaatttaacagttatattcttgtaagttatattttgtaaatattgtaaccctcattataaatatatataatttctcttgtaaagtcatattcatacttcaaatcttaacttttttaaatgtgaagccattcctgaatggctatattattatgtagctgaattagctacatacgtctttgtagctttaatcatattatcctatttagttatctggagaaatctcatcaacagcttgtagagagagaaattttaagtctaatagttcagctgtgtatactgtgtttgtttcttggggttgcctgtaacaaattaccatgaaccacatcttaaaacaaaagaaatttattcgctcacagttttgaaggccagaagtccaaaatcaagatgtcagcagggctacgctctctttgaaagctctaggggagaatccttcctttccttttccagcttctggtggtaccaagtggtcttggcttctggcagcgtgactccagtctctgcctccatcttcacatggcctcctttcctgcatctctttgtcttccccctatctgtctctaacaaggaattagattgaggacccaccctaattcaggatgctctcaagatccttactttagttacatctgcaaagaccctatttccaaataaaatcacattttggggctctaggtaaacatgttttgtgagttatcagtcaaccaactacgtctattgaatatatcacccatatttctatacagtcttctattccatttggccaacaggtatgtgcacaggtgaatgcatgttctttctggaagaggagaggccttttttttttttttttttttttttcaagctgttgagcacatgctgtcccttgcttgactttatggacgttaggccttatacattgaccttgtcattcccataaatattaaactcctcctagaaagtcaccccggacgttttgaatggagcatattaaatatgcatggtcttttatgccaggcttttccaacactcttatttttttactatctttttattgtttcaggtagtcagattgtacatagtatatgctaagttcctttgcttatatagttgacagatcactataaacttgttctttatgcatacaacccctgaaatttggtcttatccaaagatcgagagcatagtggggtacaaagatcattgaacttgtggacaaaagaatcaggttgacatattcattgtgtgaccttagataaatcacactccctgaacttctgttttctcgcaactaaaataaataatcttacctcacagagttttggtgaggtatgaagtgtttaggagattattttacaaagtttaaagcattatataaattaagcagtgctgtattaacatcctgcatgaagggatgctttttgtatttatatcattcaaatatagagtgtttgttagtgacatggaaagaagtcaattagggaaatgttttaaaaggtcaagacatagttgtgtattctttgagcttatagtctaattggagaagagtaactagtaccaataactaggttaagctctgaggaatggatggagaacatgtttgtttgaaagaagtaattatggttgccctcatggaagaagtgagagagaccagaggaccaggaaagactaacaggcaggtagatgaatacagagtagcgtagtctagagtagcagcttgcatacaacactgcaaagaagagtcagatgccatacaaggacatttcagaaactcttcttaaagctgcagactccaaagagaagcagtggtagataaaatggaacaaaatactgcatctcataaccaacttataagaaactgtccaatctgctaagcccttatttatatggccatgtgggtctttgttctccatgaggccaagtggtcttcaaaagcatttagtagaatctctctagtaattgtcacacagacagttttccctagaaaaaaatgacacctttgatattctcgagctctgagtctcagcaagcatttattaagcactaattatgtgctaggccctaaagccaccaaaaagaacaagacaagttcctgtcttgaaggagccaatgtctagtagaggaaagtaacacagaagtgccgtgaaagagtcaacactgaagcagcaagttaatttatcccagatttctgtattattaacctgtctaggcagttagggtaggcttcacaaagagataattcctaggcagaggtctttgccaggtggccgaggatgggtatgccttcttgatagagtgaggtgcttgaggaagggcttgggatgccctacacctgctttttaccaaaacctaaaatagagcaatggagtaggagacaaggctagagaagggagcaaggactgcattataaaggaccttgtgggccatgcgaaagaacttggagtttctcctacatgatgaggagagtgctttaagtgggtgagtaatatgaatcagatttgctgtatagaaacagcctgtggctggctgggcgcagtggctcacgcctgtaatctcagcactctgggaggccgaggtgggtgtatcacctgaagtcaggaatttgagaccagcctggccaacatggtgaaacctcatctctactagaaacagcctgtggccgtactaatgtgagaatggatataggggcagggcaggatagttaggagacttgttaattggacatgttccttatgtagtccaaactggatgcccagctaaaaatcagctatgattttctttatgttaaaggaaaaagcccaaaatgaaagtatatctcatgcaagtctcccagattggccccactactttaatctcttgcagcttctcgaccagagaacagagataactgaggattttatttttctcccttacttataaccacttgtgaagtgtgagttccacactagaagaatcatctaagagtcacagatcaagtaattaaacctctttgttgagtgcacacttgactttgtgtggaaatctgcacttttaaatttgctttattttctaaatgagagtacatttttcaaagtcatgcttttcttatttctaaggaatttacagctcatagcttttccataattaaaattggccatatattaatactcctgcaattctgtatttttgttttgatccatgcctatttttaccagatattcctaattaagctctggattttatacaaaatttacaagaatttttaaacaagacctcacctcatttaggatttgggatagaggagtgattgtgtctttaaaatcgtgtgtttgtgaccaggcatggtggctgacacctgtaatcccagcactttgggaggcgaaggcgggcagatcacgaggtcaggagttcaagaccagcctggtcaacatagtgaaaccccgtctctattacaaacacaaaaaattagctgggcgtggtggcaggcacctataatcccagctactcaggaggctgaggcaggagaatcacttgaacccgggaggcggaggttgcagtgagctgagatcgcgccattgcactccagcctggcaacaatgtgagactccgtctcaaaaaaaaaaaaaaaattgtgtctttgtgtatgatgtgtgtgtgtaaaatttttttaaaaagaaactcttaaaatgtcagtgtgttaattggagtgaagtttagtgtgataaaccagaaaggggaaatgctggtttgtcactataatttttctcttattgaaaacttacattcatatctactgcaaatcctttgttctgtgcaactgataaatccaaggtcacccttatcaaaattttggagatacttagtcttccactggagtgctttttcatgataaactgcatgttttatgagtagctccattatctctgaagtctctgatgaatgccatctggtccaaatgctgggttgcaatttttcaggttgttttttggctccttccatctccccatcctccctttttttttttggataactttttattatatagatactccattgcctatgagtgtttttactgacattctttaaattttctttaacatgaatgatgtctcccttttatttcttaaaaccagagaggataccagcatagcactattttacatcaagtactgttatcaacacaaccacggaactttgttaattcagagtatttccactgatcagtttacagtttatgtattctttctgactagcaagtatattaacttgaaataggtcattttgagtgacaaatctagcctgttatttcagaaacagacaaaatagtattttctacttcatgaggaaagaagtatctatttaaatttttttgttttctccaattacctccctggcgaaaacagcaacagtattgggaactgccnnnnnnnnnnnnnnnnnnnntagataatgagatctaaggaattaaaacaggggttgggagtcaatctaattgggattagagtttcaggggaagacaaacagaaagtgaattgcaaggaaaagaagcaaggtaccaactagacaaccgaagaaaccctgtggaatggacaagatctgtctatttgaagaattctaataaagtagtatggctgagatcacttgcagattaacacttcatgtggtttatgtcctctccagtacctgttctgagttgatggtatacctactttgaactaatttgaaagctagattacaaatgaagtactaagaattgaggccacttctctgaggttactagaagtgcaagcatatgtctatacccaaacaataacacacattacagttgatgataatctaggcattgaaaggtattatagcaaggattgaaacggtctgctccctgggatgcactttcctcaagatccccttgagttgtatatctggatggcaatttaatatcagttttgtgttagcgcagttgtgtatcaaatgttttttgcagtgtctaagtcaaaaatatggtggtgcacgtcctatcccattgacctcacttcactatgctgaagttttatctatggtcagtggagtactttgtactcttcagagtgatggccagtaattccaaaagcctaaggttttctgaatgatctactctcattatctctgcatattttgaaaaagtttatatttattatcttctgacctatctaaccctaattcatatattctctctgcctaaaatcatctcttccctgcctgcctacctcaccaactcctgctcattccttaagatttcatttagatttcaccttcaacttttctgtgaaatgttcttgctgactactttcctccacccaaaaggtaaacttctatccagaattttcttgttttatcttgttaatgcttcgttttcattatcagtttctgatttcagctcagaaatagggatttcacaatcctatcgggattgtgattgtgatgcactttgctcttgtattttacattcagatgcccagtaaatgtcagtgttacttctttggcacttggatgagattagacatgtgcctgctatgtgtccagtgcagaagctaagtcacctctggttccgtcttattcttctgtgcctgttaaccattgcaagatactgtccttgcagggccagtgctacattggctttcctccacagtcctacctacactgttagcaagtcatattttttggagcatcattccatgcttgatctcattttatcatctcaactacttttagcatataagtgaattagaaagcaaaagccagaggtcatacaactagtttctaccagcagcactgtcatgggaactcctagatctatttactcttagcatgtcatcattatgcaatgatattactcccttaccagcaatattggcagtgctcttttttcaaagcagaggcacttaaaatggttagaatagttggttttggttttcaaattgactacagggttattatattttgttgaacagttttctgcacagaatattctgagacttcacctctaaatattaaatcacaggttccaatattctcatttgaaaattgagaacctaattgaaaattgagaacaacttgttattaatacaccttttctagttgtattcttttcaaaattttttggaatttttggtaataggtctaatatgaaagtgtaaattaaagttcttattgcttttctggctacttttttttttcagttatgctaactgctctcttgccttcctctattcagttacttaggtaattttactataaggtttttttagaatcacctcagtggtagtttgaaatatttaatatctttcaaaatctgcctgctgattaaaattttttttctactttaccatgctttatttagccagttcattattaataggcattcacattattgcacttccttttgaagtttgaaaaaatgctgcagtaaccatccttgtatttcttaaaagtagaatttctgggttaaattatatgtgccttttaaatattgacaaatgttttctgtctttgtccatttatgctactgtagcaaaatgccacaaactgcgtggcttgtaaacaacaagaatttatttctcatggttctgggggttggtaagtccaagatcaaggtatcaacaaatttgatgtctgatgagggcatagttcattctagctgtgtctttacatggcagaagggacaaggcagctctatggggactctttttaaagagcactgtcacattcatgaaagctccatcctcatgacctaaatacctcccaaaggtcctacatcctactatcagcacattggtgattatgtttctacatatgaattttaaggggaccattcagaccatagcagttgccaaattttcattattcgtaacagtactaatttacactgcaagcaatttgtagagatgcctatcccttgagaatgcagcatattaccaaagtttttgatgtatgtctgtccagtggtagaaaaatgatatcctacatgactattatttatattataaaattcaaattattatatttttatttgtatttattttacatagtatatatttgcatcttaatatccacttatatctaattttcatgtttgttgtaaggaaagctgagcatcttatatataagagccatttgtattttcatttttataaccagtttgtccatgtcctttgcccattttctattaagttgtaaacattgatttgaaggagtcttatatagtaaggaaataatttattctgtttgttgtttgttaattattgtttgacattgttattaacagccatctattttttgcctgcagaaatttattttattctttttgcaaaactgatcaatcttttgtgtactactgtgttttacatcatagttagaaaaaaaacaatttcgctccaatattatttttaaatttttcattattttaatgtatttttatatttttatattttgttgaggtcttcagtctgcctgaaatttattttgtggtaaatggtggaataaggaagtttttgggtggacatgttttcacttctcttggatatatacctaggagtagaattcctatggtcatatagtaactatgattgacattttgaactgtcaaactgttataaaacagctgtaccagtttacatttccaccagcagtgtctgaggctctaattctccacatcttcaccaacacttgttattagtttttttactatagccacccaagtgagtatgaagtagtatcttattatagtattgaattgcatttctctagtaactaatgatattaagcatcttttcatgttcttattgactctttgtataacttttggggaaaatgtctatttaaatcctgtacccatttttgaattgggttatttatcttttttattatttgtaagagttctttatacattctggatacaagtcctgtatcagttctatgattttcagatattttctcccattctgtgggctgtctttccatgttcttgatggtgtcctttgaagtacaaaaggtttttttgttgttgttcttaattttaattatatcaaatgtgtctatttttttttcctttaatcacttgtattcttcatttcctaaccaaaaaagctctgcctaatccaaggtcattaatattgacccctgtttttgtcccaagagttttatagttttgctcttacatgtaggtttgtgatcagttttgagttaatttttgtgtagggtttaagaaagtaatccagcttttttattttgcatatggatatccagtttcagcaccatttgttgaaaaagctactgtatcaatagaccatatatgtggggtttacatctggactctgaattctctaccattgatctatattggtcttttctgatgctagtaccacactatcttaattactgtagcgttttagtaagtttggaaatcaggtaagtgtgagagctttaactttgttctcctttttcaagatatctttgacataacctgctgatttttccaaaatcagagcacatcaaaagaaatacaaatagcaccagtaaccctttgttttagcatatatgtaatgtaaatagtctcttgaaatttattcttagtggattatttttcaggtactatcccttgattacattagacctaggtactactctggtcaggtagagtctgaacattcatgggctttagtttttttcttgtatttagaggttgaatcaattagataccctaagtccctaatatagcttctaaaaatttgagtcaataatccctcctttcatcttattatagttgaacatgtaagtgtaggagagaaaaaatgtcctcattagttagtattaatgaaacacccatgttgtacaattcacagtaagttttaaaatggaaaactagaatgattgtgagtgctatggcaaatggcttgaattttggtgactcataaaattctacgagtcctcattcactatttactttccatattagaaagtaaacacaatctcatcttttaaattacaacccaaaaggcaattttagaaatatttatgttgtaaagtgagggacttcgacacaccactgacaacactagacagatcatccagacagaaaatcaacaaaaaaacactgggcttaaattggactttagaccaaatggacctaggagacatttacagagctttcaacctcaaaaaccacaaaatatacattattctcatcagagtatagaacattcttcaaggtagaccatatattaggctacaaaagaagtctcagtaaatttttgaaaatcaagatcacatcaagtatcctctttgagcacagtggaataaaaccagaaatcaattccaaaaggaattctcaaaactacacaaatatatgggaattaaacagcctgttcctgaatgatcagtatgacaaaattaagatggaaatttaaaaaaattttgaaacaaatgaaaatgaagacacaacataccaaaacctctgggacagagcaaaagcagcgctaagaagaaagtttatagcattaaatgcctacatcaaaagaatagatcacaaattaataacctaatgttgcacttaaaggaaccacaaaaacaagaataaactgaacccaaagctagcagaagaaaagaagtaacaagtcagtacagaactaaaataaattgaaacaaacaaaaaaaatcaatgaaacaaaaagttctgttaaaaaaagataaagaaaattcatagactgctcaataggctaaccaagaagagagaaattcaaataaacaatcagaaatgaaacaggagaaattacagctgataccacagaaatacaaaagatcatcagagactaaacaacactatgctcacaaactagaaaacctagaggaaatggatacatttctaaaaacatacaacctcccaagattgaaccaggaagaaatagaaatccagaacagtaataaaaatctcccaaaagcaacaaaaaaagcccaggaccatatggtttccagctaaattccaccagatatacaaagaagaactggtacctggcttaccaaaactgttacaaaaagacaaggaggagggaatcctccctaacgtattctgcaaagccagtaacaccctgatgtcaaaaccaggcaaggacacaacaaaaaaagaaaactatagaccaatatctttgatgaagatagatgcagaaatcttcaacaaaatactatgaaacagaatccaacagcacatgaaaaataaataaattaacaccacctgcagaggaggctgaggaagatggatgaatagacccctccagcaatcatccccacctatacaaacaccaaattgaacaactatccacacaagaaagcaccttcataagaaccagaagttaggtgagcaaatcacagtacctggttttaacatcacatcaacgaaaaaggcactgaatagaataggaaagacagtcttgaattgtctaatctgtctctccccatctctcagcagtggcagcttagcgcagagagtgcttaggggagggagagcgcagtaattgtggggcattgcattggagctctgtgctgccctgtcacagtggaaagcaacacagggcagaattcagccagcacccatggaaggaacatttagaccagccctatagctagggggaaccatccattccagcctttggaacctgagttccagctagccccaccagcaaggctacagtgctttgaggtcctaaagaaatcagaaaggcagtctaggccacaagtagtgtgattcctggacaaatccttgtgctgtgctgggcttggagccagtggacttgaggtacatgtgacccactgagacaccacctgtggtggccagggaggtgttcgcgtcaccccaccccaaccctatgcatcacagtttgcagctcccgcagagactccatccttggtctgaggagagaagaatgggagagtgaagaagactttgttttgcaatttggatacagctcagccacagtaaaataaagcaccatgctgagtcctaaagcccccattccaggccctggctcctggatgatattttttacttaattttttttttatttcaatagatttttagagagcgggtggtgttaggttacatgaataagttatttagtggtggtttctgagattttggcgcgtaccgccctgaacgtgcccgacctcatccggatgacatttttagacacatcctggaccagaagggtacccactgcctgaaggaaacaacccagtctaagcaggattcatcacctaatgactaaagaaccctggagccttgaataaacatcagcaatagccaggcactactcaccaatgaaccttggatgagacccagtactgtgctggcatcaggtgtgacccagcacattcccagctatggtgtccacagagaaagactccttcttgaggaaaggagagggaagagtaaaaagactttctcttgcaacttgggtaccagctcagccacaggaaaagaaagcaccagtagattcctaaagtttccagttctaagccctagctcctggacagtatttctagacccacccttggccagaagaaaaccccctcgccctgaagggaaggacacacgtctagctggatttattactgctgactaaggagccctagggctcagtggtagccaggcaatagttgccacaggcctctggtgagacccagtactgctccggcttcaggtctgactcagcacagtcccagtggtggtgaccacaggagtgtttgtgacccctttccccccaattccagacagctcagcatggagagagagattctgtttgtttgaggaaaggtaaggaaagagaacaagagactctgcctgttaatccagagaattctggattaggcaaacaaaagccaagagatttttgtcaacaccagacctgtcctacaagacatgctaaagggagttattcagtctgaaagaaaaggatgttaatgaactataagaaatcatctgaagatgcaaaactcattggtaatagtaagtacacagacaagtacagaatagtataaaaccataatcatggtatgtaaactactcatattttgagtattttgagtagagggactaaaagatgaaccaatcaaaaataagtactacaaccacttttaagacatagacagacagtataataagatctaaatagaaacagcaaaatgtttaaaaatgggaagagttttattggtttacagtgtagagttttattggttttctctttgcttctttgttagtgtgtttatacaaccacagtgttagcttatcagtttaaaataatgggttagaagacgttatttgcaagcctcatgataatctcaaatcaaaaagcctacaacagataaaaattgaaatgccagaaattaaaatgtaccaccagggaaaatcacctttatgaacacgaagactagaagaaaggaaagaaggaagggaagactacaaaacaatcagaaaacaaataataaaatgacgggatatcaaagagatttctgtactccagtgttacatcaagttaaaaaagcttttacacagcaaaggggtggttaatggatacaaaaatatagtaagattgaataagatgtagtatttgatagcacaactgagtgatacagtcaacaataattgtacattttaaaataactaaaagatataattggattgtttgtaacacaaagaaaagataaatgcttgaggtgttggatatcccatttgccctgatgtcaccattacacattgcatgcctgtatcaaagtatgtaccccaaaaatatatacacatactatgtacccacaaaaaaatttttaagaaaacaaaaacaaatgctactgagctatgataaccaaaacagtatggtactggcataaaaacagaatgaaacagaatagagaacccataaatagaatggaacagaatagagaatccagaaataaatccatacatttacagtgaactcatttttgacaaagatgccaaaaacatacattgtagaaaggacagtttcttcaacaaatgattctgggaaaacgatatccatatgcagaagcatgaaactagacccttgtctcttaccatatataaaaatcaaatcaaaatggattaaagacttaaatctaagacctcaaactgtaaaccttctagaagaaaacactggggaaactctctagagcattggtctgggcaaagatttttttagtatatcccaaaagctcaggcaaccaaagcaaaaatggacagatgggatcatatcaaattaaaaaccttctgtacagtgaaggaaacaatcaacaaagtcaggagaaaacccacagtatcggagaacgtatttgcaaactatcgtctgaaaagggatttacgaccagaatatacaagggagttcaaacaactctattggaaaaaaaaaaatctaataatctcatttaaaaaatgagcaaaagacctaaggagacatttctcaaaagaagacaaacaaatgctgaaccaggtatatgaaaaggtactcaacataactgatcatcagagaagtgcaaatcaaaactacaataagatattatctcacctcagttaaaatggctttcatgcaaaagacaagcaataacaaatcctggcaaggatgtggagaaaggggagctctcgtacactgtgggaacataaattagtgcaaccactatggaaaacagtttggaggttgctcaaaaaactaaaaatgtgcaatccagcaatcctgctcctaggtgtatacccaaaataaaggaaatcagtatatcaaagagataatctgcacttccatgtttgttgcagcactgttgacaatagccaagatttggaagcaacctaagtaagtgtccatcaacagatgaatagctagagaaagtgtgatacatatacacaatggagtactattcagccataaaaagaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattaactcaacatggattaaagacttaaatgtaagaacctgaaactacaaaaattctagaagaaaacctaggaaaaaatcttttggacattggtctaggcaaagaattcatgactaagccctcaaaagcaaatgcaacaaaaacaaagatagacaagttgaacttaaatgaactaaaaagtttctgtatagcaacagaaaaaattaacagaatgaacagacaacctatggaataggagaaaatacttgcaaactgtgtatctgacaaaggactaataccagaatccacaaggaactcaaacaactaaacaagaaaaaaaaaaaacaaccccattaaaaaagcagacaaaggacatagacatttttcaaaagaagacatacaaatggccaaaaagcatatgaaaaaaaaaatgttctctaatcatcagagatgtgaagattaaaaccaaaacacaataccatcttacaagagtcaggatggctatagttaaaaagtcaaaaaattacaggtgttggtaagaatgcagagaaaatgggaatgtaaactagtacaaccattatggaaaacatttgaacatttgtcaaagaattaaaaatagaactctcattttatacagcagtcccactactggatatttacccaaaggaaaagaaataatgtataaagatacctgcactcatatgtttatcgcaatgctatttataatagcaaagcattggaataaacctacgcgtccatcaatggatgattggataaagaaaatatagtgttatataccatggaacactactcagccataaaaaagaatgcaatcatttattttgcaacaacatggatagaactggaggccattatcttaattgaaataactcagaaacagaaagtcaaataccacacgttctcacttataagtgggtgctaaataatgtatactcatggacacagagagtggaataatggacattggagactcaggtgggtgagtgggatgaggaactacctaatgggtacaatgtacactattcaggtaatgtaactaaaagcttcactgctgtgagatatagccacataacaaaactacacttgtactcactaaatatattttttaaagtaagaaatatgtatactgtaatagtctttctgtgcaaataagatgtacttcctatgacagtgacctattaagcctaatggaaatatatttctaaatattttactcgtatttctgatagtaagcagttctcccttctaggttctctgcttatgtgacctattgaggttttaagcacaattttttggttataatttaaatcgcatatacttatcttcactaaagcagacccattgacattctgcgtatcagtgacttttacttctttaaaattaaaacagagaatttagtagacataaatttaaatatacacagaaataaaaagagcaaaaaaaagttagatgtattttccctaaccagtttttcttttaagtatcatatacatatatagttttctctattacctctttcttttacaatacttgaagacttctgtttatgtcacctattgcctaattttattaacttagattagaatttatgatcatttgatttgttgatgtgcagtaacctacactttctgtttgtaaccttgatgtatgcattaaacaaaattttttataatttagtagtttaaagcctcataatatacagttatttatataattaggaaaaaattcatcaagtaattatgaacggttttcacaaatgaaatgtaatgtgttccaccctttgttaactaggaaaagtagcacaaatcctgttttttttctactttgaatacctagtttattggcacagaaaagatcaaattatatatcttttgaataaatgttggtttacagtgtccaaaatatttcttctcacatctactcttcttttctagccttcccttcagaaacttcttgttcttggctttctgatttcttactgactactcttctcctggatattttggctcatggaccttcaagtcatcatttcttcctttcagttattcctttaccgctaccttaagacagtgacagcagtcagcacgtacattgttttgggatcaatccatagattctgagtgctagggcaactgggtaaaggtgacagagaatgccagttgaagctgcaaccacccttctctcttaccatggctctatattattgtgaccttttagatcctcttctcatgtcttttctaggccattgcaagggagaagctccattccatggttgttgtggatacgttcgttttctatgctatgtcatagcatagtgtcataaactatgtcataaacacaaaggttttgtgatctagcctcacaattctggaggctggtagtctgagatcaaggtgtcagcaggattggtttcttctcgactgtgagggagaataagttcaatacccctctcctaccttctggtgactttccggcaacctttggcattccttaatgtattatcccaacctctgctgtcacctttacatggtgttctcctttatgtgtgtgtctctgtgtccaaatttttcctttttgtaaggatatcagtcatattggattatgacctccaatggcctcatttttacttgattacctctgtagagaccttgtttccaaataaggtcatattctgaatacagtgggttgggacatcctatctttttacggagacacaattcagcacatatcactggatatcttataatagccaatgtcagagtatccaaaactgggacactcaccttcttcctttgataagcatggttccacaacgtaaggaagggaaagtcttctgttttccttctttgccccttacactgtcactaaagaatgtccaggtagttctcaaaaatataatggcccaggaactacattggtataaaaggtaaggccgagtacagtggctcatacctgtaatcttactattttgggaggctgaggtgggaggattgcttgagcccaggagtttgagaccagcccgggcaacatggcaacaccccatccctacaaaagatacaaaaaaaaattagccaggcatgatggtacacacctatagtcccagctactcagaaatagaaagctgaggtgggacaatcatttgagcctaggaggtcgaggctgcagtgagccgtgatcatgccactgcactccagcctcgcgacagagcaagaccctatctcaaaaacaaacaaacaaaacaaaacccaaccaaggtaagtatatggcaatatttgtccacaaagagcttaataggaaatttgatattataactgagtactaaggggagcagtccaaaagtaaatggaagatgagaagaaaagcctttgaggacctaagagagccagttctagaggacctaggatttggacctcatttgagattggatgatgcatagtaaagaaaggcattgcaaatgaggaggaagcatggtgagtttggagtctgtgtggagcatcagtttgtatggaagacatagccagtgaagacactgactggagcagatttatgtggaagcaggacttttctgtcttgttctccttggtaccttcagtgtccatccaaatgcttggcatacagtaagcactgaataaatgctgatttaatgaatgactattagaaaggcagagcaaactattttggttagtgaggaaagaaaaagaacatttatcttaggaatgcaagtcgttttaattattaggccccagagagacatttaaatgagactgcagtcatgccctgctacctgctttgagttatgtattcatctcttgaaactgcttgctcttgccacaagtacctacaaattaacctaataatgccacattgcacactgtaacccataccctatagtttagcaatgtataaccaatcactaatcaatgtttttgtataagccagtgagaattcctgacaaacaactttgtatcagtccactccctgtcccccttttttgcctttaaaaatccacttgtaattgccgctaagtggagggtatattcagggcaacttaaatctgtgctcctgggttgcagtcttcaagtttggcccaaatgagctctctacttgtattcatttttgtctccgtttcttccttttggtcaacattagctagggtagattaaaataggtgcagaaaagttcaaacatgatggaatacggtgcagctataaaattttgagatagcagattgacatgagcaaattgtattaggaagattagtctgagagtaacataaaggcaggatgaattcaagcttagagtgttggaattctcagaaatgaataataagctagaatgttttggaaataatattggtgtgaggcaaagaagatgtgaagttggaaatagaagacagacaaatctaagagatacatgttgaatcattgagcacctatcatgttatatgactaaatgtttttttaatttattataatttagaattagagagtctttgagattgtaacataataggcatccaggcacggatgctcatgcctgtaatcccaccactttgggaagtggaggtgggtggatcacctgaggtcaggagttcgagaccagcctggccaatgtggtgagaccctgtctctactaaaaatacaaaaattagccaggcatggttgcgggcgcctgtaatctcagctacttggggggctgaggcaggagagtcacttgaacccaggaggcagagatcacagtgagccaagaccatgccattgcactctagcctgggcaacaagatgaaactccatctcaaaaaaaaaaaagactttatgagaccttggattttaaaagcctcaaattaggccttatactttttgggtactcaataggtgtcagtggacaaatacagaagaaggtaaatgatgtagaagtttaatttccaccttggagagttgggtaatgatttatcttttgtgaaaagtgtgaaatcaagaatctgtgtttctggttgtcagggacataagaaaatttaatgtatttccaagatgactgcagtacatgcaggtagtcttaggatatgcctgttgatcatgactgcagatagagactggctcatctgggagagtggatgtggctctgaatagggggtgggggttgaggggggcaggtcttatatttggttggttttattttttttttttcataaagagaacagcattaaaatctcaggaagctcaattaagggtcagaagaatgaacaagtgctaaaacaaagggggaaaaacagaatcataaaacaactaaaatagagatttaaacagagctttaatttttccaattataataatgcatttataataacacatcaataaatgaaattatgtaacactagaaagtataaaggaaaagggaagaaaattactctataaatctaccaccaagagataatcactgttaatcttttagtatctattcttccacacttttctgtatatgtatgtataaacatgtatgatgtttatatgtgtatatatgcatttttttagtaggatcattccataaattctgtttcctagtctgattgttttaggcttaatcgcatatatcttcgtacatttaactatacattcaaaaatgatagtcatcatttttggtgactatttaatgttccctgaattcttagctcttcttttccatcttgcacatgggacaccttcttactttttctctccagggacttctcttcatggaagaaatttgccttataaaacacaatctggattgatgtatcttttcttaccaagttatctgtgctgttggttctgcctgttacttccatcctgttgattcttttgtgtgctcgctagcctgtactgttaactccaaattctacatgtctagacttgacttcacattcttttctcactcatgggtaatactagttgtggtccaaaaactgtcatcctaacattgacagaccagaggttcaactgttctgagctgtttgagtccttctagctaaagccttggaatctccacagttttctgtctaaagcaattttatgttgccaggatgggctgaggcaggagggcacttcattactgatcttttcccttttgtgttttaaccaataaatacataggtccaatgaacaaaataagtaataaaatattggctttaatactcaaaattaggggttccctcttaaactgttagtagatgtgactttgtactgtgttaaatgagccatttgatccctttcatgcctcggggattggaagagagaggtctgcttagtagatacttaaaccagatagctgtgtaagaatagctttgcaaacttagttgatagtagaaagcaggagagagtcctgaaaaagaggtacctggatgatgtgttcaagcacaggtggtcaaagagaaggaaataggagacagagttgagtattgcgggaagtcagggaccccaaatggagggaccggctgaagccatggcagaagaacgtagattgtgaagatttcatggacatttattagttccccaaattaatacttttgtaatttcttatgcctgtctttactgcaatctctaaacataaattgtaaagatttcatggacacttatcacttccccagtcaatacccttgtgatttcctatgcctgtctttactttaatctctcaatcctgtcaactgaggaggatgtatatcgcctcaggaccctgtaataatttcattaactgcacaaattgtacagcatgtgtgtttgagcaatatgaaatgtgggctccttaaaaaaagaacaggataacagcaattgttcagggaataagagagataaccttaaactctgaccgccggtgagccgggcggaacagagccatatttctcttctttcaaaagcaaatgggagaaatatcgctgaattctttttctcagcatggaacatccctgagaaagagaatgtgcacctgggggtaggtctctaacctggccccccgggcgtttagtctcaactcttatggtcgagactgcagagatgaaatagactccagtctcccatagcgctcccaggcttattaggaagaggaaattcccgcctaataaattttggtcagacgggttgatctcaaaaccctgtctcctgataagatgttatcaatgacagtggtgcccggaacttcattagcaattttaatttagcctcggtcctgtggtcctgtgatctcgccctgcctccacttgccttgtgatattctattaccttgtaaagtacttgatgtctgtgacccacacctattcgcacactccctccctttttgaaactccctaataaaaacttgctggtttttgcagtttgtggggcatcacagaacctaccgacatgtgatgtctcccccggatgcccggctttaaaatttctctcttttgtactctgtccctttatttctcaagctggccaacgcttcaggaaaatagaaaagaacctacatgaatatcggggcaggttccccgatagttgagagtagtgttttcaggcaccctgccctgataatgttttattttttaacctctgctcctcttgtggggagaggtgaacaaagagatagaaaagcttcctccccaaccctcccaagtggtggaagtcttgctaagaatgttggtgtgagttgcaaaatgagtgtccctctcaccaataaacattaatttttatccaaatcattttgcatcttctaccagtctcccttcttcaagtcggctgtcagcacatcattcccaagttttaaaacctagtgcctcctgttttctttttcaacaaatatcaacttttatgcctacttttctagcttataatttccacccacctttatttctcactaaccttcatattcctcaggtcctttttctttgcatttcttgtttcttcctctcttccaatcatataaatcctgcctagccttcaaaaaccaacttgaggaagaatccacacttggaacttccctctacttgtcagacccagagtgaatttttctcttctcagtttgctgcatgtttatgtgctaaatttaatgatttttaactctaatcccagagatgcctaagatccaaggagcctcattggggatgaaggacagttggcacagatggcacactgaagactccctgtaccctctttaaccaaaaagtttctgctcgtacagattttatataatgggattttatgtgagataatttggagagagttccataacttaaaaaagtgtttgagaaatgttgctctctaataataataccaactcatgtgttactcagtcaaatgaaatactgttacttgcatttttgttttatatgtatatgttttgtctcataaattacactggaagctccttgaaattagttatctttcttttccccaatggggaaggattctagatagaatcaacaaacctagaatctggggacctgcaatattctttactagtgatacccttggacctgagactaaatatttgatagctcccttcttctgtgtccttatctgaaaagtagtaatgaggtattaaattcttcagatgaaagagtgattaggcctttgtattgaagtgcagtgccaagcaaaggggatgtattctgttgattgattcatttttaaatttcattttatagatctatgaaattcatactgagattttaagtgacacaagcactgcctctctcagtaatatctctcatttttaaagacagcttataagagagtgtggtacataacacaaaggaatggattgataaagatatgatatcatgcattagcagcaagtaaggaggatagatttttcaggaatgccacttcaattatcagttttttgtgagactcacccagtcttgtgacataacttctcaatcccatttatgccttttggcctaacttttttacactgatgcacaatatgtgaactggtacattttactgaactacatgtatagcaaagccccattatttatgtttttcttactacattatttaagaagtatacagttaatgaaagttccattgatttgcttatttcctttggattacaactacatttgagatgcaagagggtagcttattgcaattaagaagtagaaaaacaaggctgctgagtggaatactgaactgagaataaagtgcctttgtcaccatagagccccgttgttctttaagcattttgttaaaagagtgaatgaatggagcaggatagcacaatattttttctgtgtgcggtacaagggtagagctgtggttttcttgagtcactgagacagaaagaagaaaaacttaaaaagaaacaaaactcttttctggctaaaaggtactttatacatatatacccgtgatgtcgctaggataaaaataactttgcccaattcctgaaaaggaattctactgggtagaatcaacaaacctggaatctgggggcatacaatataatttaccagtgatatccttgggcctgaaactaaacatctgatagctccctgcttctgtttccttatctgaaaagtagtaatgaagtaccctcatcagatgaaagtgattagacctttatattgaagtgcggtgacaacatatggtgaaatcctgaccatgagatccagtaaaagaaacaaaagatactcagcatttcaggctttgtatagtcagtgagtaaataaacaaagaaacaaaccaaagagtattccctaagaacctagatgtagtgtcttaggaactgggccacctactgaggatagaacgatgaataaaccaaggcttttgtccttgagaaagtcacagagaggaagcaggcctataaacaggcaaatcacaatatggtttgataagtagtgtctgtgaatggatttgataagcaggtatgtttaacaaggaatgcgcagggaaaaggtaaataggattttgacatcttcaaagaggaggttgtaatggaaaaggcttcaaaagggagttattttgaagactgtattgctaggcattcaacatcaaatatcgggtgtggtaaatcttggtcctctgttgtctaaatataataatttaagaattttcctgttagattttcttctaaaatcaaagaactgaaatttgaaatgggaaatttggagaaacttccatggagatggcattttcatttgctaacgttgagtctaaaattctaatataagtatcgttacaaaccataagcaaactgatgcatacaaccacgtgtcactaaaagcaatttctaacgatacttgctacccaacctgttgaaatctacctctcatgttatttttctctctctctgactcttcttaatttcattatttgaaaaactgagagcaggccattcacctacctttctccattcctcatctcctgaactatatttttttacctacttgagccctctgtcccccatatccagttgggcaaatagctcatccttcccatgtagcccccagcctcagggccatcatgccttattgtacataataaaatcctgcaatgttatttctgccacttttccttctcatcctttcaaaaagatgtttttgttttcttccctgaattgcaaggagattatgcatcttctaaagatggagagatctatatatgatcatctcttattattaaatgataatttgtaccttaatttacagaaataccagaaactgtacaatgtgactttgctttattttctcagaaatgctaaagttcttttatcatcattattattattcatcagttctcctcttttcattcacttgtgtactgatgacttctttctagtttgtccccatagcaacactggataatgctaatgaaactgcaacatcttaagctctcccacagagcatctctgttaaaatagccatgaaacactattttctttccttaaaagaaatcagtattttggaatctctctcatgatcaagacttaactttctaaactgtctaactagcattgaatctttaatttagagaagcttttcagaaagcaataaaccacatttgagacaccatcttcttccccacattcatatcacatgttggtatacagccatggttctcaaaatatggttccccagcagcatcagcatcacctgggaacttgttagtgttgctaatttacatgccatactccaaacctactgaatcagcaactctgggaatggagcccaatactctgtttaaacgagtcctccaggtgattcaaatgtgtgatacaattcaggaaccactggtgtacaggataggcagtgctgtagtaggcaacaacatcacatccagtttgtgtgtgtgtctggggttgtgttgacatgattggaaattaatgttctgtttgttttttatggcctctaagtttatttatgctatgaaatattagctgaataacaatttgtgttaaaataaatatggcattacacaatgtcagattagctaatgaaaagaagtgtttcctaatccttatttatctgttattaacaagtgtaagaaaaagccaagttaagatcaggtgtggtggctcatggctgtaatcacagcactttgggaggccaaagcgggaagattgcttgagcccaggattttaagaccagccttggcaacatagtgagaactcgcctgtagaaaaaatgtttaaaaattagccgggcgtggtggcatgggcttgtagtcccagctactctgaaggctgaggtgggaggattgcttgagcccaggggagttcaaggcttcagtgagctgagatcgcgccactgtactccagcctgggtgacagagccagatcctgtctcaaagaaacaaaacaaacaaacaaacaaaaaaaacaagtgattgccatttactctatagtagtaggtaatgacttcaactataaaagtgtgtggtttttttctatttttgtttcttaaatggaaagctaatatatttcaattgtgtggatgctgacaaatattcacctttttgaaagaagtcttttaaatagtgctttttctgtttgtggttaatacttcattctttttatgcttaaacacatcaaaagcatacagtaaaaaaagtgattttttttggaaactatgacttagcaaaaaataggaagcagatataatagagaattgcaaaaaggacacaagttaactttatcacataaagttttaagaggcaggtaggatccagaagttgaagatccaggcagaaatttaagtctctgagacagtattaaagttaagtattaaaaattgctgttcaccacaaaagctgaaccacctctatgctaggatgtggtaacagagcctaaagaagttgcattgttggtggtctggccagacctgaaatcccacatgtcaggctataatataaagagctaaacaggattcagaaatcaagataagcaagaatcctttgatcaggaatccagatgtcagttagtccaaggaatcagtaacaatacagtaattcctgctacccactgaagcctgatataataagcacctggcatgtgccccttcctcttgaggatcactgcccaaattcagaccctcactgtatctcacctgggctgttgcaattgcttccttattggagtcaaatcactgaatactaataacattcagttttgtgaatatgcagtctctgccttccttccgtatgcgccttgaagtgccctgcttttccacactggacttgctccttttatgtatttgtacttgcccctatgtcttggttcaaataattgacttgttacactttggcagattagatgctctcctcaccctggattttctctcgaccttgcacatacctttatttaaaacaaatgccatgtattatcattgcttgtgttgctacccattctttgagactagaatctatgtcttcatctctctagtcctctctcctagcttggtgcttagcataccataggttttcaataaataatttttgaatgattgaataagagatttctacatataataggcatggcacacgtaaatcatggattttcctaaataattttgatttgaaatatttagtccttttctttcagctatcagtaattttgaaattcagctatttgtgtcccaaatttatctcctgaatgtcttatacatagaaataagaaaaatcccttgaagttaccacctaccagggacctagcaagaggaagactatactcttgaggaagggtatgttagccatttaagaacatctccagggaagtccattaattaacttctttggagttttttttttttttttttttttttttgagaaagagtctcactctgtcacccagactagagtgcagtggcaccatcttggctcacttttgctctctaagtggctcacctccacctcccaggttcaagtgattctcttgcctcaacctagcgagtagctgggattacagatgtgcaccaccatgcttggctaatgtttttatttttagtagagatggggtttcaccatgttggccaggctggtctcaaactcctgacctcaggtgatatacccacctcagcctcccaaagtgctgggattacaggcgtaaaccagtgtgctggccacattaatacagtttaaagctggggaatgggatagaatgtttttgtgcatgcttgagaggtttagtaccataatttttgttcagaattgttagaaatagaccatatagaaaatctgttcttttctttcttctctttgcattttcatacccgtccaaaattcaaaacactggggaaaagtggctagaactgggaaatacaaaacagttctatgtttgttccatgggaaatggattataatgacctttaatttatttggaaacatctcagaaaatataaagttttgtataaggagtttaccagagttctgaagattattatgctaagtagttatttttcaatgggattacacacttcactgactacaaacattgtgtattgatgaccatcaacataatcaatacaatattacttgctgacgccacaccggatatttctaaattgctgtatatttttggtttttgtttccatagttattcttgcttctccttgccttgtgacaattaaacaaatatttacccagcatttactttgtgcaggacactgtgctaggtggtagaaccagaagaataagcaaaacaaacaggcttcctgccttcatcaaacttaaaaactggcaggaaaaatagactttagcagtatttcaacttctctccctatcttaatgggtgctagagagaactgggtataaaatgaatgtttatagcagaagtcaggtcatgaactcagagcctgcaagggacctgccaggtaacagaaatgagggaagtggaatagaaaataagattagataatgtctaaaaacaacaggtattagacttcattagtagattttaggtattagtaatacctgttgttattagactttatttaatcgtgaccactttaaatttactactaccttcagcttgatgttagagtaatagggagtggtaagggtcatggcaaacaataacataccttctctaaggaagcagccatttagatccgattattgaaaagtggaaaatcactcccaatgttatcacaattttcaaatttttaatttttaatttatattattttattttactttatttaatttttttagagtcagggtcttgctctgttgcccaggctggggtgcagtggcccattcgtaactcacagcaaccccgaactcctaggctcaagtgatcatccagccttagccttccaagtaggtaggactgcaggacacaccaccaggcctggctaacattttttttctttgtagagacaggatcttgctatgttacccaggctggcaaatttttttaagccagaatatgaaatcatttttttatgtctactctattcattttaatgatggtaactaattgaaattaaaatattttgcttagcaaataaaatatatcagtgaggtaaatttggcgtgagagttgccagtttgtaggtcctgagagagtgagccttctgcaaggtaagtgcatgaattttagcatctaatttgaatacattttagcatctaatatgaatatacagaagcctttttttttgctttcttcctagttaggattactagattaagcaaatgataataagggatgatgtcaaattatatttgaatttcaaataaacacttcttttttttttagtacataccttgtatatgtcttaactactgcacagaatatacttgtactatgcaaagccatacagtatttggacgtacttacgccaaaaaaaaaagtattctttggttatttaaaattcaaatttaattgggcatgctgtattctatctggcacccctgttcctagcactgtgctactattatgaaactaagttctccaaataagcggcctatggctaaatgaaatgttttaatcatttttcctatgtgttgatgttaattttaagtaattaaaaatttacttttttattgggtgattgctgtttgtcaagatgggcaagcctgcaaataggaagtttaaaataatcttatctatggggaaaatttcttatttagcatttatatataaacttctaaattgttcttaacatgctttattattttggcaccaaaagaattctttctgtggttccaatgaacatttttgtctacatatttaccctcgtgctaccatttgcctttgtgacattaaaaaaaaacaaaacatatcttcataaatgtccccctttccatgttagcaaattgattttcattttaatctttgaaaagctaaattattaatactttgcttcaaatagtattctccctgatacccatgtcactttgcaattgtttttgtactttttgaagttctcttttcttcccttactgatattaaccatctgtattaatgaggtaataaaccaggcttgttgctaatgaattgattcattcagtgctggatttaattagaaagatatttaacatgccagcagatgttctgattttgtttcattacccccaaatataataaaataaaatacaataaatttttatatttttgcataaattaaacagagtcaagatgtattactctgttgtatattgtaaaagcctaactgatggagattttgttactagtatattccaaatattagaaggaaagtcagttttctctttaaaacactcacctaactaattagcataagagtaaaatctaggaataaaaattacgtagtagtagagtgccacgacccccaaatctatagaaaagaacctaagccgcagatacttcccgaagatttctttttattactttaatagaggatgccttttctaaattaaccactaaacaggttacttaagagcgcttaatttcagagacacgtccagtgactttgttttattaactctttgcttttcgtagttttgtttgcagtgtccaaaagacttatttaaaaagaaagaaagaaagaaagaaaaaggcagctttaggagagatttttaatgttcaaggctttatgagagaaattaggatgaaaagttataaatgtgttaatgcatgcacaaaagtaacagctcatacaaactgagtagtccttattttggactttcagcctctagcatgctctttctagaaaggaataaaaggattttgtgcagtgtcccaggtaccatatcaacagatacgtgaattaagcaatcactgacatacaaatacattaggagagaaaaactgttataagatttaacaagtagataagttcatctatcaggtaaacatcctgagatataagtataaaagctacaggcagcacagtggctcacgcctgtaatctcagcacttttagaggtcaacgcgggtgaattgcttgagtccaggagttggagaccagcctgggcaacatggcaaaaccccgtctctactaaaaatacaaaaattatccggcatggtggtgtgcgcctgtggtcctagctactcaggaggctgagatgggagaatctcctgagcccaggaagttgaggctgcagtgagccgtgatcacaccactgcactccaccctagtgataggagtgagaccctgtctcaaaaaactgcttctacagcaccaaaaagattaaaaggaggaagaagacaaaagtaattcctttaccctctccagtttagctttcattgctttgtttggtagttccttttgtttaaaaatatgtcacatattatttacaaatgagtatcatattataaatatggttttctatattttttcatttagcaatatgttctgagtattttcccatactactcaatctctcaaaacacattttaatgacttgcttaatttctataattcatttaagtattgttgggtattgagtcatttctaattttttcctagcgttatgtaacatcaacgtatattcttgaataaacccctcagtcttgctcttatagggtgttatttctaggaagcgataagccttagttaccagttaaactttaattttcaaattccatttcagagtgtaaggaacatattaatttcctaaaactagggcaaaatgggaatgaaatcaggagtgggaggtgggctaggcggagagcacaggtgatagaaatagttgggcctactctagtgtctctgctaccttttctgactttcaagatgaataaagcattgagtgattgtgtttttcatctgaggttcacttcttacaaatttatgatatttttcttttagtcttaacagttcttccaagatttgatagatttgttaatgtcattcaaagccaatcacagaaatgtgtgtgagaaagaaagatcagaactcacaacaataggttacccaacccttaattagtttctattagatcttgcttcagtggttctgtttatgggtttgctcagacagcttgggaagatcccagccaccataaaaacttcagccgttggtcagttcataaactctatagatctctatcattctctgcgttagattcttttaattctttacttggcttcccttgtactataggttatctggtgtcatcagcttcaaccaggtgcataagtgatggaaatgaagtttcagtagtaaagtacatacttgaagactgtccctccttttaccttttctaaagtccattttacctaacatacaacaatttggttttcagcttatttatttcagaaataaatttgctacatcccataaatgcaatggatggcatttcatatgcctagctctatctactttctgattatgtttttgtttttcagattaagaaaactgattattttattttagcctatatcgacaatcatttcttgctttttctgtgaggaaagaatgataactctggaattgatgatggaaaaaatactccttttttggtgttaacttctcccctaatttattttcttgcttcttccctaaatactaccacaccacataacatttcaccccaaattcttaaattttttaacctttatgatccatttaggagtgtatctgtttttatgaatttattcataatcttgtctccattaaaagacaccattgctcatttgcttaatcctcttgaatatcaaagcctctagtcaaagctcttgtgtcattcagctcactttcacttgaatattctataatagaaaacttttttaaagcaaggtgacctgaactaccatttgttccaaataaagttcattattggtttttaagtaacatcttttgacttataccaaggcactaaacatttcagaatggtttagtttttaaagcactttgccaaaggtttagagtattatcttctattaaacattgattcttctgttcagtgtcttgtagcatatgagtacctagggtgtactcattttctatagaaattggtgttccctaactcactattttctatttctctacaatgagttcttttcactactctcagccagcctgcatgtaatagctctcctccttcctacaatctgcccttctagtttcgcagcctcaatagatttcgtctttcttcatgccctatcttccaaattactgagacatttaaaaaagcaatacaaaaaaaaaaaaaaaaaagatcattgagccacgtgtgtagactgcttgcccagattaatggatcttaaaatggccaagctgctagctaggaattttcagctttatattaaatctcagcatgcaagccaaaaagagagcactgtatgggatattgtcattacaaagagaacttggtactttaagttcctatagcaaacagtatttttagattcaatttttatagggattgtctgtttgccatagttatttatttatgaaaaaagtacacggtttacatgatttattttctgtattgatatattaaaggctaataagttaaatatataaataaaggtaatttatgacaaaaagtttgttctgtagcattgccctcagaatattttataaacaatatagagggctacatatttttaagaaaaatattttgtcttgatagtataaaaatgtgccatttttcctatttagaaactcttcaaagcttagcatttaagaagttatattttatatttgttccaattagaaatatggatacttttggttataaaagttgatatataatactgcctaacttcatagggacttagacactcacagtgtccataaaaaaataataaaaatagtacagagcagtaataaaatatatattgtatttcattaacaacattcctgctgtcaagaggaggagggaaaaaccagggtttctccatcgtaatccaaatgttaagatatttgctcagggagtgtattatgagctataatgagcttgggctctggagtcagactttatggatgccagtcctctccatttcttactggcagtgtaacccttgtataacctttttgtcaaggaagggcctctactcaatatgtgaaacagaaagctggatttactgttgttggacagtggagatacgtacttgtaaggcacagtctttctgaataaagcagactgctgatcttattgagggttttgagactagtagaggttagggactggccaactgtcagaagcaggagggtgtatggggattgggtcccattagctatggcagtatagtcattaaatgaggctgttgccaatgattcagaaatgtggtaatggaattgagttctcactgacccattgggatgagtttaaaactgtttatgattcttactacttaacaataataaaactgccttcctcataggacatttctgataattaaatcagagactacatgtaaaattcctagcatgatgcctaatagaaacaggccttcttctttatcagtctgaccttaaagagagtaaagcccttcaactatgaaagccccagcttttgtagcttcagatcatcacactgggcagtgtggcctctcaaatttgtctcactcctcagtgttatacagtacatgctgttcatttgcatttgtgtgtgtagttaatacatggctctgcaatgtcagcattttctgcagtatttgtctcagttgtaagtagatatcatttgctttccatgccagtgggctttttgtgggtttggttttgttaagcttttatgagcatcacatatctctgtgagaacctgttgaaagctgtgaacactatcccctgagaaatgtgcatataaatatacacatttttgtgtacagtttattgggttctcaggcttcatgaaagttcaggccctgctcttcagagctacctctgttcaaaaggataaattctctgtcagaatcttcacctctggaaacacagatttcagttgtaaaacattgaaaaatataaacaaaaacagcgccttagaaaacaaaatgtatcttggcatttcaaagcaaaggttgacattgactagataggaggcttccagctcctgccagccacaatgaccttttctaagcaaaagtgtaggccagggcaatgggttttgaatattactgtgcataagccaatggattatgtacactaatattcattagcttatgtatactaatattcaaaacccgttgccctggcctacacttttgcctagaatgcaactcctaaatgctaatgcccaaactttctttagccacaacataatatataagtaaaccacattaaaatgtccatattctttgacctagaaattctacttctaataatttgtctcaagaaaattatcatttaaaaatggcaaaaaattaggtacaggtgttttcactgcaactttatttatggtaacaagaaatgtatgcaacctaagcatctaacctgaagaatcggttaaacaaattgtgttatgtttcaatgttagaatactgtggttcttgcaagtaattttatagaaggatattccatggtgtggaaagttatttgtagctattaaatggagaaaaaaaaagtatcaagaaagtattttttgaaattttaataaaaatatatgttgaaatatacaagtatacctcagagatattaagggtttggtttcaggtcaccacaataaagacaatattcacaataaagcgagtcacatggatttttttggtttcctagtacatgtaaaagttatatttacacatattaagtgtgcaataatggtattatgtcaaaaaataatgtacataccttaattaaaagatacttaattggtaaaaaatgcttacgctcatctgagccttcagtgagttgtcatctttttgctggtgcagggtcttgcctcaatgtttgtctgctgactggtaagggtagtggttgctgaaggttggggtggctgtggcaatttcttaacaaaagacaacaatgaagtttgtggcatttattgacttctcccttcatcaaaactttctccatataagttgttttgcttttttatcatttgtgcgttcagtggagtagcactttcagcccccttcaacaatttttcctttgcattcccaacttggctggttagcacaaaaggcctagctttcaatctgtcttggctttccacttgcctttccactaaccttaatcatttctagcttttgatttaaagtgacagacttgagactcttcacttgaacacttaaaggccattgtaggattattcattgccctaatttgaatatcattgtgtctcagggaattgggaggagaaaggggagaatggcaggtcagtggagcagtaagaacacacacgtttatcttaaagttcaccatcttatatgggcgcaatttgttagctccccaaaacgattacataacaattagtaacatcaagtatcactgatcacagatcgccatatcagatataataatacgaaaaactttgaaatgttgccaaaattaccaaaatttgacagagagatacaaagtgagcacgtgctgttggggaaaaatggcaccaatagacttgctctgtacagggttgccacaaaccttcaatttgtaaaaagcacaataaagtgaagtatgcctgtatatgaagaaaaatcatcataatgttaatggtggttatttctgaatggtgagattatgggtattttttcttttcactttgcttgaaagttttacagtgaactatgtgttcagtttttttattcagaaaattgtttcaaaacactataagggttagtcaaaataatttagtgagagttttaatcaaagtattacattggtcacccaagaagtaaagaagatcactgagagctgttcctttacattttgaatgagaggagatggtaaaagacccagtagtgggttcctctctgtagaaaagaagggtcagtatttggagagggaagggtccagaaagaagctactagaggcagatactttgttggctctgctgtgcttttaaatgataaggacaaatagaagctgtgagtagtattttcatcttactgcagaaagagggaaatgattcctatgaataacattgttacatttactttttaattctttttttttttgacggagtctcactcactctgtcacccaggctggagtgtagtggcgctatctgggctcactgcaacctcccatctcctgggttcaagggattctgctgcctcagcctccttagtagctaggattacaggcactggccaccacacccagctgatttttgtatttttattagagacagggtttcgccatgttggcctggctggtctcaaactcctggcctcaagcaatccatcctcctcagcctgtcaaactgctgggattacaggcaagagtcacagtgcccagcctactttttaattcttaagattgctatatagttactgtctggccatcaggttactaacattggtccagggttgtcactaaatataaattcaaatatcaaaaaatgaagacttttttttttgacagcggggtaagagctgcagtagcttctgagatttcagataagatactgaaagacctcaccagcatatcgtaacaaccaaactgacttttgaaaataattataaaatttaggtatgtggagcacagaaaatcctacggaaacctttgaagttttattgtactactaaaagaattgcttcaccaaaaacttgtaatatcagcagtgttgtggtttttttcggtttcgaaatatccctgggctatttatagttctgggtcttctcttagagaattatcagtgtcacataaatgttaaattttaaataaatcattcctgaagttcataaataaaacctgaatgcatcaaaaaatacatacttatattccaataactgtaggaatcatctctttgatattcataaactttctgttctttattcctttttgagtaagagtttgttcattccagtggttttcacaggaaggtaggtggggggtggtaataatgcttcccaaagtattataacaatattctctacctaattgtgaatcactggtttagaacgcagcagaaatggcagcttgcagtgagattcagagcaaagcatctttcagctctgaaagactctgaccactgctatagcctcttaatgtattcttatgtatattggatatgttaaatagaattattgttcccttagcttattttatacaactgaaataacttattttacatttctgtattttatttagtggctatcatatatgatcaataatcattgttcagtggactgctgggatttggtaaagctagtatcttttgatgctgatctcatctttatcagtttcagcaatcaaacattttcctgatatgttttaactttagttatcttactgaaaattatcacgttctatttgaaaggtattatttcttaaatgctttaggctgtatagaatcagaattgagaatgagaaaagattggagaataaagtgggaatacagaaaggacaatgcacaaccctttaataattgctagcatgtgattagcttttgctgcctttttttctctctttctcttgcctacttctaaacatccccttcattttcttctcttttccattttatctattcctttttcactgttaggggatattggctgactaggaaaatagtagaaggtttgaggcttcggacctgagagtcatggagggaaagaaagttttccctagtattgatatttcctttttccagaaaggagatgtcagcccactgaactttcaaaatagcaggggtggcagcttgccccagccaagaccttcaccaagatttccctggatgctcccacagacgagtgaaattctcaagcatcaggaactaacccttttcttttatagggacagatatgcatttttgttaactctgacccagttaagacccattcatatcaatctgaatgattttgtgtgcctattctagaaagtcaaaggtacctcatgacaatttgccatgaaagtgaatttaattttcctataaatcaaatccatcaggaaaatacctcttagtaagtcacagcttttcaactagtgtccagagaaagtgaccatgtatgaaagtacaaaaatggaaaggaagcagagttgaccttcaggaaagaaaagctcattttagatttagggggaaagtataccatatgcctgcatgcacacacacgcacacacaaacacacacacacacacaaaacacagcttagtgactgagtattttgaatcagtttttgaactggaaagctgtagggcttaatttttttttttttaatttgtttaatttgaataggacttaccatgaggtaaagaacagtttttctcaggagcttggaattcctaattagtattatctatatcttccttgaggacttacaatgtgttgctttttgtctttttctgtttgcatatgagatcatttggtaaacactagatcattagcccacataggatcatttggtaaacactagaaatttggagtgattttataacacaagaagtacaaaaaaagtgtatagattattgttcctgaaacttttttgcatatttaaaattaaaagcacaaagtagaaaatattttagaatcatgataactacctaccttcagatcagagtaaaatgtaccaaaaccatggtgtattttaatgcatataattgttccttggcttgcttattttgatttactctcaatttttttaagattactgattatctgttttatgtggtttgtataaacatctggtttggtttcattgattgccacttaataactttagataaacagtcagttgggcattttgttttaatctagatttttgaggagtttcttcacttttaagattctacatctctacaccatgcagtcaacccacagaagtgtaagctaaacaactacttactgtcttaagcttctgtgtgttgggacagtttgttatctggcattaatatgataatacctgactgatacaccttgatttgtcagtattcaaatataattgcctcttgttagtcattagtatagaaccatatggacaatgaatgacaagaccttgaatttgttcatgatcttattcctaggatgcgttatcaaattaaattttaaaatacaatggattttttttgttttttttttgtttgttttacaatttgctgtaaataaaagactctacatctctttgatatcagtgtcttttttccatgaatgaataccccaaatcataagatggggaatcttgagtggtactatgttacctttctccatttaatatgtttatctcactgtatggcatttatgtgtctggattttggggggaataaattattctaggacaattagttgtaaagcatgttttggtaaaccaaacactattttattattgttttgcaggaaaaaaacactggaactgtatcagggaggtacaaagcctcattgttaacatggttgttaacttgaggtagaaacagttaagatagccagtcatttatcacagtggacattggcatatgcaagaagacttgtagcacttcactaaagaggatgccttggtagaaaaaaaggttttgggtcatagctttcttatctctaaagtgggtttttgattctaggtcctttctagctgtaagccatgatatactgtaccagaagcactttttcaatatgtgggatgcctttgttccctaatcccaccttctttatcaagggtttatcaaaatctagaagctgagctgtattatcagactttgccagtagatacctttgtctgtcccagtgtattattcttccctaaaaatactttgttatattcaggtacttctactctaataccatatttgtgttgctgaaaaactttgcattccacaaaatcacacaataagaataatagagatcatatgggggaagagggctagggacagatcgttcaaaaccaatggaactttgtaaccagagcaatcctaataaaaagaataacatggttaagtctccactggattcgcatccagaatcagtccagttaagtaatcccaataaaaaaagcgtaatatggttaattcttcactggatttgcacccacaatcgtagtccagttgattctttgcatccttgaattctaggattcatgcttccttcttcaaaatgtaggtccttgggggcacttacatcaaattgaggtcagtttcatcaaaattaaatatctaaccctgggtatagacctctgtcagtcaggtgtttttaaaacccaggaagaaatgcctttgagggatcttcatcctcattcttggctttcttgaaaatgtccctatttgctataaggaaggacttagaattttcaggagttgtgttaaagatctgtatgtattgctgaggcttgcttttaataatgagaaagctcggccctgattgattcaaaccactgttgtgctggcaaaaatacatatgaaccaatacaacttatattgtattctgacattattctttaatttatcaaatatatatgagcagactcaaaggaacatatattaataaagactgtagtctaattatgtttcataaataatcatttctttttttatcaggtatctacaaaatataatatctatcacaaaatatttcttcttccaaaacctatagaaaaggtaatatgttttcctaaaaacagaaaccattttttaactcttactctacatagtgtctatcttcttatactaacttataaagttataaaattgatcatatcaagttttcattagaacagtggtttgtgctttcacataaagcatatctctgtctaagcagctgggagtagcaaaaaataaaataaaaataaaaataaaataaaatacaaaacatatcccagccatacattagaatctctgtgtaaaaaaatcagcatattttcaaagctcccaagttgattcatacatactgttaggattgagaattgttgcctgaaagtaaaaataatggtattcattaggatgtcattttcagtaaagttccatttagacattccattgaagctagtgctaatcagattaactgctggcagaattcattgttaattgttatgagtaatttgcaacatgtaccatttatgtaaactagacaacctattctttcagagatacgagatttctatcaccttttggatttatttttgttatgtaaaacaggaaatttaataccgtatccaaaatgctaggaataaaatctgttgtgtcttgttttattgtccagcatcattttattccctcatccttcctctttgaagtcaagtgatctttctgatgtggtcacatatttgtagaggattctgttacatcatggagatgggatttatgatacttaatgtcactgagaacatagagtaattgtcagtagacaaataaattggagaattatattttttaagtgtcctgaacatgactgaatctcaggtgttttgcaggagctttaaaagactgcttataactacattttttaaaagcagcccaaatcctgatgggtccaagtaacttgaagaaaaaggatttattaaatacttcaaagtaaggccaaaccacctgccttagcaggcaggcatgtaactggaaatggaggacatgaatctagtgatttagtatcttacttgctagatatgggctatcttaaaattatacttggttctttttttctcctctgatgcttctgacattcttttttttttaattttaagaaagtttttatgggtacatactaggtgtaggtatttatgggataaatgagatatttggatacacacatacagtgcataataatcacatcaggataaatggaatatccattacctcaagaatttatcctttatttgtcttacaaacattctaattttacttttagtgatttttaaatgtacagtacattgttacacagtatcatcactttgttgtactgtgaaatactagctcttatttaatctaactataattatacccattgaccatactcccttccccctaccccctactagccagcctctagtaactatcctattttctatctccatgagctcaattgttttaatttttagctcccacaaataagggagaacatgcaaagtttgtcattttgttcccggctgatttcacttaacataataacctccagttccatccacattgttgcagatgacaagatctcattcttttttatggcagaatagtactctactgtgtataccacattttctttattccttcattgacagacacttacgttgcttccaaattttaactattttgaacagtgctgcaacaaacagcagatatctcttcaatatactgatttcctttatttggggtatatacttagcagtgggattgctggatcacatagtagttctatttttagttgtttttgtttgtttgtttctttgtttattttttcgagacagagtcttcctctgtcgcccaggctggagtgcaatggcacaatcttggctcacttcagcctctgcctcccagattcaaacgattctcctccctcagcctcctgagtagctgggattataggcacacaccatcatgcctggctaatttttgtatttttagtagtgacggggtttcaccatgttggccaggctggtctcaaactcctgacctcaagtgatccgcccacctcggacttccaaagtgctgggataacaggcgtgagccactgtacccggccttatttttagtattttgagaaaccatcatactgttctccatagtgactatactaatttgtgttcccaccaacagtatatgaggattcccttttctacacattttcaccaggatttgttattttctgtcttttgggtaaaagccattttaactggggtgagatgatattcattgtagttttgatttgcatttctctgattatcagtgatgttgagcaacttttcatatgcctgtttgccaggggtggcacaagcacttccttagacaccgtggctggtgtctcactgggtcacatgctccccacatccgctggctctgagcctagcacagcacagagacttgcccagtaattgcagtccttgtggctgagtgcctttcaaatttatttgcgacccaagtgcactttagcccgtggtttgctggaactcaggttgtgaccgctggcatgggtgattcccctctgactagggatggtctaaatgctctctccatgtgcacctgccgagttctgcctggtgttgctttctgctgtgacagggcaacactgagttccaatgcaaagtcgcacaatcactgcactctccctccaccaaacatacagattctctctccaggccacatggccactgctgggggatgggggaagggtgacatgagcaattcaagactgtctttcctaccttcttcagtgcctctttcagggatatgaagttaaaaccaggtactgtgactgctcacctgatttttggttcttatgaaggtgcattcttttgtgtgtggatagtttttcaatttggtgttcctgccaggaagattaccggtcaaggcttctattcaaccatcttgctccctgacattctaaagttgtgttaggtgtgtctgtgaacataaccaccctctctggtggaaaagatgtagattcttctgcactccaacctcggcaacagagcgagactccgtctaaaaaaaaatgtggttatttgaggttaaggtagctctattttttttcttcaattgcttgctcctcagtatctagcagagccttttgcctgaaagtgaactagaagggagaattactttctagggaaataagttcataaaactgtgatgatcaaatgagtatcagctaagacttgcctaatttaagaaagtttctatctcatatactagaactaaaagacaatttattagttttcattttcaaatcgagtcttgctttatagcaattatatattaatatatagtatgagatatatatatatatatatcttgttagaaaagtttgagaaattcacatgttcaaaaataagaatttaaatgagtggttatatggtactttcaaaagtttattttttattaattttcattttgcctttgttttttgagatagggttttgctctgtcacccaggctggcgtgaggtgacacgatcacagctcactgaagcctcaacctcccgggcccaagcaatcctctcacctcagcctcccaagtagctgggaccacaagtgtgtgccaccatgcccagctgattttttattttttgtaaagactgagtcttgccatgttacccaagccagttttgagctcctgggctcaagtgatcctcctgcatcagcctttcaacatgctgtgattagaagcatgagccacagcaccctgcctttattaacttttataggcctaaaaagaatcattctttatctgttccataaaaacaaaactatttattatgttaaaatattggttgtgttcatgaattaagacatcaaacagtaaaataaaaatgtgtcatagctacttaattttgtaaatagggataatcttagccccataactcagaaatttatgattctatgtaaaacattaattataatagggggcatcagataggtgatttacaattttctagttgccaactcatttcattaaagtattaactagactactatttccaaagtaatactctgtcatatcaaatgaattaaattaggttaaatccaacctctgttaatgtactgtgaaatttccattgggcatcacttatttagaaagtataacacaggccaataaccaatcaaatctatctgtgtcagagtttaccttcccttcttttctatctcttcctctatagaaccaaataaataaaagcacttaccagtcactttgttcccattcttgccaaaaagccttttgtttgtcagtgtcttttgttacattggccatcctgttcagatcactagcttgtttgcaatgggttattctggttaattagatttaccagaaccaagattaggattttaatgtcttttttgcttattttcccctttactgttgaaaaatcatcctacatttatattcccaaatccctaatgtctgctccttctactggtagtaaggaaataacattgagaatttagttcctattagtatctgcctcttaaaacacagtatacacccagccttgaattctacttagagccccagcattcctagtcctggccctatcaaagtaagaactcgtagtagtcttaatttgaatgctctgaagtatcttcagtagtgcacagtaaaagcagtagagaaaatgaaatgtctttgatgtgaaagagtatgtaaagtaagcatataacatatagtatggtccttcatccttcatttcatttccttttagattctaaatctcactggcattaaacagtagagttatagaaagtatttctatagaactgaatatacttgaccatatatgttttaaagcgtattttttaacaccagaaatcttgtctgatttaaatctacaaataaatcaataatttatcatattaaagagggatttgtttttaatccatttattttctcttcctagtatttatttctatcatgaatttataatatttcaaaaagctgcttccacatcgttgttactgttgcattattaacgtagacaccactgattcctctttatgaaattgattaagaaggtatcatgtataaaccagaaacattcataatctatagccaagaaatgtaaccattgcaccattagtttcccacttttttaccaaagttgcttgagaaaggaagtttaaccacattttcatcattaggtagtttgaaactaagaaatgccacacggaaatggggcagcagtcaaaatcttagaatctgcagtgctttgctgacataagagggaaaggagcttcatcagtgttgtattgtcaaccatgtaattcacccatagtatggataggaaatcaagccatttctacaaagaggtccacctcaagtctaccagatggtttgttgctgagtccattttttagtagctcctgaactcattgagagttttctagacaaaaagaatagatttggaaataaccaacttcccggcccatcgtgggggaatctgatggatggatggatagtaccttgggaatgtataagaaagaaatgtctgggtatttctagaaaggttggacatgttaatagctttaatattttggtaggatagttgccaaatattcttattcaacccctgcgtgtctcatctttgctattgcttatgcttgcttataaattgaacaaatgggcttccctagaaactgtcggatgacaaaagatgctacaaagcttaacacctaaaacagagttttctttatagaatgagaatgtaaaaataaaaatttggacggggagcaaaagacttgttttccctgagtctatgtggaaaaatttgttgccttttctcaaataaatttttgttgtagacaggatgcagtaatctagccctattagagactttccagaatatataaccccataattttagaacccactcctattaattatagtaaattatagaaaattaattatagcaattattattagtaaattgctgtgtttatgtaaaggtaacatgttacttccagaaacagtagtccaaagggttaactttaatggtggagatttcaggcactgtgataaccagatattaagaattacatttaccaagggtatttatctgtagtttccatattatgccttgtataactatggcctgttctgtcttcaggctatttctgctctgactgcaaaatgagaataaccagaatgatggttattttagtaagttattttgttgtttgaaatcccaattgaatgacactattcacttacacattataaataaaaatcgtggatcaaatgatagaaaatataagtaacaggatacatgatttttaaatttttatgggtccccagaacccttttaagaatctgttgattttttttttttttttttttttttgagacagagtctccctctgtcgcccaggctggagtgcagtggcacgatctcggctcactgcaagctccgcctcccaggttcacaccattctcctgcctcagccccctgagtagctgggactacaggcgcgtgccaccagcccggctaattttttgtatttttattagagacggggtttcaccatgttagccaagatggtctcgatctcctgacctcatgatctgcccacctcagccttccaaagtgctgggattatgggcgtgagccaccacgcctggccaagaatctattaatattaaatcaagagactttcttcccagaaaaaattaacatacacacagtatttatatagtttcccattgaattcccgaaaccccagtctctcaatcaagtgcccactgacctcaggttaagaacatctgcataaattcgatctgtcttgtctaatagactagtcaatagccacttgtggctattaaatttaaattaattaaaactaaattaaaattcaatttccaagtctcactattcatgttttaaatgctcaatctccgcatgtgcctaatagctaccattgttcgacagagtagatatagagcatttttttcatcacagaaagttatgttgagcagcatcaggttagatgattttaaaatagcctatttgtcttatcattatatttatttacctatatgtgtttatataaaactacatagtttgaaaacccagaatagatattgtaaaaatatcagtctcttttaggcaccaaatacaaatctattgctaaaacatatgtttgactaaaagtaaggcagcaggctaacttagctaggccttcaggactgccataggatcatttgttttttatcttttgtctccaaaagattgcattctccatagtggtagttccaaatcttttcccctttttttaacctttgtcttcaatatgaacagagcttatctcatattctcagaaaactgaggctatcaatataaatcccttcacttttccttatgtctgtatcaaaaatttccttgtgttttctcccttgtctcttaatttaatgttctgcagaaataacaaagtgatgaacagaatgcaaaagccttagaatttcaacagtatagtcaggacctaatagtagatatttgggaagtaggcttattctgttttattgaaagtgatggcaaaaacagcaattacttttgcaccaacctaacctcggcttcactcttatgtgatttaattctttaaatctgtgttggggccctagagtgtttatttttaattaatccataggaattgctaatagatatcagtgcatatgatgcccatctctcttcatcctcaaacataaaaccattctccttattaccaggattagtgataggaactaacctataattgaccatgtgtgtcagacactcatgtgctttacattaatttctttgtttaacacttagaacaactctgtcgggtggaacactctatcaggtggatattttgattaattcattttatgttgtggaaacaggctaagaaaggttaaataacttggtcagggttggttaatgggaagtaatgggaccataattcctccagccttgacttttctctcctgctctccattttttaaaattatggttaaaaaaaatacataacatgaaatctatcctcttcacaaattttttaatgtacactactattaagtatatgtacattattgtacaacagatctctagaactttttcatcttccattactgaaattccatactcattaaacagtaattccccttttccccactttccccagccctggcaaccaccattctactttctgcttcagtaagtttgactacatacctcatataagtagaatcgtgtagttcgttttccttctgtgactggcttatttctcttataatatcttcaaggttcattccttttaaaaaaggctgaatactattcattgtatttaaatactacattttctttgtctatacatctattatttctgcctcttggctattctgagtaatgcttcaatgaatataaaagtacaaatatttctttgagatcttgttttcaattcttttggataaataaccagaagtggggtggctggctcatatgatagttctatttttaattttttgaagaacctccgaattggttttgatagcataaggtgcatcactttacattcccaccaacagtacacaaggttatcaatgtatctacatccttgccaacacatgtgattttctgggttttttttagtaatagccatcttaggaggtacgagatgatatctcattgtggttttgatttccctttccctggtgattagcaccttttcatatacctgttggatgttcgtatgtcttctttgaagaaatgtgtattccagtcctttgcttattttttaatttggtttatttgggttttatgctactgagttgtatgagtttttaatatacagctgacccttgaacaattcagggattagggtcaccagctccctgcctagtcgaaaatcttgtgtataactttttactcccttaaaaggtaaggagcctactgttgaccagaacataacagtcaattcacacgtattttgtatatatattatatacggcatttctaactataaaataagctagaaaaaagaaatatttttaaaaaacataagagaaaatatatttactactcaagaagtggaagtggatcgtcataaaggtctttatcctcattgtcttccacttgagtaggctaaggagaaggatggattggttgtgctgtttcaggtgtggctgaggctgaagatatggacaaagtggaaggggatgcaggagagatgggcacactaggtgtaaacttctattgaaataaattcctgtgtaatttatttcctggatgtgcatagttcaaattcgtgttctttgagggtcaactgcatgctggatataaatccctttttgttgactcagagcagcgtgtgggaggcttagcttcagtgcaaatgggatttcagggcaccacacctgaggtcctcttgtcaattatgctcatggcaacaggagctttgaatggcacgtttccatggccattacacctactgaatcaggatctgcattttaacaaaacctacaagtgatttatgtgcacattgaagaagtatgagaagcgcttccctagaataataatttgacactttgagggtcttccccagaatcaataaaaatgttaataatcagcatagaatctcctaaaaaattcaacttccttggaatggtgtttttttacagttcatttgaacagagttgctgttcaaagtgagaactagagcagataatttgttgttaatgtgtaacacatgtgcaaagtggatttagggccaaagcagaatttccaagatgtttgcctctttgctaaaaggagaaaggatagacgtgatttacttccttttgtattttagggttcaaggtccctgtggcagaggattatatatttctgtatctattgtcttttttttttttgagaccaagtctcactctgtcacccagactggagtgcagtggcacgatctcagctcactgcaacttctgctccccgggttcaagcaattctcctgcctcagcctcccgagtagtggggactacaggtgccagccaccacgcccggctaatttttttgtgtttgtagtggagatggggtttcaccgtgttgcccaggctagtcttgatctcctgacctcaagtaatgcgcccacctcagcctcccaaagtgctgggattacaggcatgagccaccgcgcccagcccctattgtcttttaccatggagtaagatataaatgtgacacttgtagtgacagctggaagtaatctgtcagacaaatcttactgaattatgtctgctctccagtgcttagtaatttagagactctctgttggacagaatagactgtcagataagccttgccgcaaggccatgtcacctaatttatgggcttttccttaggtttaaaatacccacactgttatatgatcaggatattcacaatcctcgtgtgatcatcctctgaaccactgatttccaggcagtggtctagggactacggcttggtaaaaattacattttctaagtctacagtaaggtcttgaagtcagtattttttaaaaagctctccaggtgataaaactcaaatttggaaaccactgctctaagctaaaatgtattcaggattcaggtctatctcatataaacatcctctggtagagtggtattacttactctgaattccaaatgccacttgttccttgcttactggggagtatacttacatgaagagtgaaaaaataatttaaaaatttctaatttaatataacatacttttattactctcagcaatatttattgttatcttagaattcaatgtaatttttacatcattgcttattatttactagtgggcctgttacgccaaggcccatagcactaaacatctggctgtaaatatagttggactacgcacaatctcaggcagagaaagttcccctaaagacagccacaggtgttccctgaaacaggactttcctagaaactgagtaccttcggtccattattcattcttttatgtcttcattcagcagatatttatcaaataccagccattcgatagctatttcagctattccaggccactggattcttttttatttatttttatttatttttttctttcaagatggagtcttgctctgtcacccaggctggagtgcaatggcatgatgttggctcactgcaacctccacctcctgggttcaagcagttctcctgcctcagtctcccgagtagctgggattacaggcctgtgccaccacgccctgctaatttttgtattttcagtagagacggggtttcaccgtgttggccagggtggtctcaaactcctgaccttgcgatctgcctaccttggcctcccaaagtgctgggattacaggcatgagccaccacaccagctacatgaaaatacataagacttagtccttgaccttaaggagttcacagactagcacagtaatagaggtatacacataaataattaattacaacagagatatttgctcttgttgggcatggagagatggggtgggccaagcccacaggagaacctggagaagggcctggaagacagaatagtacaaatgcatcacataagacaccagtctgtgctgcccttatgtatcggacataagaggaatgtctaacttctgaacagctcaagtgagtacatttaaaatataatttattatccttccctgccataaaacaaacaaaacctgcttttctacatgtattccttgactagtgactggcacttcattttgtgctatctccccagccaggaacatgggaggcttcgccttaactccctgtagccagtcagtaatcaagaactgtacatttaacctctatccctctcctctcctctatccactgctattgctgctgcctcagacaagccctcaggcttagacactgcagtagtttcccacctggtctccctagattgagaccttcctctttccagtccattctcatatcagtttagaacataagtggctttacttcctataggaaaagatctaaactcttatgtattagttaagagtgctaaagtgtaagcaagactggttggattcaaaccctggcttcatcacttgatagctgcaggcaggtcatttcacctctcaccccctcagttccttcatctgtaaaacagagatggaagtggaatctccttcatagggttattgtgagggttaattgagttaatactgtacatgtgaagttaacaatgcctggcacaaaataaatacacaatgattatattagtcatagtggggtagcaggttaattcagtgtacatgccaggtaaataaagacaactaggacttactttgccttctaagggctaacagcctgaagtggggcaaagaagatgaagagataaacaaattactccatatgatcaatgctgttataattttgagcaaggtgccaaaaaatcatttgggaatcagagaaaactttaaaatcttcttatctaaaaatgttatattaaaacttattttctggctgggtgccgtggctaacgcctataatcccagcactttgggaggccaaggcaggaggctcacttaaggtcaggaattggagaccagccaggccagcgaaacctggtctctactgaaaatacaaaaattagcagggtgtagtggcaggcacctgtaatcccagctactcggaaggctgacacaggagactcgcttgaacctgggaggcggaggttgcagtgagctgagattgtgcccctgcactctagcctgggcaacagagtgagactctgttacatactaactcaagcccccaaatacaacttaatacctcgcaaaccacaagtttctcttgcatgaaatttgcatattcatgattttgtttctagacctttgcagtaaccacaggcagtttggttctcatatgtgtgaatatttaggtccattctcttaggaacaatttgaaaaaagagaaactgagcattagacatacaaaagggaaaaacaagtgaaccacagaggaataatagactgcaataaaaccttgggaaaaaataaagaaaattatggagatgaactgtactctagtgatttttggacaatgtgggctactgatatttgcataagaattgctatggggtattagggagactggaggacattgtcagagtacatataaatacaaagtagcttataaatgtatatatataacttcacagcaccaaatatacatactaaagaagaaacagttggagaaatgccatttggtacagggagcagaacagcatagtgtttgagtttaggctcaactcagaatgtttaggctactgactaacattgtgactttgggaacttagttaagttttctaaatcttgattctctcatctggaagattggattatggtagtactactgaataagatagttagaattaattaggaaaatgtcctaacacaccttgcaggtaatttgcaaatagcaagtagctgataaatgttagttgtgctgttgattattattaataccataggcttgttttcagcagtcaaaccaataaatttctgtatatctcaattaaatctgtggaaaggatgtaatatagtacttgttatttcctacatggcaggtaataattactaatgttacctttatttagaatatgctgccttttgtagctatatactagtggatgtaaaatactatcatagagtttcataagtatattacttatctctcttcctccattctgtttttcacatttgagtttaaatgcctatgaaagttaacctactactaaaaaatataacctacaactgaagaactgtagaattccagaactccttgatttcattacctaatttaataaatatagtaattgataacaccagttttgttaatagtgcttctaaagggcttatgtattttaaatattctccgtactgtcatgtatatcctatgtgttttcaccttctctgatattaattttgtgaacaaaaataaacagtttgatttagcatactttaatgtgactagagtatgtttgggtgatgtattagagaccctcttctatgggacaccttccttctccagctcagttaagtgactcccccaaccgctgctgctgtaaaccctgtacattctccatttctttatatttttaacttacttgtaccttcaaacagactgtgagcactttaaccttggtagcactgaacatcatgcaacatcgaacatccctgtagatagtcagttgatttttgttaagtgaatgaatgaatgctgccctcttacattgcttatataatttcttttttttctttttgagacagagtcacgctctgtcaccaggctggagtgcagtggcatgatctctgctcactgaaacctccaccacctgggttcaagcaattctcctacctcagcctcccaagtagctaggactacaggtgtgcaccaccacgcccagcttatttttgtatttttttagtagagacacggtttcaccatgctggccaggatggtcttgatctcttgaccttgtgatctgcccgcctctgcctcccaaagtgctgggattacaggcttgagccaccacacttacataattcttaagccatggtcaccagtgtaccagtgactgattcaattaattcataaattaagaatgcctttaaaaagaagataaagtaagaaaaaaaaaataggaaattttttttttttttttttggaatgatgtctagccctgtcacccaggctagagtgcagtggcgccatctcagcttactgcaaccttcacttcccaggttcaagcaagtctcctgcctcagcctcccgagtagttgggatgacaggcacacactaccacacttggctaattttttgtatttttagtagagacggggttttaccatgttggccaggctggtctcaaactcctaacctcatgatccgcccacctcggcctcccaaagctctgggattacagatgtgagccaccgcacttacataattctcaagccatggtcaccagtgtaccagtgactgattcaattaattcataaattaagaaaacctttaaaaagaagataaagtaagggaaaaaaataggaaactttaacgggagaactaatattaacctaattctgaaaacttgtctgtggcttagtttttgtgtctttctttctgaagaaggttctcttctttctgaaggttgcctgactttctgcaaatgccagaggccttaccctagtttctttaccccagtttcctgattactaactactaaatagcctgtataaggtgacaggtgtagacgtccactctggcagactaaagggggctactgtcacgactggctgtggttttaggctctgaaatgagagacatagactttacacatacttcagctcttaaagatgctgtagaagatgttaggaagaggaataatatagccaggaaaaatgtttaccacatcacatatgtctagtgatcgagcagtcatctatttgttcacagaagcctgaattgtaatgcatacttgtgtaataggcaaatgataaacataagtcaacatagaaaattgccatgagggccacccagcacatactgtgtctacccagcgtgagagctttgttcttgtttgtgacaaataatcagaaacaggaaagagtttgcagatgcgacaggaagcaacttaacagacaggcctggcatcatctgtcgccttaatgtataccatttattcccttggtgtgatgattcttagccataggtcacaattgagccttagaaccttaacccagagtgttgcagccttcccccttgcaagtaccccgggaattgctgccattggccagtgtccaagaagaaggcttgaacagctgccctgacaaatgggtttcccccattcaagcaagcaaatgaggggtttgagctgctttgcaatactccctgcctctgggctacaaacactgtttaaaatgataataaagtatcctactctccagcactatgtatttttctttttggagacatgtaaatatctttaggatctttttaatgcaggaggtgggaaatcatccatatgaagagttggtttcagcttttctttctttctttttttttttttttttttggtctattccagacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtaagttctgtttttgtccttaaaagaattaaatttgaccatgtgtggtggctcatgtctgtaatcctagtactttgggaggccaaagtgggaggatcacccgaggccagtagtagttcaagatgccagctctaaaaacaaaatttaaaaattatctaggatcaatggcatgcacctgtagttccagctacttgggaggttgaggcaggagggctgcttgcacccatgagttcgaggctgcagtgagttatggttataccattgcactccagcctgggtgacagaatgagaccctgtctcttaagaaagagaattaaatgtattgtttgttaaaggagtgacataatctatatataaaataattcccatacaaatatgaaaattcatattcattttcaggtttctccttagacttaaaaaaaaaaactttacaactcttttgtacttctgagactttttttttttttttgagatggagttttgctattgtcacccaggctggagtgcagtggcacgatctcagcttgttgcaacttctgcctcccatgttcaagcgattctcctgcctcagcctcctgagtagctgggattacaggcacctgccaccacgcccagctaatttttgtattcttagtagagatggggtttcaccatgttggccaggcctgtctcgaactcctgagctcaggtgatctgcccacctcagcctcccacagtgctgggattacaggcatgagccactgcacccagccaacttctcagactttaaaaaaatctttacattatttttcttgagtctgtaagtttgagaatgtcacatactaatttattttctataagttctctaaagagatgaactttccaaagagtagataatactcactttgcagcattccatgacattgtagatcttattgatgtctcccagattatgtctcatgttttaggccatagacattctctgagtgggtccttccagtaattccagaatagacttggcaacaggacactcaaaaggcagtgtttgggaatgggatccttggagactttcaagccaaaaggatattgcccaaacaaatctcagtttaaatgttgtgatgaggttgattccttttttcccaatttataatttctggaagtagttgtccaagagaaataccttccctgtatagttactgaaagcataaaatttggtgtatctggtaaggtcccattttgaggtattctgtcctgatttccccataaaacattgtagtagcccagacattgaatacccctgcatctaaactctgtttctcccaggccatataaaacattcctagcaaacagcttctttcttatgataggtcttgcaaaagagcaagctgtattattaagagctgactatgaaagtaggaaagcctggggttgagtgcaggctttcacacttcctaatcttgtgatttcctgccaagctacctaactactctaagcattgattttctcatctataaaatgggggtaacaccagccctcatggttattgaatattacataaaacaaagtatggaatgtgagggcgatctggctgtgacatctgtcaccccattaatcgccagggttgattcggctgatctggctggctaagtggctgtccccttcctccctcaccactccatgttcatgcctcccaaagctgtgttctcagtcaaagaggacaaccatctccactagaagaggaccagtctttggtcaagggtatacgagtagctgcgcttccctgctggaacctccagacaagctctcaagtccatttgtaggagaacatagggtagtcaagcttccaagattccagacacatccaaatgaagtgctgcatgtggcagtctgcctttcttaaaaaaaaaaaaaaaaaaaaaaaaaaaagaagagtatgtgtagcatctgctagtgcctgagacatgtgtacctgataaatggtagataaaatgcaaaattttatttgtatttttatcaccgaaggtatatttgaaatcttagttttctgcagctatcgtttgagttttccatttgtatttatgctaatctaaaaacctaattatcatttgtaaaatatagcttttgagaaaatttcattcaagtttctaaataatctaaatttttggaaagatagtttaagttggaatagccagcatacccacaggggtaatgataactattctctagccttcatctctgtccttattgcctagcaccaatactgaatatttaccatgtgccttctgtgtatgttgccttatatcgactcagcactactatttttcaagagattttggtgctgccttatcaggtctcagagataggaggacagttaattgaatgatatatattgccaactgctaaaataaactaattccctacatgctctcataggacatactctctgctcctcattatcatttgttattctttattctcattaaaatatatgtgtgtgtatgtctttattctcagagtattctgggagctttcttatatgcaacccagttatatgtggtgagatctgttgattttgtttcagacacttcttaggctagagatcttctaattcatactcaaccattgaaagaaatactacataggttattctttcctaaggcttctattagtcagcttttctttaatatgaaacctttatttttctttttgagtcctggctggagtgcagtggcacgaccttggctcagtacaacctccacctccctggctcaagcaatccttccacctcagcctccccaagtagctgggactacaggcatgcaccactacgcctggctaattttttttttttcttatactttaagttttagggtacatgtgcacattgtgcaggttagttacacacgtatacatgtgccatgctggtgcgctgcacctaattttttatgtttttaaatttttatggtttcaccatgttgcccaggctggtctagaactcctgggctcaagcaatccacccacctcggcctcctgaagtgttgggattacaggtgtgagccaccgtgcctagccatgaaactgttcttttattcccttttatcatataaacacaaattttccttcaggaattgcagaagaacagtattaactaccagtgataattgaatagtttaagatttttctttctcctctgcccgtaaagtatgtgaggaatgtctgaatcagagtttgtattctcctttgtgcttatgtgtcatagttaagtagctatatttgtactaatcaatctctctatttgtatcattgttattaatctcattatcctaatatgcatacgtgggcagaaaaattgaattatttactaggtctcgggacttaggagtcagtaattaaatgctgggattattcatgctctaaatgcagatatacaataaaatggatgctttaattaaaaagaaaaggatgcatatctgatataagtgctttctaaagtgtatctttaacatgtatttgaaatatggaaacctagattttccttgtcaactgtccttctaattaagtaaaattttcactctcagcaagtataaatgtgattaattctgattgatcaggcatgtatctgagtaaactctgttgcttttaaatacctttgactgtatccagtcttctttagataataacctcctactacttaaggaaactaaaaattcctctcccaaacaatccaggtattgattgttatgatcaaagttaagttggaatcttttcaacatcatgtaacttgtttctaattttagaagacaaggtataaggtgtagggttgggaggagggaacatgagagatttatttggcatgaacacattcactcagaactcaagaggaattgttgcttctgagtacaatagataatgaagatgataataaataagagatggacttaccttgtggtttacaagaagtaagctataagttttcatactaaatatataattttttatgaaacaaaataacactaaaacttcctggggcaggagaaataaaaacaaaaataaaaatctttccattgagtccatttaacatagttatttatactgagctatttgctagctttattcagtagataaaattgctctggaaaataaatgttaacttcttatttcttacccttttctatattaaattccacacattcactgctacttaattaacaaccatatttcaaacctttatgactatgtcaataaccataccaattacagtgagggtgggcaggcaagatattgcaacaaggattttttgtgagacaattctgtgagacatgatttgaagttcctttggaagaaaaaaagtatttgctgatgacctagtaattacttttatagatttttaatgaagtatgaaatactttgataactcatccaaatagagttcctaccacatgttatttcttagtggcctttatatattgagtagctgcaattgtagctttcagtaaactagagaagtaggaaaaatacagaagagaagtactaaatgagctcttaaatttgaacagtgttctagtgagtgggaaaaaatgccacaagaagcatgtactgaagatctgctatctttattctatcactcagttgattacaatttatctgaatgcccataccatccgaaaggaaatgtatatattgacacctcttaattataagcttaaaaaccactattatgtgtttaataactaggatgtttctttactcaaatttagacataggtcaaatgtatgttgttgttgttgtctatagtataccacagtaagatatgatgcctaattttatatgtttaagttgtatgatggtttatggttatattttgctttgtaacagatgatttttttttctttgatgttgttgtcacccaagttttggttaggaagagaacactcaaatgacaactttgttcctcttggaccaacctattacctgctttatcccatgggaaacacttcctatttgaggagggcaaccgaggttctgccaggcagaatctccccatgattctaagttaattgatgtcagtaatttcttcccatgtgcatatcaccttgaagtaaactctgatggaaagtaagcatgtcatgtgattcttctcttcagacatcaaagagacagtactcaaacatagaagtttttggaaactgagacccactgactattggaatcaggctcctgttacctctgtagtggaacttctctgcaccctttccttgcctagttaagcagttccaaaacagccccaaacagttggtgtcaattttcagcccttaggtagcaacttaggagcagttcagactgagggctactgttaagtagtatgcctttcggaaggggaaaacattctcttcctcttcagacttcatttctgtacttctggttctgccttgtcaaaaagcattctatgtgacctcattggtctctgaggggaaaaaaatgcttcaactctctattacaactttaattataggggctctttcctgtccctgccttcccttttctgcatttcttgtaccgattcgtccccacatgacactagaggaactgtgttgtagaagattgagtttggccttggagccagagagacaaagttcacatctcaattctaacattttaattgaccttgggcaagtaaggactcattaaatggtagctgctaataattgtcattattgtcactatcatcattcttctcttctaccactttagccacctatatgtgccctctgacgctattaatataactattttgtctttttcatcaaatgtttgctgaaatgttgttgttgtttttgttgtgtgtctcattatttccctgggataaatataaattattcactaccttagtcttatttaaatatgttactttttcttatagtaataactgtcatatatattaaacacccagaattttggacagcgtgctttacatgcattattctatttaattatcaacaatttattttgcacatgaataaactgagtttcagaaagattaaataactttaagttcaggttcatacctttgaattcaaagtccttgcttctctattcaccattgcctccggggtggtaattaatacattaactatgatactttgaccactgtcttaatttaaaaagcaaaactgcttctagcataagatctgtgcagataagcaagggacaatattgattgtccatttaaaaaaaagtcattggccaggcacagtggctctcacctgtaatcccagcactttgggagtccaagacgggcagattgcttgagctcacaagttcaagactagcctgggcaacatggcaaaaccccatctctacaaaaaaaataggaaaattagttgggcatggtggtgcgtgcctatagtcccagctactcgggaggctgaggtggggaggatgtcttcagcccaggaggcagaggttgcagagagctgagatcactccactgcactccagcctgggcaatagagccagatcttatctcaaaaaaaaaaaaaaaaagtcattaataattcaaagagcagtctgttcacgaggatccaagctcttgcctggtcatctgttccacatggtttcacacagatacttttctaagactgtgaacattttccaaagtaaagtagtctgtgtattcaaggagttatcactgcctttcaacaggctctagacccaaaatggaactaattatatagggctgaccactagtctccgttttgtctagaggataccatccagatagtcctcaatggagtggcaaccaggactgacgatccactccttggtgtattctagcagtagcagtagggaacctccagagggaacttggccttcctgtcttttgaagtcagttatcttagcacctggttctgccatgtataaatttgattaatcatgaaaatagatgtctatatttcaatttagaggaataatccatcttctgttctaacatctctaatacaggttctactgtgttccttcatccctgtcaccactttgtaatagaaaatgtgcttgggggagaataagaaaaggactaggaatgtcatttttattctcttaagcctcctcttgtcttctctttccccttttttcctctctaccatggggtggtggggaaagcaactagtgaggaatggaaagatagagactaggagtagccatgtaggagactgaggagtacaacgtgttgaagctggcccaggatggctaaggaaataatgtcccagccttttgtaggtactttttctctatttatctgctgtgatggatccaatatgcacttgccttcttctgagatttctaatatggaagccagtgagttagccaaggagtagggtgcatcatttatatatttgtggtttaaggctcaatgggagcttaagattgccattttaagatctcctagaatacaagttagcactgttttataaggaaagggttctccccttacttacccatcaaagttaacagtgtggttgtacaggagaagaaaaacttaaacatgggattctatttttatacactattcattggcttctttttcttacatattctatattcattcagtgtatttttatttgatgtcagctcgtgtcatgtttatctctttctcccagacctctctccagcacagacttctaatacacaaatgccctttccatagagcaccatggtattggaaaattaatgttaagaaaaaaattaataataaaaaggagacaaaatattgggaattggggactacttagagaactttacaggaatcttcaaattctctacttctttaaaacatttactgtggacctaatatatccaaaacattcctagatgtgctaagtcaagccatttaaaatgtccaaatttctactctttctatattcttcatctatttcaataagtcccatttctttttttggttctttggtgtaagttacttgttttgtccctcagttgtgtggcctgataaattgggagctatagaatcaagctttccttttcctctctctatgaagataacactctcttcttggtaccattcaataaatgagattgcagttgccaatataaatcttgttagataaatggaaagataaaccacttgttaaatcctgtcatcttactccctctttcatcacatatgtaggtctgggtgttaggctttggtttttaatttagctggtgtgttgcttctaactctgctcattagatacaagaattgtaagttaggctatttttccaaagtctaaatttgcctcatttcagactcagtgtagacatatggaatttttctgtcttgttatattgatattgaatttagactgatttctcattgcattattcttctgacctctgttcttttgatacataagataaccacttagttttctctttactgcagagtgtgtcatagcctatttaatcgttattgtattttaaagacacataaacttaggtgttatttcagaaaaattcattatcacataaaaataattcattttaactttcctatatgtctgtttattgaatttggggatagtagagtttagtcattttcatgcccttacatggtaattcctttttattaaatctttatttgatacttctataatgctccactgcctttgtattcacaaaaaactgctagaaaagcagttttaagttaacatttgatttgttgctttgggatgagtgaatgtgcttatagattcctgtcattctaaagcaaatagtatattgaatcttctcatcgttccttattttatgttgttctaaggtacattttatattggaggaaaaggttcactgaacagcccatcacagatttttgtagtgtaataagaattaattccactgctccatttggtaagtgtacatcttggctaccatcttttccctacagtataaaaattcaaaggaataatcttactgtcttatattagaattacttttactttcatgatagataaaattaaattgatgtgtttattttgcctaacttgaataaagctaaaacagttctatgccaaagagatcctaatagacacacacatctgtattttttaagaaataagtccttctggggaaaaaatggttaatatctgttttcttatttgttttcctaatctctcaacagaagaacaagagaattattttttgttatgtgacgttttaccagaagatagaattcttagagaagagcttcagaaacagagactggtaagaattgtttttaaagggtgaatagtgtcttgaaaatacatataaatacatataaaatcatattggttttttttttttttactttttgttatggaaactttcaaacatatgtaaaagaggagacaatacaaaaaggtcttaaaacaaaaaaaaagtatacacttgactgaaaattaaagcgttttatgttaaaaatgcagagagaatttttggctttgttttgcttcctggattatctctaaaataacaacagaacttacacattttagtgtaattttagctgcctgacacatgctagggttcagtagtcatggaaaaatgccctcagctaaaattgagttgaattgattaacctttttttctcccctttactggaatgtgctatgcactagcattttttttatttccctttatgaattaagcatatggtttaatctacatagtagcctttctggttttcaggcttaaccataagcaagctaatttgaaaacctcagcatctttagcctttaaaaaagataacagcacatacaagcatgaaaatttttattttattttattttcttatttttattttatttatttatttatttatttatttttttttttttttttttttttttttttttttgagatggagtctcgctctgttgcccaggctggagtgcagtggtgtgatctcagctcactgcaagctccacctcctgggctcacaccattctcctgcctcagcctcccgagtagctgggactacaggcacctgccaccacacctggctaattttttgtatttttagtagagatggggtttcaccgtattagcaaggatggtctcgatctcctgacctcatgatctgcccacctcagtctcccaaagtgctgagattacaggcgggagccactgcacccggctgaaaatttttattttcgtaagttaatcagaaagtaattttttaaattgttacttttgtttaaaagtacatgggttcccattatttgtgatttaatctcgactattacttgaagttgacttgctgttcctttagtgatttcttgtaagtctttcttttatctttggacttagctaaatatgttataagagagagaaatgatttaaatatttgtgctatatcctcaagagatcaaggagaaaaataaatgctatttaccatagtcatataatttaagaaagtccctggaagcatattttattttgtagacatcccaaatgattatttcttccagtaggggaaggtgataccattggatgttgatttatatctaagaaaagttttcctgtacaacaactgcagtaaagaaataggacttcctgagtttctcttctctccttatagcagtgtcttatgaaatctgcaaaacaaggctaaatttactatcatgtcttatggatgttatttgcgtgcacttattcataatttccaatttacatgaattttctcactgttgctaacagtggccttaagaatgatcaaaagatgtcatgatcctagtagtcctaaggatttatttataagaactcaaaccctactacttcagccattcttgttctttagcatgcagaatctgtacgatgtgtctgcagatggactcaggtctctaaaaatacctacatatactgcatttaagttaccttttttactttacagtttgatagtgatacatttaatggaagtgagcattatgccagcttacagaaacaaaagaagaatgaaaaggcaatcaatccatacatgctcgttgaatttctgcttaagtagatgcctatacaaagaagtacaagagtacaaggcataatccatatcatacaagagtgtacggtctacttagagaagaaagataaatatgtattcttatcttggtaatagagataatgataaaatatcttgcagggcttatgaagattaagtgacatgtaatatacttagaacactacctggcacatagaaggcacttaataaatattagccaataaaaataacagtaataatgctgtgtcttaacaatgagaaggatttggatagttaagagagttgtagggaagggaagaaagatacatatgcatctaaatgttcaaggtgtattcaggaaaatcgagtaaaagtctactccggcttagatagaaaaatttttatggggaggagtatgagataaatttgaagaggtaaaatggagctaaattgtggaaatccttcagtgccagaaacttgactttgtagtaataaagacccattaatgtgccctcattgtccatcagtgacatgaagaaaagagtaaatgtagctgcgtataaatccatttcaagctgtcaaagcctgagaaagactagaccaacttggggattggaagtaagctaacaatgactgatgaccatccataagccatgccttgtatttggttcttgcttcatagcaccctgtgaggtggctattaaatgccgttctatttatgagtaaaatgtggcctaggaagcttaatttgcccaggaacacatagtgaatgaggtgcagagctagagtttcaaaccaaacattccaggtacatgccttttaagccatgccatgccagcgtagtcattatttggcctctcatgtgtctggtactactattctaggctctgggaatctctctgtcctgggtgctcatggtctgacaagtctgtgtagggaggggattcaggcttggattgaagtttagggaaagcagaggcagtttacaatagcccgccactggaattctgattagaggatcaacaaaaagtaaaaaaagacttgccaaacagcaggaagacaggctgaatttgccatcagccagttcatcacaattttatgctacatagtgtggaagcatgaggttagtgtgggtgattcttctgtgggcgttagcaatgattataggatctatctcctttataaagaaagaactttacaaatcagtaagaagcatgtccagaaagaagtctaaatcattaaatgaaacaaaagtaacagtatactttttcttcttctatcaagttaacaggacttgaaaataatagtactaaatggtggcaagaatgttaagagacaagtacttcttcagctgcttttaagaatgtaaactggtataccatttctgagaggcactttctcatcatgcattggaactcgtgaagatgtttatgcccttggcccatagtgtgcaagaactcatcctaggaagactttacagccagagggttttgaagtcactcactctaccacagcttggtggttttttccttatgctgctactaattatactttatcaaacaattttttattaatcagaatttcattctagtttctaaaacatgtaatttaaaccaatcaaactgcttaatgataatggatgtataatgtattcagtgtttgagtgaccccagctcaatatttcaactcaaagactttgaattgaggatcttgaggatctcaacttgaggatctcaactcaagtccacgaggaagaaccctcaaactagagtattagtagggcatttgctgacttgatttgcattaacgatgatttgcatatgtattattcttaaatatttattctttcatgtggaactctaggtaaagcatatagtttaagtacctttgtatggtttgctcttagttcaaaatgactgtaacttaagggcagaaactgtgtcttatatttaaacatccttcctagtcctccctatactcctaagttcatattgttatttttccccaaacctcattttaaacaaacagacaaaactctgttttctgtgtgagtggctggaggtatatagagtttaaatgattcactgaaagttacagtaacagattttatgctagaatcatatttctttttccatttctttgagatttcactggtttcttgacatttgcaagatttgtatgtgttcccagttttctttttgaagagcttgattcctacttgacacttctttgaatattttcatccatattctgaaagaaactacagaattaggaagattctcgaggatttcaatagcttgaacaccttcttccctttagcttcctttaaaaattctcccgtgatcttggtgcatcatcctcttatttctcatcagtctagcttagtcttgtccagtggttcttttccctcttttctcttaaatgtgtatacatatgtttctcaagatcttatcacctgttcagggcatgcacatctgtataactaccactattaggcctatggcttaaatgttagtgctggtgcagagtaggcagtcagagtaaatattcatgaattgagttcatccatagctttcatcctggttcacttctgagccccaaatctatatttccttatgtgaaacttttccatttggatttccagtccacactttaatatgcctaaaaacagaacttatttttttcctcccccaaaacttgctatttgcctgttctccttttattacataatgacaccaccattctcctggtcactcagtttggaaatctctagaagcatatttaattgattctttttttctcacccctatatctaagtcatttgtcaaatcctaccaggtccagctgagtcccaagtcccacatccatactcatacttaccttgtctatagactcacctcttcaggcaattgacactgcctccagaattttaatattaataaatacttattaaaattaatgttactattaattgattaatagtaactgattatctgttaatattaataaataacataaatcactttattctttttttttctgacaagatctccctctgtcgcccaggctggagtacagtggctcactgcaacctctgcttcccggggtcaagtgatcctttcgtagcgatggggtctcactatattgcccaggctggtctcgaactcctgggctcaagagatcctcctacctcagcctcctaaggtgctggaattacaagagcaagccattgcgcctggccctattctcttcttcaaaaacctgccctattctttattgtcttcatgttcttaaggttttctagtctcaaactgcatttccagtgtcttttccctaaattgcccagcatccaattaatttgtttattcaacaaatatttatcttgtaccagatattttctaaatactactgatatagcagtggataaaacaggcaatggtccctgcccttgtgaagtttacactgtagtataaacattacttttctcacatttatcaagtatgttaggtactttcaggattctgcttcatgaactaggaatggcaatccccacctgtatagatacatatccctcaaggcattgctcaactgccacattttccaaaagtttcccatatgccacctgtcaaaattaatgacctcttctaagttctattaacacactattttatttggcttttcaattatagttagttattttaaaatctgtcttccttactaagatgtctcttagcagtttagactgttgtattaacatttctatcttctctgaggcttgctcttacgtatgaactgaaatttcatcctgaagtattggcttgtaatttctataaagccatatagtcaaatatccctgattaacaaggatacaatatagctgaggcagacatctataatcactgcattacactttgcacttcaacataaaaaaatcctcagtttttcctttgtctacaggagaaaatgtgtggtattcgttaagttctcagtagcaagacgtaacttaactaaattgggaaagaaggaaaggcctaactgtatgaaggtattttttttaatcactatttcaaatgtcagcttgagatatcattcatgacaactacaaatattttatgaaagttttaacgtatataacaaatttatcttcaggagagaaacagttttttctgtttttaattctacttcatgtgtctcacctctccccacaataaagccacaacaaaatgaaattgcgtatctcccactgagaagattgttcttcctcatgccactttttaaaatatagttctagagactttcagtaaaggatcaaattactgtatgccaacaaactgaaagtaaaaaaatcaatttatatttatacttttcttgcataattcctatctttcaggcacaatacatacaagttctaatactgcatctagaataaaattttcttaaatataagatgatatttcccattgaatgtaacattgttattaacagtgcaacagagatcaatttagctgcagtgaccattgagtaagtttaaccttcagattgatgactgctttctttgggaaacaaatggtaatcacaatctaaaacgatattattctgagtcctaaggttcaccactttgagcatcttcaacaaggacttaaaatttacaggacaatttgtatatatactggttgagtgagatcaggcaggaaatattacccctgtttaacaggaaatgcaaggtcaaggacagtaagaaacatgcacacaaccgtggttatatacagtgttaaatagaaagggaagcaattcaaactcctaaatttccaaccccaatcaccattctctttctaattgcaccaggatactttatcacatttgatctttctttctgagcaaataggcctttttttttttttttttgagacagagtgtcagtctgtcacccaggctggagtgctgtggcacaatcttggctcactgcaaccccacctcccagattcaagcaattctcatgcctcagcctcccgaggagtagctgggatcacaggtgtatgccaccacacccagctaatttttatatttttagtagagacagggtttaaccatgttggccaggctgatctcaaactcctgacctcaagtgatccacctgccttggcctcccaaagtgctgggattacaggtgtgagccactgtgtccagccaaatgtgacattttctaaattgacatttgttagaattaatgaaaatggctgaacaggacataaatatgtatgtaaataaataataatattctgttttcattgtaaataattttttaaagaaaatctgatttcctattatcttagttcagtagtagataggaatttcttattcctttgggcctaagcttcttgtattttcttttaaaactgtacctgaccttgagtttatacaggaaaatacttcttcaggctggtaatcctataccgagtcatgccatgctgatagctttctttttcctttttcttctaaaagatgggtattttgcaatctcccatgcccacctattgaattttttaaagtccttctcttcctacctaagctaaattctcttgtacctttaatataaataggaatttagcttttctagtttcttgtgtgtttaactcctgcatttacattttattttgtacgtctaccttttttcattgtgctgatattttccatgtgaatgtttaaattcgtctcatttttttatctcctagtttattttttttggatattctgtcctgttttgaagacactcttaaaaagctatctcagtgagactcaaaagtagaagaaaaatactatatttctatcctgtatagcaagcagatggctgttgcctttatcattgcagtttcagaaacggtgggaggtactgatatctttcaagaaggtgaaatactagtcagatcaactctcatggatttgggggtgtatatcatcatccagttaagaaatgtatctctgttttttatgtttcactatcttattttagtcattgatatggatggcttttccttgtttatttaagattctaatgtcacaaggttaactttctatcatctctcataaaatgctgagaaaggtggattttattgattgtttttaaagaaactgtattttgccattaatagtttttgttttagtacagttatccctgccttatacatgcagagctgtgtgtttaagtatattaagtattatttagtatattatttgagtatattgctaacataaattcaaatgctctagtgatcagactctggcaaacagatcagtcattcccaatgctgttcagtgacccttttgacacttaaaagagaattttgggggtggggaaaagtagctttttatttgacccctggtgtgagggcttccaaaatatttaactcagttataggcagattccattctgaaagttgttgaagctatacatcattatctgtacaaataatttattcatgtttccattttactttattaaccaaacttttaatccttaagttagtggaaatttactgaactttttatacttttaatttcctcatattgaaagttacatcagatagaataaaggatgtgatagaaaaaaataatttcaccataatactgaatgggattaaaatgaaaataccgtcttactgtcagaaaagataagaaatggcagacagaacaagaggagttggtgttatgtctttagccagcctcactttgaaacaatttgaaaactctttcagtaacttagacattgttcacttattcacatcatgtaactagtaattaaaattatccaatactttcaaatttatttagaataaaaattcagactttttaccaagatctcaaaggatctggcacatgcctctctgagccactctcccacgtctctctcacccactttctcctgtgcttactgtactccagctacactggctatgtctgtgttcctcaaacacaccaagctgtttccagctttaaggacttcgcacttgctgtttgctgtgcttggaatgctcttctctagaatctcatgagctgggcccagtggctcatgcctgtaatcccagcactttgggaggctgaggcgagagaatcgcttgaactcaggagaccaggctcggtaacaaagcaagactccattccttaaaaataataataataataataagctcatggctttttttgaaggggaagggaagagtttttggggaagatgagcctctggaatggtactacaggcaaatgaatgctttggaagtgctttgggaagctaaagacatgtagagtaattcatatagctgaaatgatttaggaaaaattgccttctgtggaggattaactttagctatcagctacagtgttttggaaagtagatactcaaaagttatactgattgtttaatttgttggaaattcctttctcgggggtaggaaagatttaaacctattctgcatttgaggttatgaccaaatagaagtcatagactacagtgcccaatgtaatactaaacttttaatgagcctttaggaagtttttactgaataaatttgttttaactgattgaagtatccaagtcaactgttttcaccaaaaaacaaaccaaaagaccttctttcctttatattttaaatgtatttactctgatggaatatagggactagatagcaaagaagcatctctggtccctctttttaattaccgatgactgatataccactctccatgccttgatgtcagttcctcaaaggaatgctggtccagtgtctccagtgcttatactaacagactctgagtgctcacactgttcaagagaagaggctcatcagcattccgtatgtattagggagctctgccatttaacctgcagtctgggttctggtattataaataagtcacttcaaaagaaagctagtactttgtgatacctttgtatcaacaggacagacctttttctgcatctgattaatgagaattttaatttttgttactttcaagtttccattttcttgaccacgtactatttattttctatcctgaactttaattaatggctgaaaactttaatcctaaattctaaactgttttagaactgcttgctctttaaggttttctctcctctgagatttctgaatgttcttttttttttttttttttttgagatggagtctcgctctgtcacctaggctggaatgcaatggcgcaatttcagctccctgcagcctccgccttccgaattcaagtgattctcctgcctcagcctcctgagtagctggggttacaggcatgtaccaccatgcccagctgctttttatatttttagtatagatggggtttcaccatgttggccaggctggtcttgaactcctgacctcaggtgattggcccgcctcggcctcccaaagtgttgggattataggcgtgagccaccgcccccagctgatgttcatgtttttatcccttttctagagaggctcttttataatcccagcatgtcagcaaaaagggaatgcattttagatctttactggtccctaaacatatttggggagcacagtgaccaaggggtggtactgtaggtctcctcatctaccttcttttccagccacctttctatcaggttgtttccagacctgacctatcctgtcttttaaaagaaaaggcctccattttcataaattttaagtattttaaatatttaattttttaatatttaaatcttttaacaccaaatacatgcctataactttattttgaatgttctaaggcaagtgcattgcagaacttgcttggcaaactgcaggttaggttctctcaggcctgtccttacatccagctcttacaccccagaacactaatacacactcagataccgttgagaagaaaaactcaggaataattatattatttctcaacattttttactccatccccagcagtagccaacatctactttgcagtgcaggatttgggtccttctcccagcagcttatggcctttgctttgtgtgctaaagaatggtccccagaagcaagctggggttcgtgcctgttcaccatcaaagggcttttgttcatgtctctttgccctattcctagtctttctcctgagaacttggaggaagcccatggggggagttggaccccttgtgtctaggactctcagggattttgcctttaagaattatttaaaatacaaacttttgtcttcctgcttgccttttcctcccatgctctgtgttcgtgtctctcttcagagaggctaaccaccttttagaattcagtttgtctagttgccttgtgacttcagctctttggactcaaaataagttatgaatttatttcttttttttgtttgtttttgagacagtctcactctgtcgccaggctggagtgcagtggtgtgatctcggctcactgcagcctccgcctcctggtttcaagggattctccctccttagcctactgactgcctgggattataggcgtgcaccagcatgcctggctaatttttttgtattttaaatagacggggtttcaccatgttggccaggctggtctccaactcctgacctcaagtgatccacccgcctcaacctcccagttgaatttttttgattattcagctttttctcattgataggatgttctcttgtatctatctcctaagcagaaattgaactcctcctccccctgcttgattttaattagtatcttagtggttaagtgctacttttggctaaggtagatgcttttttttccattttatagagttctaaaagataaatacatacatacatatgtatttagtatgtatacatatgtccaaatacatatatatgtatttgtctactaaatgaggtctagcttcaagagactattgaccctgtcaactagttgtcataaattctaaaacctgttactatggcttggtgtttgatcttggtgttgacttacctatcaattattgtatcaataaattgctatatttggttatcttcatatccattttgccagaagtttgtctttggagtatatgcgagcaaattatgtcactcactgccagatgttctttggatagttttctgatacccacccaataagggcttggcgtctgctaacactttacttaaaatttaatctgttaaaaattgtgaccatggctgggtgcggtggctcactcctgtaatcccagcactttgggaggcgaggcgggcagatcacttgaggccaggagttcaagaccagcctgaccaacatagcgaaaccccttctctactaaaaaaaataaaaaattagccaggcgtcatggcacatgcctgtaatcgcagatacttgggaggctgaagcacaagaaccacttgagcccaggaggtggaggttgcagtgagtcgagatcataccactgcactctagcctggacaacagagcaagattatgtcttaaaaaaaaattgaaaaaattatgatcatgatatatatgaggtacaactttggaagccaatagttggtgttaggagggcggatgaggattagtggactctggtctagtgtgtggctattctcttcagtcatttttgagtaacaattaaatgacttttcatgcaagttctagtctgtgcttaggatgtagaagaggaaagatgttttccctcactcacctctagtttcatggctgagacctgtaaaacaaaagacagattaacaaaggaaaagcatacaaatgtatttagtatgttttacttgactcaagagccttcataaggaaatgaagacccaaagaaatggacacctgtgcatttttctgctaaatttgatgaagaaatggatagttgtggggaagtatgattagacaagggggatatgatctggtaaaaaactggagaggacttagcaatatctatttgttcagattcttctgtttatctttgtgtcttcagagataaggatgttcctttcccccaggtataagagagggtaccttttgaatgaaggctttacgatctactttagggggaaaggggaaggaggaggtaaaagtgagcttcctgcttctgctcttccaaggtgccatattttggggtggcatgttctgaaccccatcgctgactatgcagtttttacaagagtcaacccaaatgtctcctcctgatgatctcctgaagcctgtgcctctgtatccatgtgagagtctataaaagcaacattccagatactgactggaagaaagacagattcaagattataaccaacgaatacttacaaaaactgtgttcagggaagattgtttgaggaagactggagactgattgtttaagactatatagaaaaatttcataatttccctatatagtcttaaacaatcagtcaggagacaagaagtatctgtactgcatcatgacaatccataccccacccctctgtaccgttttcactgagtttgagggtgtgctttgggatgagggttagctttttttaaggcttgatattggaaacagccctatgttgttttttctattaatcctaagtatattgtccatgatgcatatacttattatatacccacaatgactctgacaccagttacctagacaggccaaacttcacaggttaagggcacagccctccacagactatcctcacttcaaacaccagccacaaattgggggttcctcaggatactttggcttctcaccatctggctacaaattcaagagttcccactactctctcaggttcagtagtttgctataatgactcacagaactcagaaaagcactatacttgtgattacagtgcagtcatagcaataggatacaaatcagaacaagtcaaacagagagacgcataggatgagatctgggagattcccaaatacaaagctgccatcgttcctaaggatgcattgttctcctggcacatcagtatgtaaccatacccagactaatccctaccaagaaagtttactggagctttggtgtccagagtttttattgtggcttcattgagtaggtataattgattaagtcattggtcacatggttgagcttgatctccagctcccctcccttcccaggagatgaggctcatcttatgtggctcagagccccaacccactaatcacattgttggtcttttctggcatggccagttcccatcctgagtcatgtcatttatataaactatcaggtgtggtcaaagggcccaccatgaataacacagaccctccagtcactcaggaaattctcagggttaataagttatctcctaggaacagacaacaagggccatccgaattctccacacaaaccctttacctggtgtgtttcccttgtctgccaaagctgagagccacatttagggcctacctttaggttaggtttgagagagagagagagagagagagagtgtgtgtgtgtgtatgtattttattttttatttgcaatgtaggtgccaccctacttttttctttcttcttttactcccatttctatgctacattgttctgtagcagcttgaaacatttattagaacaaagtggaggtataagtgaaataatcccagatacctcagagttaatccatggttcttaaaataaaaagcaggagaaataggaaattctgctgcctttctgtggagactttgggccactgctataattttcatgaggagatttgttgtgttctatattggaggagtgccactggactcctaggctgagaatgcctagctggttctgccatgctgctgcctttaagctggtttgggaaggaacctgaggagtgtgcctttttctctcatagccactcatatatccatttagccaagaaactctattgtaaatctattacttgtcagtatccataaaatgtttttgatagccatagctaataacatccatcttggttttactttcgtctgttaatccaggttatttccattggatttgtccctttaagcatcagttttttactttcctgtgtataaattcttacctaaataaacattttttaaattgctctttcataaattgactggtttttataattttcaacctaactcacattttcattttctacctatgtgtcaatcccctatgactatgttgagtgccatctgctatatctgctgttttattaattttttctctgcttttagcttatgaataaagatgaaagactaggcattgacccctttgctgtcacacttgacattttacactaattagaaaaacatatatagcttattattatgactctgcctaacacataagttgatcttatattcttacaactatggttttatctaagtgtatttgtaatgaaaatattaactgatttttatcagcttctttgagaggctcaaatgtataatgtctgagccatgctcttcatctccctattcctagtatatagccaagaataaacttaaatgaataaaacctgatatatagcccagcatgaatttttttttagaaaacataaatccacaaagtagatgggcacatcttcgatttgcacatctttgtggtgctttttatggagtgtctcctaattttttttattcataagtgacttcaaacatatgccacagctaattctatctgatgctaagctttatgaaggaaagaaagagtaagggaaagaaaaaaaaagagggagaaaaggaggaagggaagaaggagaggagagaagaaaatagaaaagaaaaaatacttttcttcattgtgcaagtagcttctactcagttttctccctgatcagcaattgtcagtatgtttaccacagaagaaggatgcacagaatttaaaactgttttgttttctcacatcctatcaaggtaacagcaataggaataaaggtgctagggcatagtgatatatgactgtcttctacctagactcctattaactactggaggttttgaagaaatagaagccatgggaaacacagcaactccattcaacagttattgtgcaccctgtctataatgcccaggggagattacaaagatgaataaaacatttctgccttcagtgggcttattatctggtagactacattttgagttgattacatagagatgataacattaacaacgttttcctatcagtcattcatatactttggaagactattagtttggaaaaaaaaattttttctatgcatcagagcttgagtcctaggcagatgaattattttgtaatttaagatttagacgtagaatacctcacaaccaaatgaaatgtgtgaacctagggtggtcttgagtagaggttagggaggaacattaaaagacattcttggggtaattgaataaatctaagtattatctggacactacaagctattttaaatttactgttgattttcttacttgtgatgataatggttttgtggttatacataggggaatgtccttactcttaggagaggcatgctgaagtatttaggagtaaagcatcatcgtatctgcaacttattttcaaatagtacagccaaaacaaagtatataatatacaaatgtacgcgtgcatgtgaagagagagaaagaaacaggcaaaatgttcacagttaccgaatgtaaatattgagtataggaatgttaattgtactgttgatttaacttttctgtgttggtgaaatttttcataataaaaagttttaaaaaatagaagagtagcaaagtttagggatagctacctgtcttatttagcttcctggtttaccaattcatttagaatgtcatgacatagctatgtcagcaaaggcaatttcaacaaataaaggagagctttcttctccttactgaattgattacaatacaataatgaaaactgttccagacataatagttacatatttaaaatatttttttcatattttatgtataagtgaaaaatggtcaaaagtatatgttatatctttgttgttattttaagaaatttacaaggcaaaagtactttgtagactaaactttattagagtggaaaggaggaaaaccttgatctcatatttcaattcttaatattttttaaaaaatgaaacaaaagtaattgtgttctataccaatgtacttcattttccttagctgttgggctttataattatcactaattcgtttccttattatgacttgcatcttctattttgctcaaaacgtcatgttagtaacaaactgtatttgtgcccttaaaaagtatgttttaaaatttttttttttttttcagactgggcctcgctgtcttgcccaggctggagtgcagtggtgtgatcacagctcactgcagcctcaagcttctgggctcaagcgatcgtcccacctcagtcagcctcctggatagctggactacaggcacgcaccaccatgcctggccaattgttttatttttagtaatgatgggggtctccctatgttgcccaggctgtgtttatagtattaaaagtaaaaatgattttttaacagtaaaaacctatccccaaatccctagtcctatagcaagtaaaattctatgtatctctgtatatattttgtaaaaattgtctgttgtaagtttaaaagaaaacttcaggatttttaaaaatcataatcaacagtaaatttcttggaatagtttacatatgtagtagaccattctctttgtttaaacaaattatcaacttactgtcactgtgggaagctcttcattttactttataaatgaaatataaactacataataagtgccaaccatatgtcagtaagggataatcaagtgtgttataaacccctttcctttgagaaagccattttgattttcagtagagcacttagatttgtagtgtgtatgttgttgcacctcgggtataaatgtagtcatcatgtatttattgagaatctactataagaaattgtgtgcatgtggcatagaggaactcattttctgtgagtagagatggttgggacacagttttcctgaagaccaagcaatatagatgccaactgaatgctataaaactatggtaaaaaaggaagtatcacttctaatacaaaaacagtctgggaaagtcactttaatgatttgtagaatgtttcacaggcaatttagagatcatctgaaactgagtcctagagaagtggtatgcccaaggccacattaagagctacttcgtcacaaaaacaggacaagaatacagaacccctaagtgtcaggccattattctttccactcaccacaaagatacagcatttgaactgacccttgcataagcaaagatgggcaaaagagggaacgattactccaggccattgagtggcttcagaaatcatagtaggtagttcagaaccgctattgagaataatacacaactaaatagtgtcatatgttcttgctattccctataacataggattgtatgaggaagaaatgtgagagaagacttttaaaaacctaggttagaggccaggcgcagaggctcccacctataaagcccagccctttgggaggctgagggaggaggatcacttgaccgcaggagttcaaggccagcctgggcaagatggagaaaccctgtctctacaaaaaaatacagaaaattaaccgggcatagttgtatgcccctgtagtcccagctacttgggatgctgaggtgggaagatcgcttgagcccacgaagtcgaggctgcagtgatccgtgatcatgccactgcactccagcctggctgacagagtgagactctgtctcaaaaaacaaaacaaaacaacctaggttggaatcaagtacagagtattgtgaatgccatgctaaatactggggattttattcagtagaaaacaaggatccattaaggtgttacttaagattttattgattaccagttttagttttatttccagatagtgtaattacgtatttgcagactaattttttaaaggttcatttacagtgaaattttgtcttccatccctctgggcatgcatcagataaacatacttttaaaatatatgtatggggaaagtccttcctataaatccatccatctggtatctggtaagctcagtagatccaaattgaagagaactcaataataagaaacaaaccctaccagatgaaaataactcccccgacgctcatctgaggaagatattggaagctactttttcttaggtaccaaacatatttgagttaattttattcttagaatttgatgatctgtttttccttagctgagttttgggagtccctaagtccctatagttttgttctaggttaaaaggaagaacggaaggtctaaacagaggatagctaatgtagaggaggtgtagatgggggagccagttggtgggtgtagaagtagacccactaacagggatgaaaagcttcagtgaataaagggagataaacatagatggccataaaagagagagaataaaattaaagcaaaagagcacaacagtttagagtcatttgcaaagtgatcctgaaagtaaaatacttttgcattacagtacagtatggtagtaattgttcacagcaaagaccctgtatcatatagaacaggttaaattatgtcttgaatttcgaatacagaaaaacatgagaattgtcttagaaaccgtcttgtgcaaaacttaaccaacttcaaatagcaaattaaaatgtctgtgacctagaaagtcttagaattcctctttttctaattaaactagaaataaggaataattatatttgcatatgttatctatgctgttattttagtgtgttctaagccccaaatgctgagtggctcatttgtattgaattcatctcaatgaggcttccgtgtgggtattttgtaagaaagattttaatgctgcccgacctctccagatcactgtcccctggcttctgaagttgtttgttcactaaataagaaggtcattgttctaagctctgtatcgacatgtgctacaatgggtaccttctgagaaaaaattaaaagtgatatcatgaaaatagcaccaaatttggcaccaagtagctatgcagctttaaacaaatcccctaacatctcttacagggagtcagtagatagtttcatgagatccctttcagctgtcatgttgtaaaaagccagttctacacaatattggtcagaaagaaaatcttactagagtagagaggttagatgtagttagtagaaatagaatatattaatggggaacactggaaaaattgtcttttaagaagtgtctgttcatatcctttgcccactttttgaagggtttgttggtttttttcatatatttcttggctgtataagtgtcctcttttgagaagtgtctgtttatatcctttgcccactttttcatatgattgtttgtttttttcttgtaaatttgtgtaagttccttgtagattctggatattagccctttgtcagatggatagattgcaaaaattttctcccgttctgtaggttgcctgttcattctgatgatggtttcttttgcttgcagaagctttctagtttaattagatcccatttgtcaattttggcttttgttgccattgcttttggtgttttagtcatgaagtctttgcccttgcctatgtcctgaatggtattgcctaggttttcttctagggtttttatgctttagagtgttgatgggagtataaattagttcaaccattgtggaagacggtgtggcaattcctcaaggatcttgagccagaaataccatttgactcagcggtcccgttactgtgtatatacccaaatgattataaatcattctactataaagacacatgcacacatatgtttactgcaacactattcacaacagcgaagacttggaaccaacccaaatgcccatcaatgatagactggataaagaaaatgtggcacatatacaccatggaatactatgcagccataaaaagggcaagttcatgtccttagcaaggacatggatgaagctggaaaccatcattctcagcaaactaacacaggaacagaaaaccaaacaccacatgttctcactcataagtaagagttgaacaatgagaacacatggacgcagggagggaacatcatacaccaaggcctatcaggggttgaggggctagggaagggataatattaggagaaatacctaatgtagatgatgggttgatgggtacagcaaaccaccatggcacatgtggcacatgtcactatgtaacaaacctgcatgatctgcacatgtatcccagaacttaaagtgtaataaaaaattaaaaaagagaaaactgaggattaaagaagttaaatatcaattatatgtgagagccatatttcaaatccagatctgctccatgtttcagagcctgagctcttaactgttgtactgtggccagaaatggttgcacgatagaaataggaatcaagtgggatcttgattagcagataagatttgtgaaagtgaaaaagaaaaaggaaataaaatgacctcaggaaaaataacatatggaaccaccttgattagagcaggatattatcagagcatattttaaattatttgagttgagatgcaacaagttaattatgcatgaaaatattaagaaaaattctagcagcaaaaagaggatgaatatgttagaaaagggattgaaatcagggagaacctttaggagactttatttatggtaacccacaatgactaaaaactgaactcagaggggtgaccttgggaatggtagagaaaagttatatggaagatagttcaaatgaaaaattgatcagaacttgattacaaatcaaactgagaattagggaaaagagcaagtcaaagatcccagcacaattttggttttggaagaggatagggatgggaaaacactggaaaagacagggtagcaaaggacggtaaaaccttgttgattttaattcccacatagctgttaaagtggagtgttctgtaagcattttatgggacagacttggagtttaatgcaaaaacaggaatggagaaatttgaaatgttggcaacttttatatactccctttatgcttccagcccagtttcctcccatccagactttgacattttttattagccaattgtgcattaagataataccataaatctgtttctactttccagagagaaattctggaacaacagcagcaagaacgaaatgataccaattttcatggcgtttgtatgttttgcaatgaagaattccttggaaacaggtttgccattttgcatctttaaatgttactgtttttaatctgaaaactcatcagaacatccctaactgttggttatataaattaagttctatgtgttggctcaggaccctttcgtatataagcagtcctttttaaaaatatacccaacgtccaagatgaactgtaggtgctctaagcagcagaggggtataaattcttaaaatgacagaagcagatttatgtttaatattacaggacttttaaaattggctgacctgcaagaccatatgcagcaaactactgcagatgcacctctgtatactaactcttttcttctaaatcattggtaacttttcacttttggttattaaaaataaagacataaaaaagaagtgggggcactggtgattctatcaccaaccccagctggtccaaaaccagctggtgcagtacaattcaattctggcactaatcacctgggattagcataaggttttacatatttaagggcacaggctcaaacaagactgccttcacattagacaccagccataaactcatatggtcccagggctacccaaagttttgaccactggttataaagtcagaggttcccactgataatttcatgggtttgataatttgctagaattacttacagaactcaggaaagcactgtacttatgattacagttttactataaaggatacagattagaaacagccaaatgaagagacaaattgggcagggtctgagagggtcctgaataaggagtttctgaatcctcttcccaaggaattaggacctgtcaccttcctagcacattaaggaattcagcaaccagcaacctactctgagttttggtgtcccaagtttttattaggacttcattatgtaggtatgattgattaaattattgaactcaatcagcagccccctcccctctctggaggtctgactggctcaaagtcccaaccctctaatcatatggttggtctttatgatgaacattccccatctggaagctatgtagggtcctaccatgagtctcctcattcatataataaagatactcctatcactagaaaaattactagaaactttgtgctagggacaagagacaaagagcagacacatttattattacgcatcagcaatgtttacaaatatacattcacttaaatacaagttatgaagttgtaacctctaggaactgaggatgatttcactgattcagcatacaggggacaatcagaaaaatatcattctctgctcacttgaaagaaagcagtctttagtgaaaacatagcccagcacagtaactgacattgttatgtgaaaaaccttggaaaggagaaggtagccacttattggaatttataaattataatttataaattatataatatatataatatatattatataaattatataaatttataaattaaatttataaattataaaagagtttaattgaggcattaatgttcaaaacaccagtggtaaaggtttgattctcagatcagttagcatagagaaaaatcggtgccaaggccactgatcgtacttctaactttgtccttctatttcaaaggactttacgggcataacaataaaggctggtcttaaaagttaacttaaaagtaccagtgaaaacccatgccaccatcagaaaatttaccaaacattactactgacaatgttttaacaaaatatttccgattttatgttgaggtaattattgacctagtgaggaggcatgtgattatcatcagagatctctcatatcggcatatgggaagctacaaatggtatttttgttttctataaagttctagtgattaatgtggatactgatatgatttgaaatatccatatgccattaaattcttacagtattagtatttgaacatattaaatattggtgtttctctagttcctaatataatcctcctgttcttctagtctaacttatctgcattctgtattgagtagggtcacataggaattacatgacctcctcagtagtcttgacttatgccattgttctgtagtaaatgcacatttttttaaaataaccagtgagaaagataaatagtgtctagttcttataaaacgtcccctttcattcatcagttcttttcatttatgaaaagctcagcctgtaagattaaagacacaacttgattccacctatgcactatattaacagtgttgcaggcatacatttgtgtacgccttgggacataaatatggaatatttgtgtatgcattgggacataaatgtagaaagaaggagatggataacagacaaggatagagtaatgagtactttcttgttaccatacatctactttttctcctctcctccacacccttcattgtttgttttaacctgtttgtgtctttgaatcgaaagtatatcttatagacagtatacagttggatcattttttatccattctgccagtcttcaccttttcattgtagtacttaattcgtgtttaatgtcattactaataagatcacatttacttctaccattttgctatttattttcaatatgttttaggtcttctcattattctcctctattgttgccttcttttgtgttgaataggtattttctagtgtatgatttttagttcccttgtttctttcttttttttttttttttttttttgagatggagtctcactctgtcgcccagcctggagtgcagtggcaggatctcggctcactgcaagttccgcctcccgagttcaagccattcttctgcctcagcctcccgagtagctgggactacaggcgcccgcaaccacgcccggcaaattttttgtatttttagtagagatggggtttcattgtgttagccaggacagtctcgatctcctgacctcgtgatccccccgcctcagcctcccaaagtgctgggattacaggagtgagccaccgcacccggctcccttgtttcttataccatagattttgaactctttttcttagtgtttgccctggggattgcaattaacatttcaattgaaaacaatctgtttcaggttaataacaacttaatttcaataatatgcaaaaactttgctccaatataatttgtttcctcctcactcctttgtgctattgttgtcatacaaattatacctttatatattatcagctcatgaacatgttttctaattactgctttatacaattatctttcatatcagatatgagaagaaaagggtcataaaaatgcgattatactgtatttcatatttacttatgtaattacctttactggtgatctttatttatttatgtagatttgagttattgtctagtgtccctttcttttaacctaaagaactttcttcagtttcttgttggagagatctgctagtaatgaattctttcagtttctgtttatctggaaatgtcttgatttgtccttcattttttttcttccatcatttttttgaggaatagttttacaggatgtagaattcttgactgagagtctttttccttcagcactttgaatatgacattctactgtcttctagtttccataatttctggtgagaaatcacttactaaggactgcctgcctgtatgtaaggagttgacttttttcttgcatctttcaagagactctcttcatctttgcctgttgacagtttacgtgttggtaaggatctcttatctcttggtaagaatcaatgaatttgaaaattgttcaattgagattttccagtcttcgggacagaagaaaaaaagaacaaaaaaaaataaacagctacagagatcatcaatcagattcttcccctgccccaccaggatttgtgttcctgtttgtgtgtttagtgattttcttggattaattctcttgatttgtcctacttgaagtttattgggtttcttagatgtttaagttaatgtgtttcatcaaattcgaaaagttttcagacattatttctttaaatgttgtttctgccccctttctctctgtctctgtttctctatctctctttgctctccttttggagcatattatacatatgttggtaaacttgatctctgtagctgtgtttatttttttgttttgtttttttcttctaagactggaaaatcccatttgaccaatcttcaaattcattgatttttacttccagcttaagtcttttgagcccctctagtcaatttcttatttcagttattgtactttaaaatccaaaatttctattggttgtctttttaaaaaaaatactttctggctactattggccactctgcctatgtaaaatacataataatttatatctttttattggtattctgtttggtaagatatcattttcataatttcctttgattctttagacaggggtttctttagttcttttgggcatattcatattagctaacttaaagtccttgtctggtgtgtcaacatctggactttctcaggggtgatttctgtttctgctttcttcccccatgtatgtagaggaaagtttcttatttctttgtatgtcttgtaatttttttgtcaaaaactcaacatttaagtaatataatgtggcaactctggaaattggattcctcctccaccccaccagggtttttgttactttttgtgtgtttagtgactttcctggactaattctccaaagtgtgtattactgctactgtgtggccactgaagtctctgcacagttagcttagtgttcagataatgatccgacagatttcgttaaattccttgaaccactgtatcttctgccttttgccaaggggctttgtatgtgggttggagcataccttcaacacttcatcagtttacagttctggtttagcctccacttcttgcttgtgtagagtttcagggttaatcagaggtgagagagtaggatcttcacaggtttttctggggcttacatagaccagcacatgtgtactgccttctagatccccaggaaaatgtcaacttttcagagtcctctgtagacacctcattacccagattttccttttaaatgttttggcctattgtttgctgcaattagtattgcctcaggcagctgtgatgttacaaaattgtcactgattgtttctggcaaatgccctaggggtgagaattttttcaatgggtggactgaatcatgtcaaataaagacaaaccctgtgaatgtgccttttcccatcacctgccatacaggctgaatagtaacagttcttgtaacagttctttcagaatggcccacttgtattctgccccttccagtggctgtgagcctgctgttgtcaaggctattgtggagctaaggggaggagaatggaatggggcaaattaaaacatcacaaagctcaccattcttaccacagttgagccatgtttcttaaataaatgttccttggattgttgcatcctttctgttaattccagagtgcttaaaaagttgatttcgaccattttcaccagtgctactgttgctttaatagaggagcagattttcagaggtccatgccccactgttccagaagtgcttctctcaaagctatttctgtaatttaatcctgtttgcccaaatcacatttataagtttagtgaaaactgattacaaacagtattaaaccaggacaaaaaatgagatcagagagcactatgtagggaaatatttgttcctaaagtatagggaaagaatatttgaaaggaaaagtacatgaaataatattttaagtaaaacttcatttcagcccaaaaggtattatgtatttatagttattacatgcttttaaggaccattgtgaatgtgaaaaaatataataccagtgctacttgatttacagtggggttacatctcaataaagtcattgtacatttaaaatattgtaagtcaaaaaaaatttaatatacctaacctaccttaggcatgctttgaacacttacattagcctacagataggcaaaattgcccaacacaaactgtactttataataaaggtttgaatatctgatgtaatttattgcatattgcactgaaagtaaaaaacaaaatagttgtatgggtactcaaagtacagttagttcattaataataaaattaagtttataaagaaaggagttgcaataataatttaaactgttatgcatttaatttcccataaattaaagcaagttgacattaggaattaatttaaaaattaaagaagtaattcagcaatttgaggaatcatcttggctgatcaagaattaaaggacttcaaaatctgacatgaagcagatcacataaggtgccatctctactccaaagccccaaagattttcttggccctttaccaaccagcaactgtggctacaagggtgaagcctttcctcccttctcacctcagactaataggctgaatcaagctaattttgaattagctagcaaaccacttaggtacttgtattagtcagggttctccagagaaacaggaccaatattatatatagatatataagcggagacatattatgggaattggctcacacaattatggaggccgagaagtgccacagtatgccatctgcaagttggagattcaagaaagccagtggtaaattcagtctgagtctaaaggccagagaaccatgaacttgaatacctagggacaagagaagatgaatttcccagctcaactatctgggcccccatggcttggatgatgcctcccctcattggtatgggctatcttctttactcagtctgctgattcacatactaatctcttccagaaacatcctcacagacacacctagaaatgctatttttaccagctatctgggcatcctttaaccaggtcaagctgacttgtaaaataaactaccataatattggagaggacagccagccccttcttgagcctgctgccagttccatctgtacctggcccccttttcagagcctggatatcaggcttggaatcctgggtagtcctggctaaggctaggccactcctaggggaacctcacctgaaaccagaagacatcaaggaccaccagttcagagcatgggaccaagtgcagactgttaaccccaccaaccctcttcctaacactgactttgccttcactcagtctccttccagctcttagatgtcagtcatagaacccttggcaaacctggctcaattttggcccactgtggtagaactgtccttgatccagaaggcattagggatggtagcaattaagtatgtggccagggtagcctcccaacactcatatctgctttgagacagctgcttgttagccctcgttccctcactttcaatatctgtattcctgtctggcaggccccaaaaaagttcagagcaagcctaggctcacacatgggcttgttctctggggcaacattgcctgagatcatggggaccttcctagtacacctatacctcctgagccagctcttggtccattccaaggcttgggtgtcaggcctgaaagccctgggtagacctgacatgcttggttactgttgggggaacactttggagtcaggaaggtctggcctataagcctggaaacaagttctaaggactgtcagtctgttccacccacatccctcccagcaagctgctggctgcggccaaaatccttgctgaaccaatcctcttaggtcccagaagccactgtggcctacctgaacagagtcttcgagactggccaagcctccaaactcatttaccccaggagccaaccactggcctctcatctcgtaactcagactctagatgccagattcttgagccccagagaggttgagagccggattcagctcccctgagtacattcagtgtgactcttaatggcaagatattttgatcctagatagactgagggtgagggaaacctcccaacccacccataccccttgagtcagataccatttctgacagcacccaggcacaatctaggctctagatcttcatcctggaagttctaggcagatgttaactatggctcggccactctaggagaacctccctgaatccagaggcactgtactttaccccaacatggcctcggggatagggggaactttcttaccctctgcctgacacccttcccccaccccaaaacacacacacacacctaccacactgcctacaagaggctctcagctctgctttcacctgaactcttccacagcctgagcctcaggtctggaacccctggaaaggtctagctctgtctgggctgcccctgggaaaacctttgtgggcccaaaaggcactgtgaactaccccaacaagtagttttagtcaaagttatcagtaataggcagtgagacaaatgagcatactaaccacaaggttaataaatgtatctcttacatagttaaaaaaaaaaaaagtcaacaaacatttttatagaaatgtttgctttatttctttatttcactttctcaaggggaaaaaaaacactgaaaacatttttttggggggggaccaggtaagtgtctaaataatctagataaaaccatatgatatgtcactatgcatagtctatcaatggtacttatactgatgaggctctccaaaacaatcacctttattttatgaactaaagttgtgataaaagctctgtagaatatactatacacatatgcttttttgctatgtaaaagttacataattacatttgtccttttctgtataaattaatcaagaagttggtcattgttttgcaggttatcacagcccttgcatttaatagacctgttaactgtgggttccaggtcattgtccaatgatactctggctaaatgcctgtgatcttaggtcatagctggttgtattttctgttaggcagttgcctcttactcgtctccatgatgaattggaaaagtagaagcagcacagttaatttaatagtttaaagcagtgatccccaacctttttggcaccagggaccagtttcagaatgaaactgttttatctcagatcatcaggcattagattctcataagaagtacacaacctagatccctcgcatgcacagtttacaaaagggttcgcgctcctatgagaatctaatgccaccactgatctgacaggaggcggagcgcaggtggtaatgctcactttcccgcctctcacctctttctgtgcagcctgcttcctaacaggccatggaccgatacccctggtttaaaggacagaacctgattcttctatagagtgtagccaagcagcagatagtagaacaaactttggtatccctttacagaactgatgtgactgtgtacacttacatactttataatgtcactctttaatagctgaaatctttgtgttagtgcttagcacttgcttatacctctaattagtgtttttattatgtgaatgctattccaacccaaatgtgttcttagatgatttgtgaataatcctaattgctcaaatttcttcctagatctgttattttgaaccacatggccagagaacatgctttcaacattggattgccagacaacattgtaaactgcaatgaatttttgtgtacattacagaaaaagcttgacaagtaagtactgatttatgaaacactgcctaaagctgttttaatcttggactctgttgtgaatatttttaaattaatttaatagagtaattaaagaagtgggaatttcccatgttggaggagttcacattttgtacgacagtccttattttgtctagatcatattgccctttggtgttttttaaatttttcaaatacactatgtcatatataccaaacaatatacatatcatacaatgtatgccgtataggatatgaagaatatactcactgtctagcctaagaaatagaacattgttaattcctttgaatctccctgtgtgtctttcctcattagtatttccccagaaaccactattcttaattttgtaattgtaattcctttacttttcactgtaacttgtctacatattcaataaggtaaatatattgtcaaattatggaatggtgtttaattttgtgtgaaacgtagcatactgtgtgtattcttctgccttttggttttcattcacatttgtatataatactccatttcctcaaggtcatattctggcaaccatatctggagcttagcctgttgaaataaggaagaaaattctttaggtcaccaaaatgactttcaaaaacgtatccacttttctttctaggaaagggcccaaaattttttctctgagaacccagttttctttatttaaataaaatactaacaagtgtggtgcttcaacccacaacactgagagcaacaacatagaaaaaaaaataagggccgggtgtggtagctcacacctgtaatcccagcactttgggaggccgaggtgggcggatcacctgagctcgggattttgagaccagcctgaccaacatggagaaaccccatctctactaaaaatacaaaattagccgggcatggtggtgcatgcctgtaatcccagctactcaggaggctgaggcaggagaatcgcttgaacccgggaggcacaggttgtagtgagcagagattgcaccattgcactccagcctgggcaacaagagcaaaactctgtctcaaaaataaataaataaataaataagaggaagcaagtaatacagattaattataagaaatttttaactcaaattttgatgtcaccactatgttaaatcgagtcccttcacccttttgttaaacgactacctataaaataagaccagatgtgccttctagcaagattagcaataatgaatatatataatcagcttatcacccataaattgtcaactataaaagaatatactacaaaagaatattattatgccctggaatatattctttggcataagaaattgatgaaaaggtgtttagtagagataaaaacaaattcaaaattgaaacaataacagattgcaatcatttgagagtttcccatgtaaaatatattatacttagacactatatggctccagaaagtagaactctctactttttactgagtagcaattataatacatgttgtatcaactgtcaggcttagtatgagaaagacattttgttaataatctgctcaaaactggtaatcactgcttcattaggtaatgaatgcccagtcagtggaaatatttgagcagaaggtatatgagaattatatggtagtaacagctactatttatcttattcacatacatgaataaatacctagcacagttcatagtgcatagtaagtgctcaataaatatatatatatgaaattatcatttaaaaatctctaaaatgttggtattatcttcagtttagaaatcagaaaatggcaacagagaagggaagtaacttaaagtcccacagctagctggcactggagcaaggaattaaaccctgcaaatcagctcacaggatatcccaaaccatgtactaattattacatacaatgggtgcagtcagtgcaagtcattataattaattgaagaacatacctacatacttattttagaataggtaattcagttagtaaagaaccaaaataatttttggatattacctatctttgtcacagtcttaactgaatagcaaagttggtcaacttagctgactacaaaatacaccatactatgcactctacaaagccaaatgaataaagtgaggggggattctgacaaggatggtatatcccatttgaagatgctgtgtaacctaaaatgaataaatatgaaactcaataataataaaggattattgcagcaactatacaagagacttgtttatcagtgtttgtgtatttcttgtagtttgcagtgcttgtactgtgagaagaccttcagggacaaaaatacacttaaagatcacatgaggaaaaaacagcatcgtaagattaatcctaagaacagagaatatgacagattttatgtcatcaattatttggtaaggctttcttttcataacttaaaatttgattgcagtactgcaaacaaaatctttctgaggaccaactaatatttgaataagcaattattgcaaaagtcaaaatgtaattgaggggcacattcaagtagtgattagctttgaaatggttagagtacaagacatttgatttgacttgtcttttatttgacagtgtttatgtagtaaaaatgtcatgtctctagaactcacagtcatcttgaccaaaaaaaaaaaaaatacagcatttggatatccacataccatcccccatttatgtaatatcttttaacttggggccagagactcctttctttttttttttttttttttttttctttttttcttgagatggagttttgctgtgtcgcccaggctggagtgcagtggcacgatctcggctcactgcaacctctgcctcctggtatcaagcaattctcctgcctcagcctccccagtagctggaattacagctactgtgctgcacagcactgggattacaccacacttggctaatttttgtatttttagtagagacagggtttctccatgttggccaggctggtctcgaactcctggcctcaagtgaaccaccagccttgccctcccaaagtgctgggattataggagtgagccaccacacctggccagagagacttctatatattctattcaaaagaaactgttgagtactggatgtgttaggtgctatgcaaaataattctttaaaaacaatctctttgctctttccccttcacccctacaaaagtgtgtatctttatcattctcttcagtcagcttatttttaagggaagtttcaaggaaaccaaaccattttactatggaaggggatttttatttgtttggcttgtagggtagactaaccaggttaccatgccaagcattttaaatgtattgatagctctcctttccaagaggcattcagatggagacagtgggggatggggagaggcatttggaaatatgggaggggatttttgatagacaacaatgactggggaactgggcctgccttcaatctactgatttttaaaaaatatatatgacaaaggagggaaactactcatataaaagaagaggttatgtaactctccagaggaattggaagaaaaacagagagttctgttttgaatgggcatttttcttaagcaaatggaatttttttctctctcaatgtaaatgaattaaaacccaaacccactggtcacaaaaggctaattgaatataatcagccattttatctattggatagaaacaagcatatcctgaattatgttggaaatctctgctttagggtggaattttgtctgttctaactattccttgtagtgttaaaattccccttgagaagcaagtttaacatgtgtttgaagattgactctaagaggttgccatggttttctacaaatgttttacaaccagctaaaggcaaacgtaccctttgagcttttcaatcttttcttgaaatcactcagtcattacttcctagagcaaatgctgcttcaggacccagcccagtctaatagggagtggacttcagtgctagctctaagaaatattcagctactgcatctagctataggagcaatttaatagttcttccttctggggctcttttaaaactaatattcaagatcttgagactagcagaacattatatagctggaggttttcaccttttagaggagacttcaagggatttgctcactcttattctgccagcacttttagaaaagtatgatacttcatttcctgggcatcaagtagggtagctgtcaaaactgaaatcatctgccagggccagccatctctggatgagcatggcagattgtgctgctcatacagggcacggatttgatgtggcgtggactacacattaagagaagtgtttcaaaagaaagtaagggctttaacaacgtacaaaatgaaaattaaattacaactttagagtcatattgatagaagtcttttttttagctagcagctatttgagtacttataatctgcaggcactatcctaggtatttatattaaattgtttaatttaagtcacaattttgtgacacaggtattgtcattaagcctcttataggtaaggggactggggcacagagaggctaattttccaaaggtcacatggctagggcaagttacttatcctgtgcatcagtttccttcatttttacaattgagacaagactaatacctacatcttatgctttgggttgggtattttggccaagtaatggtgatgagttcataatgatctattctcccacccttgcctattctcttttataataaactaaaaagtgagccaaggtcaaagtaaagctgactttaatcagcactttaaggctctgctccacaatcttcatcttcctagcccgtttccacttcctattcctattccctattttctattccctattcctatgcgaaattcctgctgaggtaagtaaccaaaaactgtaagaatgattaacaaaaaacgaaaacctaaaatgtgttgatgccttagcattatggaaatgatgtaaacacctttgaaaaggagtgaagaagcctattggcttcactaaagatatacacaggcactaaactagaggggtgcttaccagaggtatcaggcttagtaacattctaggaatatttgaaggaatactgttatatatttaaagtataatattatatagaacaagtgtataaaaaactgtcccaaatactaacagagtataggtagagaaaaataaaggccagtgtcttctcagtatcatgttagtattatttcagacctcattaaagaataatatttaacgtgaagaacatgagtaataaatcaatatgaagaataaattctaaaattttaaacaatgaataatgacaatactttatttaaaaaaaaaaaagatagatattcccttgttatccctctgagggaaaaggctgacatgagtgcatgagtgtgggcaaaagatagaattgttatattagtagtgggtttatacatctattttattgacatcatacattctgcatacatttgagtgccttccaggtaccagatgctagaagagaaagaaaaaatattgtagatagaaaggctgatttgagtcactactttcaaagagttcagaagtcagtatggaaaaccaccatgtaagcacgttagtttgaaccctttgtaatggtatatggaaagtcagcgttcgacctctcctatagcagatatatgcagtcattgagtcattcacacacagagctcctcacctccacttcaaacgccatagactctgccagcgcaacaatgatgggaacatccagggtatccgtagcaagatacactctaataggcagcagaagtaggagagcaaatggacagagaggctgcatttggctttctgagctcagcaaattgacaagttccattttccttcttaggtgagataatttctgtgctgaatcattcatatcagtttctgaatagtaacagacttgcaaaaacattaaaagtcttttgcatagtctgaattatctacatcaaattcttgctttgttttctcacaaacaaaagagttcaacaggtagtgaggatgggttggggataaggtgccagttagtttcacattcagataacccttcctcagagggcaacagactgtttaacatcgaggcttcagctacatattcctacgatgctcatgtttcaaaccctgagtttttctaaagggaattggttttgctatgatttttatcattctttgatttaaatttttttattcttaaagtatacaaagccacttataacaaaagtaagcttttaactgatttttcatagttttttatagttttctctagtgaagttatttacacttaaaacacttctctttctgtttctggtggagttttgtgtaagcacatgtaagtgtgtatgtattagggcagaagtgtgatgggtgaaggggatcttttttttccatgtttttttccaccctctcattattcatgagccatctgatgcaggggtttgagggggtgtctgaacatctttagtgatatgccttccaaactttgtttttcttacattctttgctttcctgacatgattcattagcaggcacagtgtcttaattagagagttatgtgcttttttttttttttttgctttgggtcttgtttctataataaatcatatctttaactgtaccaaatcagagcactctaggaaactgggccactttcacgtgcaaattgcttatttcctaatatactgataaacatgtacattcattttcctctcaagtggggtaagtggttaatgctgtgtggcctagataactctctacatattgtactcaacactgaggaagttgcaaaataatgctttgagtttagaagtttaacagtgaaagatattttttgtacttttggctcaaaatattcattgacaagcaacatttgcccttatcattcagaatgatcaaatcacagaaggcccatactttagtaataccttgcagcaataaaaccatgaccttaagtccaagtacagaaaaaccaagtaaggcatgaaagatttaattcattaccaaactttctaacaagcatcttgttggcagtgttgaggccatttttggtgttctgtaatgagattcagacacttcatgatgactctgggaagtacattatagagtccaaattaaccatctctaatgacattatgatagatctctgtatatctaaatgtatgcatcatttagctgataatgacagcttcaaaacctctcattaagttgatgaataatggattttctttctccctctaaatcataatggcactcatagttctttgtttttagctagatgaatacctttatttgggggaaaaagagtccataattgagtgaattttggttttgtttttccaaaaggatattgaacaacaaagctatccatgcttgtagcaggtcaggtgggcctgatcctaaccatagtttagctgcttgaaaacatatccattaatgttcctacctctctctttgtgacattgtctgcttttgcatggcacaatgggaagattggatagaaagaagacagggcaagaagagaggaagaaacggcccaaggggaacaaaagaattgggccaaaataaatcattcctactcatcactccataaagttttgctaacgctgtgactaggcttgccagacatagcgccaaaagagtggaacttttccactgatggcaaaggataaaagggatttgagtaggtactagagcacctactcatgcctagtactatttctttatagacagtaactcattcatttaatcaccttaaaaaaaccttttgaggtagaatctaaattgacctcaagtgtatttttttattttttatttctaacaaattgaattctactttctaattcaactcaaaaaatagtttatagtaatagtacccactgtatgccaggctctggaaatgtaacaatgaacaaaggccattagaatcccagatattctaatactcattcagggtttagaaacactggttcaaatttaagagaaaagaacttgactgaaaggatattgctgcttctctaaaaaattatctcattaaggtttcaacttcatattgcttttgcactgtcattaagtcaaaaaaaagtgttgaatcaaaccatcataagttgggccatctgtatatcctacttgtactgtttcaaaaccatttaaacatgggtggttttgtttatttttttggttttgatttttttcaaagttctacatactctctcccttctctttcccccaatgtctctcatccctctgttcttcctacaaaggaacttggaaaatcgtgggaagaagttcagttggaagatgatcgggagttgctggaccatcaggaagagtaagagttgttattgctgctaattaattgcagtgttccaagagtaagaagacaatgctttagtttggtttaaattatgaagcgggaacataagaagaaaaaaataccttctctgagccatgcatcccttcatgtaatgtggcaaaaacttgaattcaaaataactttgacataaaaattcctaaagacactgttattccaactaaattaaagctattgattgaacacacaagtaatatataattcagagaaaaatacattccgaagtgctttgcctgctcagttagtgctcagaccttgaagtgatgtgatctttgaactctccatgttgctgtcattggaatagagaatataactgcattgaagttaatcctgttctgtgttcgggccattgatgactaactttaaacattcacagcttctttgcttgaaattataagcttgagaaatgttcttttcaacctaaaaggatttcttatttttcatcttcttttcagtcaaagctttttggccttttttctctctcaggattttaaattattattattttaatagtgaggtaaagcccaaaggtagagagctgccatttgctgaattttcttgatgcatagagattcaggcagagagtcttccagactgaaataaaaacatctttcccattaagacatactagttggaatatttaatgagtgaatgttaaagttttaatgacacaaaaggttataaatagtaagtcatgacctgggccgggactggtggctccctcctggatggatagagttaaggaaaatgtttcctgttttctaatagggaagcttctgtgtgaattgggttaggttgatcttgagagtcttatcagtgatcatttctgagcttgccatgaaaaattctctcatctgaatttgaatgggtgttccttgtctccacaactcttccctcctggcagttttcctggtttgggaatgataagaagttggtagtatttcaaaaagggaaatgccaaggagcggggaaagtggtaaaagggatcctgtatcctttttgagttccctgtctaccgccagatttaacacttgcccagtttaaaataatcagtatttccctcgtgaaagagacacggtttgcctttgtaaaatacactatttgtcatgcagaaacacattcccggcatcacacctcacagcgtgtgcactcagtggttgtggttaatgggagagagcatcacattttctgatatgtctcctttgcaaattaaacctcattgtctcaggacgacattcctctgactgtagactgagatagctactcagaagaacggcaaataggagaaaatggaacagcacctgttcactatgtatattaatttcatggtgctgctttgaatttcaaaagctatatcagagagtcataatatgatgtgacagtctttaccaaaatgtcagagttgaaagagattggcagggttttttagtaaggagaaagcaataccaagtcactgtgtagtatactctcttaatgaagggaatctccgtattttctctcctcttttttaattcagtgactggtctgattgggaagaacaccctgcctctgcagtctgcttattttgtgaaaagcaagcagaaacaattgagaagttgtatgtccacatggaggtaagatacctgtatttatttgaattttgttttattctgacaggggaaagctagtaattgttgcaccctcatctgcttttacttcagtttcccaatcattattccaaccagaagagacaggccaggtctgtcagggagaaccagagctcagggcaatttagttagtacagttgactggacccgagtgagctgtttgttagtgtgagatttctcagaccactgatgccatctcacctttgagatgcttacaagatcattctagctcagcaggtgggacaggttctgagtcttttttccagtgcttcttgtgctggtgaataggagagcaagaagggagaacattgccatttacaaaggtcccggaggaatagggaaaaaggagggtgggtagagaggagctagggcatgatcctacagttccttcaggtgccaggatttagagagaagaaactagggagcattcctagtgtgggctttcccttctggatgccatttttatgttatagtgaagcttggagctagcagttctaaacctttttcaccccagtatacctgagagaggacacacaccctgcacctctgatccttagctgcacaaggcggatagggaaggggaacatgtaatgattcatgatagtatcacagcttgtgggcagaggggtgattataatagaaaaatattactggatgattctgatatctctccgtcccctccctgcagccacctctgccaatagtggaccatattctctactttcacccactttcacctcacccttattcagaaatactgttcttagtttagtaaaataagggcctagaaagcgctcaaaagaccataaacattttccttgattttagtttctctgaaaaaggttcccactagtatgtgtgtataatttcctgtgtttagatttaattcataatatcttaatgtctttgtattgaaggcagccttagtatgcctatcctgtgtaaggattaccttttcggcatccttgacaggtgtccttaacctctgctgggtcactttcagtgataacatcacgaattcctaatcatccttcatatggtgctacactaaatgccatcccagtgagttaaatggtctttatcatctgtgagattgtaggttaaaacatttacacagacaattgcaggtgtcaaacaaacacgcaaaaaataagtgcattgtaaaaatcaaaagaaagcgtgatttataggaaggtgtgagtgaagagaagctttgaggtttaaacagtgtatttgacagcataaaatgaaaagcagaatttgtaaaaattacctatgtggggcaaagaacctatatccataattctagtccaaatgcacagtacaatagaaacatatcttacctacacttttatcacactgcagaatgcatacatagacttctacatttttagaaggctacaaaatggataacattgtaaattataaaaactatagatataagctatgagcaattataatgttgttgctgttctttgatatggagtctcgctgtgtcacccaggctggagtgcagtgtcacgatctcagctcactgcaacctctgcctgctaggttcaagcgattctcgtgcctcagccttctgagtagctgggattacaggcacccaccaccacacccagccaatttttgtatttttagtagagacggggttttgccatgttggccaggctggtctcaaactcctgacctcgggtgatccgcccacctcggtctcccaaagtgctgggattataggcgtgagccaccgcgcccggcccaattataatggtttaactgattgacatgacttgtttggactatgctgtaaaaaagttgggtatggagggaagtagttagacttggaagacttcaaaagcagaagataccgaactcagactgagtttctaaactactcaaactcctgtgaataagttgtttataacttcagcctgaaagattaaataattcatatgcttacagatgtattcattccttttttaggatgcacacgaatttgatcttctcaaaataaagtcagaacttggtaagtttgattcagaggtttttttctgtgatgcttcattttttataaaccatcctgtaagctatgcctatgttcagtagctatgattggagagtgcaccaccaaaacatgtctctctatagatggtcttgacagaactctctgtgaagcagtgatgctcaaccataatagtcaaatatggtttttggtttcatatactccttctttctctttcctacatatatgagtgcttcaagtgaaatataagttagtggttaataatatatcataaattggagggggctagtggaatatggatttttaagtcaaactagagttcagattccagctctggcacttactggctatgacattgggcctcaggtcagaaaaatgttatgaggagtgaataatgtatggtaaatggctactgcactgcttagcagtatagctaggattgtttgttataggtgtacccaatgtatcattctaagtatcacaacaatagaacgatttggggcattaagacatacgtaaagtactgacttgctaatagatctaagacagtaaaaaacttacttctcacagctcagctcagtcactgctttcctaggtccttggatgtgttactttgctgcttttatagacatatatatacattgtttatataattagcttagtagtcaagcatgggctttgcagctgacagctatctatgcgatgctaggcagtttcctaatatgtaatgtaggtatgatactacctatctgatagggttttatgaagattaaatgtattaatacatggaaaattattagaatagtgcctagctcataagccctgtgtaaatatgtgctgttattatttggtatctattattatgctttataattgtactgcctcttcaggttgattaataaaaataagtggctcctttaagaaattataatagtgcaaaaaatgggtctgaacagttgtctaatgattctgtattttgtcattttcaggattaaatttctatcagcaagtgaaactggtcaattttattcggaggcaagttcaccaatgcagatgttatggctgccatgtgaagttcaaatccaaagcagacttaagaactcacatggaagaaactaaacacacttcgctgctccccgatagaaagacgtgggatcaactggagtacgtactgcaaaaccaaatgtgcacttcttactccaactctttgattttgtccctttatttaatttctttaagcctacagaaaaaaaaggaatacatatttattataaaaagtatacatcagtacagtgtggggaaaaatgtaaaaatattcaaaatgcttatttttaaaataatccccctcttacaaatgaaaccaagtatttttcagtatttgtgatatggagatagatacatatgtagagagatgaagtagatacagattttttaaattatattttattaacaaaatattgtaaatatctttcaatagccagtatccatctgttgcatcctttctaatggttgctaaatatccattgtatggatataatctattctgcgagatacttaggttgtttcttactttttgctattataatgatacagtgaatctatatgcctacattttagcacacttatctaattatttaattaagctgaactcctagaaataaaattactatgtcagagtttgcacactgctaggactttttgtatatattttgtatattggcacttgaaaaaattaagcagttggtcatctgttgttggattcccatgtatcctttgccagaactttgtggactggttcccaagtatcctttgccaagaaccttctggactggttctcacatcgttctggataacctcagtcgagggctcctctgagagactgtggggttctagctgcccagagctccttctgttcttagggaatgttaagtcagttcccccagaactttaaccagaaagttctagtttttctccttcagaaaatcccacacttgtgagggtaccctgtttttatgatccttcttatataaattaaaatttgtaatattccaaaagtaacttcaaaatgtattcagagaaggaaccagaataacaaactttatattccgtaagtgtttccttttgtgattacctagaaagaaggaactattaggctggaaaacaaaacacaaggaagagcttattattctcaattatttgaataatttgtgtttgaaaaattaactatatttgaagtttgttaacttataaggaagaactaggacctttgagtagaaatgagaaagatgtcatttttagcttcacaggaggtgtatcaaacaactagatctacccactactggggtcagctaccttcgaagatagtgtgttttgttatcatgatagatgatcaagcagaggctaagtggccagcggacaactccagaggcaactctggagggtgggaggtccacgatcttggtttaccaaatctggatagtagatttggtaaggttgatgtcagccagtaaaagtcaaagtgaaagcaatcagaagttgtctccagtatagcctttgcaaaatgctatgaaattgttggcaaggatacctgacaaaattatagtaaatgtgtacattcagctacctggacactgtattagcttggtaatttaatactatgtatctgtggttgttttcaggtattattttccaacctatgaaaatgacactctcctgtgtacactatctgacagtgaaagtgacctgacagctcaggaacaaaatgaaaatgttcccatcatcagtgaagatacatctaaactgtatgctttgaaacaaagcagtattttgaaccagttgctactataagagtacttgaaaacctagaagaaactaccacagaagcaatttttcatgtttttctcctatgagacagatatgaaagaacaatttaaatttgaacatcaacaaaagattggtccttggtgaaataaacttttcaaaaatgaatgttcttttcaaaaaataaagtagaaaaatgcacttactaagaacatgaaaaaaaatgaagtaggaaaataagatgaagactttgtattttggctgtaaagttttattgtgtgatcatcttaaattatctcacttcattaaactcataattatatatagaagtatatgtcaattacaaagaaatgaaatgttcaaattatttataaacctgatttttcaatcagtagtttcagtctcctccccaaggaccttcttcatccaacaagttgcaaaatttgaatatcccttctgtactatattgggtgagctgtaaatgtaatgactaaaagaaaagccacagaagaaagaagaaatggtcaaagacgtggataatatgcaaattggccattatattagaacaatcaagagctgactgtgttattaccactttctgcctagggtggccaaattccctagaaatagacatcaagccagttaacttcacttttccctgcaatttgtatgtcactaacatttaaatgccattttttaaaaacataaccacaataccattatgacacctaaaaaacattaacattaacttaatatcatctgttttcagtttttcccacttgtctcaaaatgtatgtttacaatattatcagtttcattactgatgaatattatatgcctcctgataagatgtactgaggaggacagaatatcacttttgtagatttataccaaaaatgcataatttggatataatgaagaaacagtcaaatccaagtttgaggctgggcacagtagctcatatctgtaatcccagcactttgggaggccaaggcagaggatcacatgaggtcaggagttcaagatcagcctggccaacgtggcaaaaccccatctctacgaaaaatacacagattagccaggcatggtggaatgcacctatagtcccagctacttgggaggctgaagcacaagaatcgcttgaatccaggaggcaaaagttgcagtgagccgagatcacaccactgcagttcagcctgggcaacagaccaagactctgtctcaaaaaaaggaaaaaaaaaaaaaaaaatccaaatttaaaggacattctacaaaataattggcctttactattcaaaaattttaacatcataaaaaacaaagactgaaaaactatttcagattaaaggtggctaaagatagcgtagcatgatcctggattggatgctagaccaagaaaaaaagtttttcttttgctacaaaagacattagcaggacaactggcaaaatttgagtaagatttatagtaagtgttatggtattgttgttaatttccagattttgataactgtactgtgggatgagaatgtctttgttttcaggaaatattcatacacactgaagtatttaggggtaaaggagcattttgtttgcaacttactcccaaaaaactaacaagggtatatatagaataatgaagtaaacatggcaagatgttaacatttagggaatctaggtaaaagtatgtggagattctctgtactatggcaacttttctgaaagtctgaaattatttcaaaattaaaagttttttaaaatgtcttttttcagccaggcacggtggctcacgcctgtaatcccagcactttgggaggccaaggtgggcagatcacgaggtcaggagtttgagaccagcgtggccaacatgctgaaaccccgtgtctactaaaaatacaaaaattagccaggtgtggtggtgggcacctgtaatcccagctactcaggaggctgaggcaggagaattgcttgaacctgggaggtggagttttgcagtgagttgagatcgcgccactgcactccagcctgggtgacagagcaagactccatctcaaaaaaaaaaaaaaaaaaaaaagtcttttttcagttgttttgtttaatcaggttccaagtgagatccatgcactatatttggttggtgtggttcttaagggtcttttaatctataacaattcacagtttttttttaatgccacttatttgttaaagcaattggattagttgtcttgctttctggatttggatgattgtatcttctttatattatttaacatgttccattatcattcattgtctccatccatttctgctactataacagagtacctgag

SEQ ID NO: 17003 - DNA, 46118 bp, Human
gcaccatatatatgccatgttatttaaccgtcatgacatgcctatgagatatttagtattacttctgtgaggaagccaaagctcagagaggttaaataactgccccaagaacacacaggcattaagtagtggagcagggtttgaacacaggtctctatgactccaaagtgcagtgtgatatgttatttttactgatctgtttatggaaaatgatactgctttctaatttagtattaacacaaagatttttttctaaatagatttacttaaagtatgttataaaaatactatataaataatgaaacagattttacatgagtatgaagtggtactagtagctagaatgatgaaagtttggggaatactactccaaatattttgatagctagcctttcaatttagcctgtcttatatttggactgctgagtacaaggaaaagaaggaaacatgaaaattaagtgaaatatgagttacttcccctgtgctctgataggtgggtaattgatcatatgtcacaataagaaaatcaaatgaaccctttcaaacaacagcaaaatctgtgattgtaaaatccagaggaaaaccccaggtgggatctatctgtatgaaggatgaaatttccaaggtctgaacatagaatggctgagaggaagtgatgaccctgtgagtcaagaccctggaccctgggggagccctgtgggtttgagaagccctgggtgaaaggtgaagggttttacaggcctgtttacagacctctgtagtgacagaagggagatctttgtgcaaaggtcaaagtaagaattgggaaagtctgaaaagaaaacaggaaagtaataatgaagatgaaataactacttggcatactctgccacatgatttacaggcaaggtttcctttgtttttcacaacaatgcagcaaagaagtgattatgagtcacatttcataagtgagaagactgacattcaaacatgttcaataactggcccagggtccagtggtcaagccaggactggacttcggaccaccagttccaaacccacaccccttcccttgcaccacacgcttttgtgtggatgagcctccccaaccctgtcaacaacaaactgtcactttgtcacttttaatgtctcctgcttcacaggacacagctagcctccaagagatcagggaggcatgcccagagggtgctgcttctctcttttgaagctcaagtgccacagacctcagaggcacataaatgtcccccacactgagcagaggactttgcagtgcctgatcagggcagaaaaaggaggcatgcacctgggggaggatcacatacgagtgaaacctgtccccgctgaagcactaggtttggagaaatctactgggcatttacacacctttcccacttctgcttatgacttgtagccaaactcaagagtaccacccacttccaggaatagtgtaccaaggtaacagaaacattctagattcatacaattggggttagattaggatcatctgaaaatgaaggttgtgtatgtcaattgccttctaacaggatgggtggagagatgtacttaatgaatgattttggggaagggctagaagtgaagcacatggcctctctgccctcactcattgaaggctgtcttctgaagccccgtggagctcagtgcctgtcacatggttgcccacatttgttgaactgaactgcattttcatctatgggcttcaaaggctgtgtgtactctgggatctctgggaatctgtcagggaaggtgtctttgtcatgtttgtggatggggctccctttgggggtttcccagggctttacactcatgctccgagggtacgtttgtagtcattctcatcagtggaaatgcccacctgccggcagaagttatttggaaccaagcaagagcactgtccctggctgtggtgttgtttctctagtcagttcccctttctgtatttgagttctaccgtcagtcctggcattatttctctctctacaaggagccttaggaggtacggggagctcgcaaatactccttttggtttattcttaccaccttgcttctgtgttccttgggaatgctgctgtgcttatgcatctggtctctttttggagctacagtggacaggcatttgtgacaggtatgtttgtggaggctcagacgcctagggagtggcatgagataaagctgcaagctgcatctggggcagaaatgctgatgtgctaatggccggccagagaatgagtaaaagggattgcagagagcatgcttaaaacctctgaccatcaggtttgcttctcagattgactacattggaggtgggatattacaaaaatctgtctcttcctgccagatcccttcatctgtttttcgtgagctaagagacaaaataggcaggaaatagaaggtgccacttaccaaataattggcagctgttcttggctttggggtgctggggtctccgagcagcctctgctctagaagaagcagtccaaagatgtcagctcgcctcgcctgagtcccctgtgccagtgggaaatccagagaagggggatttcctcctcttgcagcctctctgcaatggacttacttggctttcctgtttgacctttcccttctctggtccagagacccttccccaatatttcttcccatccaagtgccccatcccaatattagccccacttggcaccagagaccaagatctaatttaaaaagaaatattcttgggtcaaaaaagagcccaagcaagtgattgaacataatgtgtttcacatacggtgaacctatttgcatttgcatttgcaaacgggcttaaaatatcatctctattaatagcaatttaaggttctggagagccaggtgaaaatagtttttgacaaagggaacttcctactccccttaaactgtaataatgaaggaaatgaactgtttatcttacatgtaacctcaatcttgggactaaggccctgtactaaaatgcgtctatttatgtgctcagacttgcagttcgtgttatgtctgctgctgcagataccgttaatattatttatgtgagctatcctgtgtataatggaagcttttataaatctctatttatttattcctaatatagttattaagtgcttgctatgttccaggtactagggacttaacaggtagcataaaagacataaggaaaagctgcactcttgttttctagcctagtggggaaatcacattaatttaatcacactaaacatgactacatagcaatagtgctttaaagggaaggaaattgttctatgtgactatatcagctgattaattaccaagcctttgcatttgatattttggttagtctattcttcttgaatttcatatgcctcttcctgggtgggggtgaggatgggattttatggagttgaggctagggcaggtagggagaaaacatgagaaagatgaagagataagccaagccagattcttcagcagaaaaatcaaggttgaaataccatgtttcaaaaatcagactgaggtgggagttgaggttaggggtccctaggccaggggattgaagcttcaaagagataaaactagagcaaaagcaagcacagagagtggcagagaggtccctgggcatttttccacagtccattctagtgctggcaatccacctttcatggccaggcaggtaagagtatttgtggggtgggagaaaggacagggccataggctgggcacacagccctttactggcccttatctctcctctcttctcctatacagtgctgtttccgaactgtacattggcttacactcgggctgaggtttgggaaataggcgccattttgaatatgtgtggaggaagaaaagtgtgtcttcagcactttccacctccccatcacggccctgagacctcaacaccgggaagcatctcgttccctatcggtcctcctttattcatggacggatatgattcctttctaagttccatgtcctttttagataaattaacttgaacctaatgcctaatggcttaaaaacaaacaaaaaaaaccctcttccttccagctagcatttgcattttaacaggggctttcaaaaaatgccttagcccaaggaatgagtaatgtgggaattccaagcagcagggtaggactggtgcacagtatggggagagaaggcccctcaagttgtggccctgaaatgttggcttcctctctttgaccatgatgctgtttctgagaaaacaagaatcaggctaccttaggggaccaggatgggcatggctcccttttagtgagttctatgagcctcatacctgacagtcagagccctcgagtggatgagcacagactagaagaagcactgtgaaactttgcatgatccttacctttttggcaaaaaggaaaaaaaatcgttctcaaattcatcaatagtttgaaatagggtgtgccttgattcagaaagtttcgattctagatacaactcggagaactaggcgtgtcttgtacacagatttgctcttgggggaccggaaaagctaaatgctatcgccatgctatgctccttcttctaggccagtgaggggaacgcattcttcattttaatatttcagttgcctacaatattggaaggtggataaaagcaccctctgctccttctaaatctgcgaagacatttcttctctgcacctactcatccttgatgcagctctcctcatgtctgtatggaaacactgtgctctcaaatgagtttcagaaagaacaactcacgaaagaaaacaagcattcggtcagaaaaatctccacaaatgggggataagggggatttgctccaaggagagactggaaaccaagtcagacataaaatccagcctaagctagaaggagacatggctggtgggagcttgaggaaaacagagctcaggatggaggacgtctccacctccagtcatgtcctctgtccaccagacaccaagaagtgttcatgttccatcgaggcagccctcacacccatcccttcctcatcatgccgactgcctctttactgcttcaggctcaccatctcaagtcgacgagcctgtaatactggctttcttgatcaccctgataccagccgtcacctcttgacaggcttattttctttaagctgtcattacaccatttttctgctcccaaactattaattccaaacttccaattttctgttaaattaaatatgaattccttatttgactttccatgccctattaggctatcttgctccttgctttacttatagaaactaatctcccattatttatccaaagacaacctctgctgcaggccagtcagcttttcttactgtcctgtaaaaattccatggtcactcctccatttccatgtgtccttaaaaactgttatttgattgtgtctcagaaagtcgtcaaagaatatataccaatgaaaagcatcaaaaaggttatacttgatgttatgtgtgtatcaaaaatatggctgaaatatttatccagtgaaactcaatcaacactaaaaagtggttctttcggaagcatcagttctttgagacccattaaacagatgcctcggatgcagggttatatattatcaggaatctgtctagggaagaattattggaagcttgcaaagcctttcaaggacagaggacgatagctaccacgttgagttctaggaaattaaccattgttattgttaaaggaagacagcgtttctcagaggaagactgttaaacagtgcagtggcccaggctaacagccctcataagtgggagtatcagaatgagtggacttaattacttaaaaccaatacagggtggaacttcatctgctataacagaaatcaactcgtgcaagttctaacatgcagggtacagttctgagaccaagtctgactcacctgtcaaagctcagctcaactattaccacctttacaccacccttccaagctgtaggagtgcttgctgttctccatgtcttctgaagccctggatcacttgtagccagctcagcagactctacccagacagggatcctttaaatgtaccatattgtctactgtgttaaaaatgagaggaactgactcagggtgagagcgatggagtgtccagatgttctcctttatttctccttattcctggaaatgtaatgagaatcttagaggtgaactgaaaagttatgagttcaaccacttactcaattcgagattcgctcctaaaatgtctcttctgtgttatcacccccactttggtttgaatagtacttgtgacagggagcttatcacctcacaagaaaatccagtcattgcttgtagctctctattaaaagttttccatcatctggaactgaaatctggctccctgtaacttttagttattggaactacttgcccttcagcaacagtgtatgtatcctcccatggaagggcccttacatatttgcagacacccagcatatacttgcaatcttttcttcttcaggttcattaccctagtccttttagttgttcttcatttgacataatttcattattcactagtgaaccttgctgcccttccccttgataaaccgaatttgtcagtgtcattcaagtataactgacctcacagaacgtgataccacaagcgatgtggtctgattagcacagagttcagtgaatgaatcctacactaggattggatgaaatttacttagccataccacactaacacttatgtgatttttatgtttactatggatagactatttctcctgtgtccacttcttcctcttacacagttgttatttcaaaactgaagtacagattcttacacttaccctcaggagattcatcatgttagtattagtctctcttttcaggctttatgaatgttaattcagctaactcatttttgagctatctgtctcattttgtgccatctgcacagcataagtttgatttctgttgcttttattagtagttttactaaatacataaaagtgaaatagtgaaacacagagtcttgtagcatccactgtgggatcagtcttttagacaagaatgatgcagttgctgagtcaaatgaataaatgaataaatcaaacaatactttgtcctcatttcccatattgatctatcaccatatcctgttaattataattctaaatatttcttgatctatccacttttcccttacttcacctgctactatcccagaccaaacagccatcttctttcactcaaacaattgcagtagccaactgattggtcttcctgcatctgtcctggcttccctatcatccatttgctacacagaaaccatggtcatcttttcaaaatgcaaatctgatgatatcagtctcagctctaatttctttggtggttcacatataaagactgaaatctttaactgaccaataacacacgtgtgatctggcccctgctcacctcttcagccttgtctttcacctgtctcttcattttggccacagggacctcctcgtaccttctctcacgtgccctcctgcctcagcgcctttgcatatgctgttccctttgccgagaactcttcctgtcaactcccaagcccttcacctacttagcacctacctattcaatctgttctgtttgcctcttggtatgttacaaactgtctccaaacttagcagcttagaacaatgaatcctttaccctctctcacaatgtttggggtcaggaatttgagcgggccttggctgatttttctgttcctcatgccatcaattgatatcacctgatgttattaagctgatggatgggctgatctggagatgcactgtccagtttggtagccactggttacctgaaatgcagccagtcctaattgagatgtgctataactataaaacacccacatgattattgaagatttggtgccaccaaaaaatttaaaatattcgttaataatttgtattctgattacatgttgagattataatatttcacatacatcagataacataaaatgtcattaaaattaatgtcacctatttctttttaatttctttaatgtgactactacaagttttcaaattatatctgtggcttgtaattgtggcttgtattgtattctttttttctgagatggagtcttactctgttgcccaggctggagtgcagtggcgagatctctgctcatcgcaagctctgcctcccaggttcaagtgattctcctgcctcagcctcctgagtagctgaaattacaggtgcccgccactatgcccagctaatttttgtatttttagtagagacggggtttccccataatggccaggctggtctcaaactcctgacctcaggtaatctgcccacctcggcctcccaaagtgctgggattacaagcatgagccaccacacctggcctgttttatattcttactggacagtgctgatctagagcaggagtcaagcagttttttctatgaaaggccacatagaaaatgttttcagctttgcaggccatgcagtctccatcatagctgttcaactcttccattgcactgcaaaagcagccatagataataatttacaatagacatagcagtgttccagtacaactattaataaaaataggtggtagccagatttggcctacaggctgtagtttgctgacccctgatctagaagatccaagattttattcatatgtctggtggcttggcagggataggtggaaggctcagctgggaccattgacccaaacagctatacagtcctctccagcatgatggtctcggggtagtgggacatcttacgtggtggctcagaactccagataaggtactcccagagagacaggtagaagctgtgaggcttcttatgaccaagctctcgaagtcccagaatatcccttgtactgtattctatggtcaaacaggtcactcaggctagcccagattcaaagagaggagatccaactctacctcttcatgggaggaggagtagccaaggatatgtgtttctttttaatctattatatcattcttcagatctcagtttaggctggtcctgttatgggctctcaaagtaccatgaacctctcttttgtagcacttgtcatagctagttttacatttctctgtatgattacttgatcactatcttgcttttctactaaactgtaggcaaccacgtgaagaggaactgtttctggttttgctcattatattcctagcaccaaacacaatgcttggttcaataaatatttgtggaagaaacgaatgaatgaatgaaccaatagcaaatgaatgaatgagtaataactgtatcaatattaatcctacatttctccatattgctgtcacgtatatcataagatactctgtcagaagccttgctaaaattcaaatatatttgattcccagtaaccttcttattttgtagttcagaaactttataaagaaggaaataagcctatcttactcttcccagtatctcaaagagggtttctgccctgagctgctcaagagggtttctgccctgagctgctgttcattctgcaaacactgctcgaatacccactgtgtgccaggtacagagagttcttctctgctgtaatctggacaggcaccagcttcccagcgtgggtttaggcttcaggtgcacactactgtgtaccgtctaagccacacctagaagagctctggggaaatatgactacttgggcagaaaaggaaggaactaagaagaggtatctttgtgtctgaggtctgaaggagcgtgtgggctcttgttcaggcaaagggcaggatgaggggaggtggggtggcagcagccagtaatggggtgggacagcggaatgcagaggatgaaacttcaggtcctggtgctctgagaagtaacgctgtgcagcatgtcacacccagaggcaaaccaaggccccagggagctgatgttgcactggagctctactctcctctcagcgagctggtgacgtgccagtccagcaggcctggcttatccaaccacaagtatgaatcggcagaaggcaatgagctgggccctgagtgctgctgggctgaggccgacctaatccttcctccacagagactgtggtgtcccctgctttgctcagggtaagaactcttgtatacctcacaagaagccaaggactacctaccaccttccacactggccctggagcctgcattgtagttatttgtggacactttttcttctctttagtgccaggtgggggaccaaggcctacatgtctttacaacccctcaatctctagaacaagtctgacactgagtagatgtagcaaatgtttgcctgaaagactacctcaataaataaccttctgaggcaccagcaaacttctcagcatttttcctgatactccggttaccactaacattctacacaaagttgtgaaataagtctttttctttgttgctctccaacatctactgtggacccctcctctcacttcctgtttcatcctctctgcactcccctgtcccaccccattactggctgctgccattccacctccctcatcctgccctttgcctgaatgagagcccacatgctccttcagacctcagatacaaagataccccttcttagttccttccttttctgcccaagtagtcatatttccccagagctcttctagatatggcttagatggtccacagtagtgtgcacctgaagcctaaatccacgctgggaagctggtgcctgtccaggttaaagtggagaagtactctctgtacctggcacacagtgggtattcgagcagtgtttgcagaatgaacagcagctcagggcagaaaccctcttgatgcaaagggatactttggggccccttcttctcccaccccagtctgtctctctgagagtcctctcgattccaggagccaccatcacacctggccctaggctgtgctgctcccgtctgtctcagaggctagataacatcagagtcctttccactggctcctgtggcagagcaaaaactggttggcatttttaaacgtgctacaccagtgtgaaagaaacacaggctgcatgggtttaaatctcagctgtaccatttactagctgggcagcctagggcaagtactgtgacctctctgagactccattccttcatctgtaacatggggacaaataatctcaccctgttgtgagcagtaatagtatgattaatcatttagccaactcttattcatgttctctgatgggccagacatacaaagtaagtgaaagtggattacggcaggtgctcttcttggtttctggagtgaacctccatttacatggaggctcctctttttagatttctgactagttcacccaccttattcatagaccttattctgtgcttagctgacagaaatctcctctcagagaatccccccggtaaattcttaggttctttcctcttccattcccctttttgctctctccctccgaaggcaagagtttccactttacaggcccactggagaaagttatggcttctggttgtggttggaggttcattcctgagggagtggggacatttctacacttcttcacggccaatgacattggagaaactggcttcctaacccagcccacaccctcgcacacacacatcacacatcatggctagaatggagagaaattcttcatatggggcacttgtacttcatgaaagaaaatcatatcaatcttgagtattttaacatcctattacagcagggtcactgataaactaagtgtccagagtgttttctaggatggtgtgtggtctccaaattaacattagtgaagcttactggaaggattgttactcctgggccaggccaggattttgaggagagatgtgtttgctgtcaccaaatccttgacagactttggcagaagtgtgttaggcttactctggatagcttcagaggacaaaactagtattgacggaaggaaggtaaggagaagcagcttctaacccaggggaagagagagtttccaaactgagaaatcaaaaatggtactgattccttgtcagggtcagtgcttctccccactgtgtgaattacaggggccatttgtccaagattccttagagcaatactgatttcatgtaattatttgaatgaaaggtgatttgttaaatttatagtaaaatataatttgatttgtgtccctgtttgtcatgccaccccagaagaaaaattgtctttggttaggtcgaacataatggttttttggtttgcaaaccatgagcgattcccatattaggtgggagttcagattcaaagggccctcttttttttttttttttttttgtagtagccagcctaatgagtaggaagttgttctcactgtcattttatattgaatttcttttattttgagtatgaccatcttttcaaatgtatgagatagttatttccagttccacatactatctgtacatttcttttgcccgcttttagtttgggtctttggcctttttcttattgatttatagaagctcttttatacatagaaaattaatactttgtgactagttgcaaatattttcagttgctgaaatacacagtaggtgttccatgtaagagctgaacagctggttcctgattgctgtctccctcccttccagccaatagatttcagagtttgggcattacctattgagccaaagctgacaccacacaagcgcagagtatgggaacagagttctctgtctgattcctgtgagcttcctcatactaaatcaccaacagcaacctacttatcacagaatatgagaattgaacaagtgttggcaaggatgtggagaaattggagctcttgttccagttgtcgatgggaatgtaaagtgatgtcgctgctatggaaaatagtgtagcagttcctcagaaaattaaaaatagaatgaccacatgatctagcaattccccttctgggtatatacccaaaagaactgaaagcagagtcttaaagagatattcatacagccttgttcataccagcattatgcacaatagccaaaaggtggaagcaactcaaatgtccatcaaaaatgaatggataaacaaaatgtagtatgtacatacagtggaatatcatttagtcttagaaagaaaggaaattcaaacacatgctacaatgtggatggcccttgaatacattatactaagtgaaataagccagtcacaaaaagacaaatactgtatgagtttacttataccctaagcagtcaaattcatggaaacagaaggtggaatggtggttggcaagagctgagaggaggagagaaagaagagttattgtttaataggtatagaggcttagttttgcaagatgaaagagttctgaagatggatgtagtgatgactgtacaacaatgtgaatgtatttcataccactgtacactcaaaaggtgaagatggcaaattttatgtgtattatgccacaactaataaagatttctaaaacttatgagatctaatttcaccgtttcctattgctaaagatcacaaattagaaaacacgttggcaaaaggtacatgaaaataagcactcttgtgttgatcagagcataaacgtataatctcataaactaataaagatttctaaataacaaagatttctaaaacttatgagatgtaatttcaccatttcctattgctaaagatcacaaattagaaaacatgttggcaaaaggtacatgaaaataagcactcttgtgttgatcagagcataaacgtataatctcaggggagaacaatttgcaactattcttcaaccctttggtcaaacgattctgcttctaggaatatagcttactcccacctgtgtgatatggcatataatcaaggttttccattgcaacaaaagattggaaacaacgttaagtatccatcactagtggtctggaaatatatatatattattgtcatccaatagaatacaatagactaatatgcaacttttagcatgaggatactcgttacatgctgatacagaataatctccaaggtagtcatatgtgtgcaaaaccgtacatagtatgctaccatttgtacttaaaaataaaaagaaaacagaatatgggtcaatgtttttgtttagttttgtctaaagtaactttaagtagaggcaagaaactggtaacatgtaacagtgatcacccctgttacctctgtggaagaaaactagacagctaagggacaaggctgggaggcagacttgctttccactatttatcacctttatctttcaaatttagtaccatctacatttagtaccatgatctattcaaaaatatttattaaaaaaagaaaaggtatagtctagaaggaaaaaaaacataacagacacttctagcccaatgtcctgcactgggtgctatgagagcagaggaaagaaacacatatggcttctagacaacaccgtctggggcatacatttctgctattcgatcaagaatagttgtgcatcttttcctggaaagaattgatttgtttttatcaacagacctatgaatttagtggacagacctgtgaattaattcactggttaggttttcctttttacattggctgttaaaaagctataagccaaatttatgtccccctcagtgcaaattgggcagatttctagggcaagcatttagcactggccttgtccttggctctgtatcatattcctgtatttggtttgcttttccacctgtttctcatgttggtcatctttcctgtgtatggccataccatcctgaatgtgcctgatcgcatctaatgttggtcacctctccttattctttgcttccttataagccactaagcagcctttttggtgctagttagggtaagtgcgtgggtagtgaaggagggaggagggagaggaagaaagaagatagaggttataaagcaaagcatatcctttttcttggcttcatcatgtagattaagtgaattgctctcaaagcgtggtccttaggccggcagcattgtcatcaccttatgttgttaaacataaaaattcatgggtttcatcccaacttactaagccagactttctgtggttgaggcccaggaaactctccaggtgatttttactcacattcaagtttgagaaccacaggaaaacaaaaggaaggcagatttctaagcgtaaatgcaatactaaccgattgcccccatcatgcctgttatgttggtcaagataaataatactagctactgcaataatcaatccctcaaattttattttttgccaatatcacaatccattgtagatcagttgtgggagaggtgtaaagagagctgctttattagtttattaagcaaaccagatctcttccattgtgagactttgcgattttctaggcccttggacatttcctctggatcccctgctgctaagaaggcaggagagggaggaaagagaagagactttagcagccagatctggaagaaacatcttttctgcccacaattccattggctagaagccagtctcatggcctgtataactgcaggggaggctgggaaatgtgacctatcgatggagctaagagcaaaaggaaatggctttgatgaagccctggcattgtctctgcacacccgagaacccaagtgaatcccaaactccacgtccaggtcatgttttggtgaacatcggttttcagtttccttttctaatcaagttttaccttttttttctcgactctagcactatgggactgagtaacattctctttgtgatggccttcctgctctctggtaagaacctttcagctttgttaagtcctggaatcctactgtctcctgatgagtctgaccacagcaagcccaggcctgagacttggtgggttttactcactttctactgagcattgtacaagaccacatgcaaaaaagactttcctggagaagaaggaagtgttatgattgagagcagctgatggcaggcagctgggatggagctctcccccccgtgtgcttcttcctcctctgcagtctcacatcagtgagcctagatgctcagagtagggtagcctggcccatcccatggggatgggggaaggctgctgcactgaggcccctgagacttgactcttttgttccacacatattctcttctggtcttctctgaccctgtttctgtctttctcaggctcctaggaaacaactgacagaattccaaaagtctcccttcattcggagcactggctttcacgtccctgacttccctaccctctctcactcccttccctacagcccatgcacatacctcatggttgccacggcttcctgacaactatggatgttcagctaattgtgtcagctgatttatagtggagccaatgaagctgaagcttcagagccctccatttgcacaaccctttctaaatccccctcaagaccctgtgaagggccccctagcagtgtggtcacctgtcttatgctttggtaaaatttgaataagtaagatattgtaaccacaataagttatgaccactgtctccttcctctgcaacttttccctccatgccattctcctgtctggtggtgttagcagtcaggggcattttgtatttgaattctacattctttttcttaactatccaccacctcccctcaaaattttaacagcatccagcctcacaaaactcagatcttccctgtttacagttccactttgagtttcagtttcttcatctataaacaggagttggctgcggtccctgccatgtatcctgtgactcagtgtctcgtagttactcctggcccaccccttcctgctgctccttgtctccacctgcaggcctgagagggaagccaccccactaagacagggaggtgaactgagcctgaagtttggctacagcacccacaggccaccagccatgagttcacctcctccagatggccacacaccaggcccttggccactgtccccatgtctgctgtggatgatgaggagtcagggaactacaaagagatggtccctcagatccatgctggctgggataagccttttcagatttctgtttttctgcttagcaccttgagcttgtggagtccttgagtgcaaggtctgtagatgtgccagctgatcactgacttaggtaacaacagcagcttccaacccccagggcccatgacctgctaccttagctcctggggatgtgggaggtatgtgtgtgtcagagagcaaggcaagaagactctagagaacattatccagtaagattcccttctcatcccacttcttatttatttattttatttattttattttttgagacagcatctttctctgtcacccaggctggagtacagtggcacagtcacagctcactgtggcctcgattacctgggctcaagcaattctcccacctcagcctccccaagtgctagaattatatgcatgagccatcgcacatgacttattttatttatttgataaatgcatatatacacacagtcatgaatcgtttaacaacaggggtacgttctgagaaacacattattaggcgattttgtcattgtataatcatcatagggtgtccttacacaaaactagatagcatagcctgctccatacttaggctacctggcacagcctattgctcctaggctacaagcctgcacagcatgttactgtgctgaatactgtaggtgttgtaacacaatggtatgtatttttgtatctgaacatatctaagcatagaaaagatacagtaaaaatatggtgttataatcttatgggaccaccattgtatatgactgaaatgtggctgtgcaatacatgacagtatatgcatatatatatatatcccttactttgtgcctggtactgttctaagtacctcataaatattaactcatttgagcctcacaataactttctgctttaggtcttgttgttatttcccattttaagatgtggacactaaagcccagagaggtgaagtaatttacccaagatcgacagagctactaagtggcagagcttggattcacacccagcaatgtagatttagcattcgttcacttgactcttctcctaactcttgtggtaaaccatgaataagtggtaagacttcttccatggggcctgaacagctttggtggataatatagcttctgcctcatccgtgttcatccagtgcctcctccccatcacctgcagctgacacctcagttgacccaagagcttgggcccaagcccttctcatcaaagtgaccagcccagctctcaagatctgggagagaaggaagaaaaatgccctggaaacacatttccagaaaacactaaactggaacaccatttcccaccaaattttctgactccgcacactgaaagtgagaaagtaaagccgagacactctatgaaaactgagttcaggtgtcacttttgcccttgatttgccattgacacttcttagaagtttcttagctcctgagaaaagagttaccaatattgaaagcaacaacctcaaatggtaaccgtttaagttttatggtggtgagagaataagtgactatatttttggcagtacaattttaaagtggaatagaaagcccatgacatcagatcagaaaataacattgccagtaattcacacacgatgaaaagcaacaaaaaatcagattctatttgaattctttcttctcagggcacacctctgcttactgggctggtgaacagtgacctagccacagggccggcttccaaagggagaaaggagatgcaattggcccacataatccaccctcaaaatgtagagctgaataattcatttcatggcatagaaatagcaatacagtgaagcaattctgtttaacttttccctcccttatattttgtgtcctctgtcatggaaatttgacacagtagtatttgctgcccctgctcttgaggataaaattggatgggagtttaagactgaaacgggcacctgtggccttgcagaattaggttacagtttgtgccttgtatttacaaagcgaaaggaattcctagtgccacctgcagaggcacttctaactttcaagctctgtttgccactgtcctggcacctccatcacacttttaggctggagccagagaggtttttgaaaaatcagtagctcccacatcaggaggaagtatctttccagtttgagttttggtagctgctctctttttgtctgagggttctctgggtcctagggctttctcatttctcttgaacaacacctctagttaatttcatgtacctggagtggtagttggaatatttcttcactttaagatttttttttttttttttgagatggagtctcactctgttgcccaggctaaagtgcaatggcatgatcttggctcacggcaacccccgcctcccaggttcaagtgattctcttgcctcagcctcccaagtagctgggattacacctaccaccacaaaatacaaaaatacacaaataatttttgtatttttggtagagacggggtttcaccatgttggccatgctagtctcgaactcctgacctcaggtgatctgcccgcctcgacctcccaaagtgctgggattacagacaggcatgagccactgcgcccggcccaccttaagatttatgtaagattggctcaaaagctcattcctgtggaaaggtccactgttttcctcccaagatttttgcagatatctgcgtgggtggttacttttgactcccatttcctgctgttgttgatagccctcattaaaaccatcacctggaggtgaatagacagtcgagacctatcattcccaaagaattgtcatggagcctaatagttctattggattcacccctttatgttaagccaccatttcagtgtttttcaaaatagatatatgttatctagtagggagtatcttacccccaaattagttgattgtttcaggagggcttttagtgggttccagagaaaatgagcaatcagacaagttgatttagtggaagacagtcactgaataggatgtgtatagggttgtttgggagcaagagtgaaattggtatggaacagagaggctcccaaggcaagcagacattttttttggaagaagcaagtgtttgagagactgtggcttatttttcctttgtgagaggggagttttaataccatttccaaaatatgtaacctggtattttgtccccagaagtactgttgagatttatggaagcaaaaaactctgtcacccaggctagaggagtgcagtggtgctatcaaagcttactgcagcctctaattcccaggctcaagagatgtttctgcctcagccacctgaatagctggcactataagtacatgccaccatgcctggctagttttttttgttgttgttttgttttgctttagagacggggtctcgctttgtgcccaggctggtcttgaactccttttaagtgattatctcttctcagcttcttaaagtcctgggattataggcatggcctatctatttttatgttttataatttcttgtactttttgatgttacttcaaatatctttttaagtatcctaaatatacttatttaaattttttttgagtaaatttatctataaattattgattttatgtcgatagacattgttctctatcattaataatgttaaaaataaataaaaaaacaaaaacaagtaaatcaattaatgcttaccacaggccagtatttgatccaacactaactcaaatattcatttctttaatcctcacaacaaacctatgaggtaggtaccattattgttcctgctttttgcaagaggaaactgagacacagggaagttaagtaatttgcctatggtaacacaggcagtgagtagttgagctgagattgaactcacgctgtccagaatccatactattagttataatagtgtactgccctatagctttctgtttcacagctacatggcattactttgtatggatgtatcattatttgttaaaccatttaacttatttccagtgtattgttcttataaacaatgaatacctgtgtacctctaattttgtgcacatgtatctttttgtagaatgaattcttaagaaattgagttgctaagtcaatgcttaagcccataattaattttcttacatattaccaactgtcctccaaaaaggttgtaccaatttagaattttaccagcagtaaattcagcagttaggacccattttcctaacactctcgcggacactgggtattaccagtattttttttaatacgtgccaatcaaatgggcaaaaagaatggtttctcactgaggtttaaattgcatttccctagttattcttgagatttttcctttcctttcttcaacaattacttattgagtgcttcatatttgtaagggacaattgcaggtactggaaatgtcacagtgaggaaaagtgacaaagcccctgctgtcatggagcttattctaatgggagatgtcaggtgctcagctgagctgggagagagagagctgagttgtcaggtgtcagaggagccaattatagcagcaaaacaaaaataaaatagttcagcttttaatctcttactacgacggtataatcaagaggctaaaatgggaggaagggcagactctgcctgttccatttccccacatagagtgagtataccagtcgagggtcaggtaatcagtgcagacttagggggtcgccttaccattgaagaagccccaaatgaaaggctctagcagttttatggacctgggggtggaggaatccaagggtggggagaattcatgaggaaaatgaggtgagagggctaggagtggaaaagtacaaagtactgagttagcgtggggaatagtgtctttagggctaggagtggaaaaaatactaggtactgagtcagagtggaaaacagtgtcttcaaggcagggagtggaaaagtgctaggtactgagtccgagtggagaaaagtgtcttctctatgatgaggaggcttcagcagaggtgcctgaagacctcaccccagagcctcagataaagagacctaagaatgagggtgcctgggctaagattgcaagtatgtgaaaaagcatgactggcgggaggctgagatcttgattgcagcccccttcagagactgccatgcactgactgtgcaccaagtctgctgtagaaagggcaacttcctcagcaaggcttgtcagattaagcctctttaattgcctgtggtcaggtctgaaaaatcacacatagatttttaatcagaacccagacatctcaggagagacagacaataaccaaacataccgtgtcatgtcatgtcatgataagtaccacaataaatataagtcagcatgagggacagaatgcccaggatgctatcttcaatagaatggttagagaaatctccctgggaggtagcatttaatgaaagacctacatgaagtgaaggagaagctatgagactgtctggaggaagaaccttctggacagagggaacaacatgagaagaggacttgagacagagtgtgtgatcttttggaggaatgtcaagggaggcagtgtggctggggagagtaagcaggggaaagaggcctgataggtactggggacccaattacatgaggtcttgtaaggccaggggaaggactttggatgtagttctcagtgtgaggggaagggatctggatatatttttcagtttggtggaaggcatcagaggcttctgaacaggaggattatgtgattggagctgtatttttaagggatcattttggcttgagaaactagacccggggacaaggacggagcaggcagatgagttaggagacaattacattagtctcctctacccttttcttaacatattggagttcagctctggctgtagtagttctagatctcctcagacacacttgtgtagagcctctgttgggtattttgggtacacaaatgattcatcttggttatacagatgatttagatgattgtagacagaagagggttgtctggtcattcccagacaggggagcattccttgagatagagtagaggaaggctgaaggggaggaagacagtacctgttgctatctagatagagacatccagcaggaagttgaatacaggtatctgaaactctagtgaaagttataggctggcaataagcacctgggagttattagcttttacttgacagttgaatccgtggggctagaggagaaaaaccaggaaagtatggagaataagaagaccaagaacatgcactcaaggttaccaaaattaaagagtgatttgagaaaattaacaaggaaatcagagattgggaaagaatagagcatttcaatgaggagagatgccaacacttgcatttgacacagcggtcaaatgagttgagatctgaaaagagctcaagccttggccatggtgtgaagtcaccaacaacctttgtcagggagtttcagtagagaggtgggggtgggaggctgggaataaaggcagcaattgctgcttactctttcagggagtttgactccaagggaaagagaaactaaaagcagtagcacaaggtttgtgtttgaagtaatggaggtgaaccaggtgaatagcctggaggccgagtgaagtgagacaggacactgcagatttggaatgtcaccagtccgcacaactgaataatttcctccagaactgctcaattgcccagttgtaagaacagatatgtagaccaaaagtagagtgtccccagggtaaattttatagagacaaaggggtgtgtttattgaagttgtggaaaggaataattacaaagacatactattgttgcattgtccaatataataaccactagccatatgtgactacttaaatttcaattaattaaaattaaataagattaaaaattcatcttctcagtcatactagctatgtatcaattgctcaatagccacaggggctggtggctatcatattgttcagcacagagacagagcatttccattatcactaagagttcttgtggaaaacactgcactacagggtctggataaagctgaggtcttgattaagttgaacaacagttgtagaaggagtaagcaagagcaaaacctggatgaataggaggttgtggacggagattagtatattgagattaagattctagggactgagctgctccaggtgaaaagtttcagggttatgtcataagaaggtggggggcagctgctgaaatagtctgcgggtgtagacctgtggagttgacaagatcaaagaaatttgaggcaaggttgttagactcattcatgaagaagtcacccaaattgttagcaagaccttgcatctaatgccaaaatcctcatttagcaaggtggtagtgacttagtagctacaagcaatgagaaagtcagacacctcaaaaggggaaggtgttgctcaaagtccccacaaagtgtgataaaacaaacagtagctggggctggagcaagtggcttcctttgggtgaagccagatttcactgaaataataacctcagggaaacagtcaatgaaggggttaaagatgtgggagagtttccttgtagtaagtaatggaatgaggctttcaaagggccaagtaaaactttggaggaagtttagtaaaagaaggaattttttttagtacagataagcataggaacataaagaagagataattcttaaacatataagatatgcatttggggatagcagccagggaacactgaagtcccagtggggtcagagacttcataaggctagcaaattacagtttttgagtggcattccaacagtagagtgtattgctcaggaagtccttaattatcctttgaaacaaattccttcagctgattacgaaggcatctagctggattcttgagcgacttgttcctgacatcatagcaacccattgtaactagacttcgaccattcctcttacccaagtgctggggaagggagagattctcaatgcttacccacctatggaatcccagtaagtccagttgctaggtggcttgaggtctggggtcataaaatggaaggcctgaagtcatttggtgatcacagaccttgagccaaactttccccatttagtcagagaaaggattagcagcatcccccatgcctggctctgtgtgagatcatggaagccagtggttggtgaggtgctatggagtataaattgcaaaatactttcagttccactcagaatggatttcaaagtgatttccaccccatggggaggagagggagtctgaggagggatggatggaaaaaaaattttcatgtcattttctgtgatccactctggagacagaggcagagattctctacaacagctgctcaaactatagctcttgttaaaatggaggttctgaatcagtaagtcttgggtggggccagagattccgtgtttcagaccagcccacatgtgacgtgaatctcattggtccatacatcacactttcagttgctaggtgaagaagggagcactcgatgagtggaagagaaagccgttgtaatctttgggagaaggggcctgggtcagcggagttagactggtctgtgagtggacagaatggatgggaaggaaagaagatactgtgaggctctacagaaaaaaaaaaaaaaaaaaaaatatatatatatatatatatatatatgtaaatcaagaagacagaagcagctaaagacgaagtcatttccaggtccagaaggcacaactgacagctgagtaataacataacattgactgttaattggcagaatttttaactgtgtgtttggtttctccatcaggtcatctgtcctatattacatgacaatttagactaaaaccagtatttcctcagagacaatgctagaagcttttacagtagggggcactcttgcattacattaagagctcagcaaagaagatgcagaagcctcaggtttgccttgtaaggtgattcataaacacactaaatcttccttaggtctccctttcactgtcagggtacgcatatagattttccttcctccctccaataccggtacgcatcctctacaggtggtgcattttatacctcaagtacttcacagggtcctagtgagtgtagtgaaataggcagtgattcatatttgtgcaaactcccactgatgcctgctgtctgcttccctaagagttcaagaccaccaccaaccccttgattatgtgttctcactgggccactctgtacacagtttagtttgacaagtgcatgtcactgttatctgtccttctattccctctttcaagagaaaccacatcaatttaattactcccccacttagaactcttcaaatgaagctcctctcatctctctcatcaacccatctcctccctttcctcctcaatgtcaacatgccttcacataaatcctgaatgatgaaattttatttagaacttacactaacttcctctccaaggtggcatctaacttcatattaagtaagaaacagccttcccactctccacccccgcacttctcacccaccactgcttactttttttttttttttttttttttttttgccaagtctcaagtaattctgtaacctagaaaaggtcctacacaaaccccgtgatcattcacatttaagtagttgggtggcccacatccttcccacaaaccccaaagtgtcctcaaggactaaagcctttctctcaacccttccagcatgatgtctatggttgtaaaattgtccagggtcagtgcatactgggagcagcaagtttgtggtgcctggggtttccccaatactcccaaagcacatcctcacctgcccatctatgattcattttcagcatttcactcatgtgccttaaatggtcattgaccaccacaatccgaaaacagccatcaaatttgcccagttctctttctgatctctgaaagagcttagagaggtcactgaaaataaaggccttggttcactatcgaagtcatttctaaagcatttgacatccttggaagtgctggccatgggagcagcagtcataggggaagttctgtaaagggagctatttgaatttcaaagatgttactcaacgtgattccccaactaatgaagtataataaaggggggctataatttattaccattatcagcaatcttttcaccatagcagaccaaggaatatgtggatgggaggggaggggaaagcttttggtgatggtgtagaagttatggaacctgtaacagctacagtgatgaaaactaaaattaaggttataggaaggtaactggtgggtgaatgggttgtctaactctactggtttttccctgtcttgcaatttaaattcacagaaccacagtactagaaagacccttggaacatttagtcaaccacttcattaatcagatgaggaaactgaggctcataaagattgcagtttgtacaaggccacacatttagtcagcggtgaagcaaggacaaaggtcctaatctccagatgccaagcagatgtgcacagttccagagcttaatatcttattcttcagcatgattactgataagatagtatctgggtattgtataaagagaaatggaggttttttcccctttcctcttgtttctccctccctaatccttaaccttcttttttaggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttggtatgtggtcaatggtgtgtgttcagattcttagccttctcagatgagactgcaaatgagttagaaaaacactggagggggacttgaggggcccaggggaaaaggggggtctatagagagaaggcagaggacagccacttctgggaagtgcatttgaagggagtgtagagtctgggagtagggaactgaaagtcttttgtactttttatagtctgcttctgaaggatcagtaaaaatctgctttggggaaaaaatagagctaattgaacaaagataatatggctaattacctatagtaaaaaccatggataatttggccatcacaaagtttatataaccataaaggcctcagatgtcttacattcattttttccttgggtccaagatttttcacctactaaatctttgcctggagctcctagcaaagcggacagctgacacatttgggttttcccttcagcctcctctaggttgcttatgagttgtttgctgccacaaccatgagcctggtagacagaagggaaaaaaacccaacaaacataacccacaaacttacaaaccagctcctctgcttcacgagaccttggaaggcctaaatgccactacagatttttttaaaactatcacacagtaaaattatttttttttgttttgatatactgttctactgattgtatagatcttgtatagatttaggtaaccgccacaggacatagagcatttctatcaccctaaaaatttccctcaggctgtcccttcatagagtcataccctgtctgcactcataacccttgttgggcatcctatagttttgtctttttgacagtgtcacataagtgaagccacacagtatgtaaccttttaagcctggcttctttcgtttagcgcgccttcgagattcacccaagttgttgcacatatcgagcttgtccctttttattgctgagtagcattttattgtttatccattcaactcagtaaaagacattgggttgtttctggtttggggctcttatgaataaggctgctgtaaacgttcatgtacaggtttttgtgtgaacataagttctcagttctctagaggaaatacccaggtgtggtattactggatccaggttaatttttgatgaaacttgaaaaggcagatcaacacctattctaaaaccatagagtaaaacagaagcaaaagtaaaaatagaatggagagctgctccctttgaaccctgtgtgatttaaactaggctgcagggctttaggaatagttaaccaagtgctaaatccgtgttttcaaaatgtggtcaggtaccattggaaatgttttaggtgggacacagataagcattttgaaaagccatgttgtatttgttttaatgtatattagaaaaactctaacttacgcaacatgtgatttcacagatcttgttaatgaagctaaacacggtctggcaattcaccttctacaggccacatagagtccaagaagagtgctcaaatagtacactgatatagcaaaacttataaagatgacatgcaaatgacagaccttttagtaagaatacactaaattataaattagtttgtagaacctgcaaactacctagtaactataaaagaacaagggattttttctgacagaaggcacatgacacaggtctagggactccatgccagtgatcctgaacagccagaaaagtgagaatggcaaaggcaagagaaacactgtgtttattaagatcatgtatttttccctaaaatagctggatttggccttcttcttagagtatgttatgaagacactttgatgctcatgccaaaaatcagtgttctgaatttcgaattccaaaatatccacccactcacttaccacaatcctgcttgggtttctgaaagatatgacgcagggcatctcagcaccatgaactctgtcagttcctggtgagactccagctcaattccttcctgctctcttagtctggggagctggaatgtgccccatgggacacctgggccctagagtcagaccacttctccttccaaagactctactccctggaaacagtggcttcattgtaaatctttggtgactcaattacagccctcctgtcacttagagagcacccctttgatttggataagcaggaagtaagcatggctgcaaactctattgttgaaaaataaacatgaagtcattatgtggcactcaccttgggctgagggtcacattttagacaccctgaggctcccaggtgtgccccaatgagccccagatcaagtacccagttatttgctattccctcctagatacatctaaacttagattgatttttttttatctctcttctgctttcagctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtattatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctataggtaaagctgttttccaagactatttctttcagcaggtattatacacaaatgcttaaggcagatcatccaatgtccccgacttgctaggaaacctccaactgggccattttatgacgctgttaggaaggacccagatggaggtctcctgcttctcctgagtgatgcagggtccaggaggctacgagcctatgttgcacttgaagaaatatgcttttagccctgaaactgactcagtctcttggtttacctttggatggaggattctgaagttttgatttaaaaatacaggattcctccaggctagaattctttctttgattacaacacatacatgcgcttgcacacacacacacacacacacacacacacacacacacacaccatgcatacatgcagacatacaaatgatatttattgtgagtatagaaccatttgggacattattggtcacaggagtgaaaacaaaaagatatgacaccccctctgcccttgaggaccttccaatagaatcagaaccctgtaatgtgcacacatgaaaaactggatttttaaaaggttgaattggaatctaaattttattccatggaaatatctgactaaatttaaaataaaagtgactggtaatgagatttatgggcattcagaggtaggcaagatccctgagggtcagggaatggttcctaaaggaaggggtaccttgtaacatgtaaaataaattattggggttaataaatgtggtgaggaggggagggcattctggatgacaggttcccaaaactgtggtgacttccgtagctgaaaaaatttgagacagtatctgggctaagcaggtgagaggaccacagtggatcagctgtatctgacgtaagtgcaggaggtatgtcaaagaaagccttggaggcagaaatgcttgtgtgttcacaagtattcttcagggacaagttcagtggaggaaaggattgaaactaagcagtagccactaataggagcctgacattttaaagtcctggctttacccaggagggcatgtgtctatatttgactcctcttttaagaagctgtaactgcaagattccctcctggaataaaggtggtctgcatctaccctgtcccatcactgcctgtgctgaccttgacacccacatctgccttcttcttaccttgaccccttctccagcgatgatttcttggcttgccccctccagtgacatccatccaactccttgctccataccctggctttgtcacctcctttctcccagtgtcttgttgttcagatataacttggtctgtgaacagcccacggggccagtccccatgaaccaactttacaactgggccaatctcatctcctgctactgacttcttcctattcagacacttcagcctctgagaatccagtaaatggtggagccaactcgtcctgtcccagttgcttctcctgtatcctctcttggccagatagaagcctctccaagctatgcctgaagttcagtacctccttcaatgtgtaattagtttgattggtggccacaagatggccatatatgacatgccccagggccctctgttacggctcccatagtctacaaattaacaggggcttgccaccactataacctcatcatggctcaccttcctgctgcttctcaactactgttctgccaaacttcaacaggtacccccatcttcagaaatgtttcagctctagctgcctcaggaagatggggcttgcctctctgggtttcccattctatcgcttgatcagagataggttagaccctgagtcaaggggccttttttgcatgttaaaaggtagcagcctccacgttagtaagtataacccctaaccccctttactgggagtgccaaactggctcaagtggaatagactgggacagactcaaaagggattaaatatggcctgcaatgccaacaacttcttaacatcccagaaacagggcatgtgtctacaaattatagctaagctaatagatcagctggtcctaattttcctgaaatttgggattagctaccagaactgttcccaaaaatgtctttaaagtgggcgactccgttctaagttttccccacaaagcctgttttccaactccccagaaacttaggagttctcatgtaaggaagtagttcctgaaggcgtgaaggttcctcaaggcatgaagaaacatcaaaggtttttcagtagatgagatatgctgaaagccatgcagaggaaacctgctgtgacctcagtaggaaaaaactaaacaaacaagcaaatgaaaactagaggtaggggcctgtggaagctgttccatttgtccaagtgagaggtgtctggagattatagtggacagaagaatcatcacgagaggaacttcagggcttgggaactgactgcagaggggggcaggatagcaggcacggcacaaatgactgcacgtgcagagcctcagcacagacacctcacccagattccagaatcacgggccaggctgaccctcttcttcctgatcatggtcggtgttatccccacctccatgaaggcatggcagctcagtccaggcatttggccagaggcatgggctcgattcttaggtcgctgctgaggccctgagcctgggactttctatggcctcctattgtggatttcaggcttctctggccttagagccctggggagaggctggcaggtaaataaagagaagagcagctagcagaaaccttttgtaaatgactctcctggctgattgaaaatttgtggtcatttgtagagcttgaggaccctcagcctcccccagaccacattccttggattacagctgtacttccaacagttattatatgtgtgatggttttctgtctaattctatggaaatggaagaagaagaagcggcctcgcaactcttataaatgtggtgagtgagtccttgtcctccccacagactgtcactttgcacctacttcccaatcggctggctgccttccggagcttgttggctgagcctagactggcaaaaagtcaggaagttgttgggaaaaaaggttttcccttggagttttgagcctatacagactggcagtagcagataatgctgctcttggacttcaaagaaaggcgacatttctaacctctggtttacaaatgtacttctggtttccagggaaaactgattattacttgctttatctacctcacttcatgaggttactgtgacatatacataaagtaaaatggtgaaaccactcctaaatgttaaagattgtggacctggtggtgtttaagcagggatatttgctaaatgaccacaagaatcagcttctcgtctctaaaaaaatctaggtttcttatgaaataagttagatgaattattgcccattgacttataacaaacaatattaactttaactaatttctaagtaatacatatccattatcatatataccaaaaataaaatcatctataactccactaataagaaaaaatgattacacaaacatttttggtgcctatctttaagatttttctgtgtatcaatctatgttgttttccataattaggattatcataagggttatttttcacaatttggataatatatgtactgtgttctaattttgttatactaaatgtagcaagacaattttcaatgtcataaatatcattctacagcatcattttaaatggctgcaagatattcccttttgtggatacaccataatttatttatttaaccaacctcattttttggacacttgagttagtccaatagttttgttattataaacaccctccccactgacttctgttataaaaatgtttcatggggacaaagtggtccctaactttataataatgccatgcctttttgtagtttggtctggttctaagctaagattggactttatctcagtaattgcctccagtagtaattagtttgattggtgctaataattaaggtaaccttctaactcacttatggtagaaagcacaagatgagtattgcctctggccagcatcttgtttttcagtatactgattttaaaatctaactagaaaatagatggatgacattagcagtcattcaatgcatcctgctgtactttaaaaataagaaattggggagcaacgatcgaatttaaataaattaacacaaagcatgtggcagagccattcaaactgccaatgtatggagtgtgctgcgagatttctatgatataaaagtataaaattcctagcacagatgtaaagacatatcatgcttgtccaggctttgacttttcaaggtgagagttttgagcttcactttctttcaacctcattgccatttaaaattagtcaaatatgaagaagtgacttacatcttgggaataagctgtttgctagatttttcttcacattagaatgatcagcttacaaatgaaacaaagaagggttggagaaaaagattaaggatgtttcttcctccatgaggcaatcagaaaaaaatcaggagactagataggggagataaagaggatatgtgtgttcacatgagagaagttagaaggtggttaaataagctctgtaggtacagatgagatggtcagattgggctgagtggcacatacatgacccctaagaatgtaatgaagaatattggtaagaaaaagttatttattcagacagtcatccatgccactgagtttgatcaaagagagaagccttgctatcactgtagggagggaggtgcaacaggtataactatgccattatagatatgatatatttgtaaatttggattctgtaacttcagcaatatctgccattgctttgtgggtactcctggcattggctatgtgataggtaaaataatgccccccacaagacgtccacctcctatactccagaacctgtaatatgttatcttacatggcaaaaggaacttcacataggtgattaaggcaccaagcttgagatggtgagattaacctggattatccaggtgggcccaatgtaatcacatgagtcagagaacctttcctagctgggatggagaaatgaactggaagaaggagagatctgaaacttgagaagctcaacccagcatttctagctttgaagatggaaggaggaagccatgagccaaggaatgtaagtagcttctagaagctggaagtggctctcagttgacagccagccattaaggaaattaggatctcagttctgcaactataaggagctgaattctgccaagagaccaatgtggaaacagcagatccctccacagagacacaagcttactgataactggtaggaatttctccaaaagtggagcttcctcctactccagtgttaatccctttctcagaggagacggtcctcaaactaactaacttggcaccaaaagtcctatccagtgttttctcattatagtttttctatgcctcaactgtatatatttacccagtttaggctgtttaaatgaataaaaaggaaatgccatagttattctagccagtttccaatctctcttctctttttttgttttgtcaaatagggcagataaggcatgagaatttataactatgaattactgtcttttcccaaacagaaatcaccctatcagcttacccattgggagaaaaactaaaatagctccccctgaaattttacttcctcatttgggtcttgtgtgactgaaatctgtatacaatgccctagcaacaacggtttttacagcttgcctccctagaacaaacctaggagtctcagctgtttcaggaatgatttcttaaaggtaaagtgcctttttcaaaagaaattattattatttttttttaattttttttttgtgtgtgtgtgagacagagcctcactctgtcaccaggctggagtgcagtggcacgatctcagcacactgcaacctctgcctcccaggttcaagcgattctcctgcctcagcctcccaagtagctgggactacaggcacgtgccaccaagcccaggtaatttttgtattttcagtagagatgggttttcaccatgttggccaggatggtctcgatctcttgacctcgtgatccgtttttaaccaacatttaaacagaaatattcacaggcttaaagactgaaagttagtgatatcatcacatttccccttcaaaatgctgaatttataagcaaatttaaaagtttagaatctaccttttaattgtctgctttcatttttttgacagtggctttttttgatatggtgactattttgtcatgggtataaaaggataattcattttgtgttaatctgaagacatctgaaatactgtattcaactataagtacctttttttacatttataagattctttttcaaaatttttatttgaatagttttttgggaactactgaactaaactaggtggtttttggttacatggataagttatttagtggtgatttctgagactttggtgccacctgtcactcgagcagtgtacactgcaccagtgtgtagtcttttatctctcacccctcccactctttcctctgagtccccaaagtccattatattattcttatgtctttgcatcctcatagtttagctcccacttatcagtgaaaacatacaatatttgtttctccattcttgagttacttcacttagaataatggtctctggttccatcaaagttgctgcaaatgccattattttgtttctttttatggctgagtaatattccatgagggatatttaccacattttccttatccactcatgggttgatggacatttaggttggttccttatttttggaattgcaaattgtgctgctataaacatgcgtgtgcatgtgtctttttcatataatgaattattttcctttgggtatatacccagtagtaggattgctgaattaaatagtagagttctacttttagttctttaaggaatctccatactgttttccatagtgtttgtactagtttacattcccaccagcagtgtaaacatgttcccttttcaccacatccatgccaacatctattattttttgattttttaataatggccattcttgcaggagtaaggtggtatctcatggtggttttaatttgcatttccctgatagttagtgatattgaactttttttcatgtttgttggccatttgtatattttcttttcagaattgtctattcatgtccttataaacaccattatttttaagaagaaactttacaaaaatagaacataaccagatttataaagcatctgggaactcagtcaattaagaaatagctcaagtaactgatgatgcttcacctgaaagaaggcctggagagaacagagatactgtcttcaaatatctgaagagctaccatgggatgcaaagattgagcttgatggtatgactctgaagggcatctctatgaatgaaggttatgagagggtataaggaattaagagagacttttctaacaattaaaaggtcttttaggccaggggtggtggctcacacctgtaatcccagcacttttggaggctgaggcaggcagatcaccttagatcaggagttcgagacccgcctggccaacatggtgaaaccccatttctactaaacatacaaaaattagctgggtgtggtggcaggcacctgtaatcccagctacttgggaggctgagagaggagaatcgcttgaacctgggaggcagaggttgcagtgagccaagatcacaccactgcactccagcctgggtgacagaagatcaagattccgtcttaaaaaatataaataaataaataaataaataaatagtctttaaaattgtatagaagaagtagacttctgcttcctccaacaaaggattaactgctataggaattgccctctttccataaacaactagaaagcagacaaaatatatgaaacaactgttttcagagatcggatgacagacagcagaaaactgtagtccctgagtgaaggaaagaaaaaatgagataagccctatgattgctctagtttgctgcctggagccagtgtccaggcccctctgaaggcaggggagccctgatactgaactaggaaaagacattgcaagaaaagaaaactacaaacatctctcgtgaaatgcttaacaaaattagcaactaaaatctagcaatatgttaaaagtataatacatcatgatcaagtggggtttattcaagaaacacaggtaagctcaacattcaaaaatcaggcaataacctttactacataaataaactaaaaagaaaaaaacatatgatcatgtcaatggatacaggaaaaacttttgacaaaattaatacccattcatagttttaaatggaaagaaaagctctcataaaaataggaatacaagatgacttcctcaacctgacaaaggacatctaccaaaaattcttctgttagcataatatttcatgatagaagactgattgcttttaccttaagatggcgaatgtggggaggatgtctactctctctacttttgttccacattgtactggaggtcatagccagagaaacaagactagaaaaagaaataaaagacatacagattggaaaggaagtaaaactgtcttttttcacagataatgatcatgcttgtagaaaatcctgaggaatctatcaaaaacctattaaaactgataagtgagtgtagcaaagacacaggatacaaagtcaatacacaaaatcaattatttctatatactaacaaaagcaattgtacattgaaaaaaattaatagcatttataatagcatcaaataatattaaaaacttggaaataaatttaacaaaacaagtacaaggtctatatactgaaaactatacaatattactactggagaaattaaagtaaaccaaaataaatggagacataggccatgtttatgaatcagaagactagatgttaagataaccattctctccaagttgatctatggattaaatgtaatcacaatcaaaatcctggtaagctctctaatagatactaaaaatcttactcgaaaagttatagggaaatgcaaagaatctacaattgccaaaacaattctgaaaaataagaacaaaggttaaaaatacaaaattagccaggcatggtggcgcatgcctgtaatcccagctactctggaggctgaggcaggagaattgcttgaacccgggaggcagaggttgctgtgagctgagatcgtgccattgcactccagcctgggcaacaagagtgaaactccctctcaaaaaaaaaaaaaaaaaaaaaaaaaaagaccaaaggtggacttaacctacctaatttcaatatttactatatatagtaattaatacagtgtgatattggtaaaaggacagacatatcagtcaatggaacaaaatagagagtcaaaaatagattcacactgttgacaaagctaccaaggtaattccatgcagaaaggatagtattttcaacaaatagtgttgggacaattagatatccacatggaaaaagtatgaacctagacacacacaaagtaacttatatattaagaattaaaatgaaaggacttccaaaagaaaacagaggagaaaatctttgtaaccttaagttaggcaagtcttcttagataggacacagaaagcaaaaaccatatcataaaaagataaaatggatgtcatcaatatggaaaacttttgttctttgactttgtttaaaaaacgaaaagtcaaaccacagacagggagaaaacgtttgcaaaatatatatctgataaaggacttgtatccagtatataattacatattgctactcattagtaagaagacaatccatttaataaaaggcaagaagaagagacttgaacagatacataacagaagaagatatacagatggccgatgagcacagtcacaacatcattagtcatcagggaagtacaaattaaaacgataatgagataccactgcacaccctctagaatggctaaaattaaaaggtctgataaacatcaagtgttggagaggatatgaagcaactgaaactctcatatactgctatacaacccagaaatcctagacatttaccaaacagaaattttaaaaaatttaaaaatatataaagactcatacacaaatgttcatagcagcttgcttcataataccaaacctggcattctaaattttcatcagttggcggtggtatatttatacaatgaaatactgcaaagctatagaaaggaatggactactaataatacacaagaacatagataaatttcaaaagcattatgctaagtgaaacaatccaggcacaagaagaatacacattatacaatttcatgtatatgaaatttgagaaaaagcaaaactattttaagtagattcatggttatccatgggatgggggaaaggaatcagctgaaaagcgaactattttggcttataaaaatgttctcgatcttgattgtggtggtggttacgtgactatatatattcgttaaaatcaccaaactctaaactgaaaatgattgggttttattatttattaattatacctccataaagctgattgtttttatcttttatttttattttatttcaatagtttttggggaacagatggttttcggttacatggatgagttctttagtggtgatttctgagattttgatgcacctgtcacccgagcaatgtccactgtacccaatgtgtagtcttttatccttcatccacctctctctcactcttccccccaagtacccaagtccattatatcattcttatgactttgtggcctcataaaagctgattgtttttaaatacacacatacacacataaaagagaacttccagtgacaggaagtgttcaagaatgctctatttagtaaagacagaatcacaaaaccatcagaggtattgttgagtggattcttgtggtctataaatacctccatggacacccaggttagcaacctgttggagtttacgtgggacaatagcatcatcacaacagtcagcctagagaaatttacatcccaagttgtgtcagtagcaagtccctatcaatagcaactcaggctttgtgaggtctagctggctagaaatttcccacttggccttgcccatgcaacattgtgtaatattcttagcaccatctggctagccgatttaggcatcaacatcttcaagacttcttctcctcctccttataaaccttgctttcagaaaaggattagaaactcttccaatcacaaaatgattgctaaaactaaatatattacccctcccaatggtattttttggttagccaggatagagatataagtgaaaaatctatttccagtgttagaatttaaggcacagtgagaaagggaaggcatatactttttgaatgcaagaaacttcttcccaatccccctgaaattgcatcatttgagtaactatctcttccatatataaagtcacaacaatttctctctcagtcccagaactttgaagccttttcaaactttccttcttttggtatctaggaggaatacatttttgaagattgttcttggtgtctttcaggaaccaacacaatggagagggaagagagtgaacagaccaagaaaaggtaaatcctgaccctgagacattgatgagagaggtataatccccagagtgcctgttacttgaataggcttatgcctaacatatgttgagacctcagcaaacctgaactaatggagagggagaggaaaataaaactagttaagaactggaagaaaataacctgataatggatgacagggtatccaatgcacaatgcccagaaagcatgacaagctctgtcatggtcaagtaaaagtcaataccaaagacttcagaggtggtgaacatgggcttcatcttatctgccacagtaaccccagtacctggcacagtgcctagattagtgggcatcctacatgtgtggaatgaataaatgaagaagtggggaatgataacatgtttgcttcagcctgagcatcttagtatttgctatggccctgtttagatgttcttctgccacttctttacctcattcttcagatcttgcctcaagcagcactttcttaaaaaccctttcccaaactagaaaatgtcaacttgttacagtgtcatgtggatcccttggctttttcttaataacaccagattatgcttacatatttgtgtaattatcttattaaactctataaactagacttaactaaatcctatgaagagcagagaccataccagttaagctcatcattgtgctgctagcacttagcatggtgcctggcatatagcaggttctcaataaatgttgaaagaatgattgatgcatgatgaatacataaaagttcgtggtgatcagtcctttcacaacgtgaagctatcagatagtctgtacctctatccctcctgagaaattaagctctcaggaatatcaaggctctgactgcatacccataggatcaaagcaaccctcagtcacaagcctggtttcagagatagggtcataacccccagggtgcagagacaaccgagagtacccagcactaatccagatataccagccactgtgattctagcaacaaaactaataattccgggcacccttggacaatgagaaagggtgctgaaatcctgcctaccctgtcacactcagtttcagaaatggtctggaagagcctgcagagggcaggcagcagagaaccggcagagggcatgggaagggccaggcagaaataaagggtagctcttgaagcatagatgacagtgtagaccgtggttcttttctcttgctttctccacctttctcttcaatagtttgtttctcctcattgctgttccaatggcaacctctattctgccctatcattgaaatctagaaaaagaaagtagctcaaatgtgaaatatcacctaatcttttcttctatttctccagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctcttgaagaactgactagtgagatggcctggggaagctgtgaaagaaccaaaagagatcacaatactcaaaagagagagagagagaaaaaagagagatcttgatccacagaaatacatgaaatgtctggtctgtccaccccatcaacaagtcttgaaacaagcaacagatggatagtctgtccaaatggacataagacagacagcagtttccctggtggtcagggaggggttttggtgatacccaagttattgggatgtcatcttcctggaagcagagctggggagggagagccatcaccttgataatgggatgaatggaaggaggcttaggactttccactcctggctgagagaggaagagctgcaacggaattaggaagaccaagacacagatcacccggggcttacttagcctacagatgtcctacgggaacgtgggctggcccagcatagggctagcaaatttgagttggatgattgtttttgctcaaggcaaccagaggaaacttgcatacagagacagatatactgggagaaatgactttgaaaacctggctctaaggtgggatcactaagggatggggcagtctctgcccaaacataaagagaactctggggagcctgagccacaaaaatgttcctttattttatgtaaaccctcaagggttatagactgccatgctagacaagcttgtccatgtaatattcccatgtttttaccctgcccctgccttgattagactcctagcacctggctagtttctaacatgttttgtgcagcacagtttttaataaatgcttgttacattcatttaaaagtctacattttctgctttggcttcaagagtactactcaacccttgtggtctgatgttccctgctctgtcctctgaatgtacttcctttctctttacatctctatggctagaagcctctcacgcatcctgtatcttctcctcctcccttttccctaccattatttgagaaaggaggcttgtatacttctatatgtttatctcagtaataagtcataaaaaatcaagtaagaatggttgtttttgaggacaactaagaaatctggaataaggaagggaagcttacttttgagtttgtaacctgtagtgtgtaattttttaattatgtacttacatgtacattaaacaaaagcttaatgtaaaaatattccttgaaaacaccatgattataaaataaatgcatatatacatacagcatgtgagaggagccaggaaaactctggaaaaaagaaaattacctagactctgtgagggcaggaatgtgtttaatttctctccaatggatcctcagacaactaagatagttgtctattctattgtccatctttttgtcttttgttgtatttcttaaagattccctcaactttatcttctaacttctgttgtatttttatttctgctatcatgtattcttttcagaattcttttttgttctctcaaaacatatctgtttaaagattgaatgaaatattaacatgccctttggtgagaacatccctcctttgtatattaaattctctgaactgctgtattctaagactaggggaaagaaaaagaaggttgaaagaggtcattaggcagaatagtactagctaacattatttcacatttaccatatacccgtcactcatctaaacctttaaactcattatcctat

SEQ ID NO: 17004 - DNA, 12359 bp, Human
tggggaggaggcacagcatgtcatcaaaataaggaaattgcaaaagaaagcttgcaggctactttgaatgacaatgagaaagacggtgctgcctgagtgtgttaaggatccacatggtctccaaaatcctccaggagcatacagtctagtctgggagatgagacacaaaaataaccagaacacaacagcttgcactgactcgagggctggataagaatatctggaactcccccatctatttcagaagcttgtctcttggatgaaaattagacacttaatgggaaagggctttgaaaagagtgcagtaacaaagccccctttacaatttacccggcacattcacacccatcctgaggccaaagccacaggctgtgaggtctcactgtctcagcttcctgagctataaaatgggaatgatgctagtctctacctcctagggttggagaattgggggtcatgggtgtgaagtgctcagcagcttggcccacactaggtggtcagtacatgtaaggtattattgttgctacatacattagtagggcctgggcctctttaaacctttatagggtagcatggcaaggctaaccatcctcactttatatctgacaagctggggctcagagaggacgtgcctgagctggggctcagacaaggacacacctactagtaacccctccagctggtgatggcaggtctagggtaggaccagtgactggctcctaatcgagcactctattttcagggtttgcattccaaaagggtcaggtccaagagggacctggagtgccaagtggaggtgtagaggcacggccagtacccatggagaatggtggatgtccttaggggttagcaagtgccgtgtgctaaggagggggctttggaggttgggcaggccctctgtggggctccatttttgtgggggtgggggctggagcattatagggggtgggaagtgattggggctgtcaccctagccttccttatctgacgcccacccatgcctcctcaggtaccccctgccccccacagctcctctcctgtgccttgtttcccagccatgcgttctcctctataaatacccgctctggtatttggggttggcagctgttgctgccagggagatggttgggttgacatgcggctcctgacaaaacacaaacccctggtgtgtgtgggcgtgggtggtgtgagtagggggatgaatcagggagggggcgggggacccagggggcaggagccacacaaagtctgtgcgggggtgggagcgcacatagcaattggaaactgaaagcttatcagaccctttctggaaatcagcccactgtttataaacttgaggccccaccctcgacagtaccggggaggaagagggcctgcactagtccagagggaaactgaggctcagggccagctcgcccatagacatacatggcaggcaggctttggccaggatccctccgcctgccaggcgtctccctgccctcccttcctgcctagagacccccaccctcaagcctggctggtctttgcctgagacccaaacctcttcgacttcaagagaatatttaggaacaaggtggtttagggcctttcctgggaacaggccttgaccctttaagaaatgacccaaagtctctccttgaccaaaaaggggaccctcaaactaaagggaagcctctcttctgctgtctcccctgaccccactcccccccaccccaggacgaggagataaccagggctgaaagaggcccgcctgggggctgcagacatgcttgctgcctgccctggcgaaggattggcaggcttgcccgtcacaggacccccgctggctgactcaggggcgcaggcctcttgcgggggagctggcctccccgcccccacggccacgggccgccctttcctggcaggacagcgggatcttgcagctgtcaggggaggggaggcgggggctgatgtcaggagggatacaaatagtgccgacggctgggggccctgtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccgctcggctccccgctgagctcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagtgagggcccggcaccccagactcctctttctgcgggcagggcacaggaggctaggcctgggggctggggtcccgctgtcagcacctgccttctcccggggcccgggaccctctcctgccccatgtggagaaagggtcctccacctgtgtgtttcaaggggccgtgacctccaggtctctccccctgcgatcccatcttgcacaggagttttcttggggacatagatcagggggtggatatgggagaatttaggggacccggtgccctgtggacagccccgttaaaaagcattttaagatgctggggcgatatttatggggtcaggtagttgatgggcagaggaagggctgcaggaggcccagagggcagtgtagccagagggagaagggaggctgataggagacagggaaagcagggcaagggcccagagtccaagcaacagctctcagctcagctgtgatgaggccctgggggaggtggggggaggggggagcttggccctggggccttgccgagactgtgtctttttacaaggtgaatggacaggctggagaaaaagggagtaggtgggggtcacagctctcagagagcttgggaggacctgactgtagacttcaccaggctccaagaacgaaaagggcagcaagtgtagcatatttgttggtcccacttctgacaggccaagtgagcacagtcaccctcctgccaccaaagtcataaatattaattgagcagctatattggccaggctggagctgggaaccagaaacacagaggtggataaaatagacacagtttctaaccccagggaggtcacacagtctggtggggacatagacttcaagggtgtggctcctgggcagagattgggccacttcctgtgccctccctgggtgggtggggcctctccactccctgtctctcctgcctctacccagcagccaggccctccccctctgtcctggacccaccccctggtcagcccccggccagtcgtttccactgccagctttatcacccgcaactgtctgtctttctgtctgtcccacccaggctgcaggaggagattcagttgaaggaagaagcagagaacaatttggctgccttccgagcggtgagtgcccttcttttccccttgcatggcctctggccttgctctgccccacctgggtggcggtgaccatgtccttctcgcttggcctctcccaggacgtggatgcagctactctagctcgcattgacctggagcgcagaattgaatctctcaacgaggagatcgcgttccttaagaaagtgcatgaagaggtataccttggcccctcttcctggggtcactgggccatggggaaagcagccggaaagtggggttggggtgaggctctggctgggaataggggtgtgagggtgctgtgtgggccctgagaggggactgaagcccagtcatgccctacaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgggtggcctcgcccggggactggcatctccgtccccctgaatcccagcttggatgtgctgcctgtggtaccatccatgggaggagagcccagaggcttcatgctcccttgctcatccctacccgtgccctgcatccttctcatttttgggcccctttctctgcccttaggtgtcagacctgacccaggcagccaacaagaacaacgacgccctgcgccaggccaagcaggagatgatggaataccgacaccagatccagtcctacacctgcgagattgacgccctgaagggcactgtgagtccctgcccacctggccaggccctgccccttcctgtctgcagttcacaccctcactttgtgaccttgggcccatcatagatcctctctgggccttcatctacttaaatctacaataggggtaaaaccagacaagtggattccagttggatgctaaggaatcaggggttcctgggcatctacctatgtggggactgtgaggctgaatgcaatgttcctttgtatctattttattctgagtgttcacatatagacttaatttgagttcagggttcaacatggcctggacctgaccatctggagttgcctgccagccccaaagctttctttgggctgctagtgtcctcttcccttccttgacctgggttccccctctcctgcagaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggtgaggggccaggcaggagcccgagtgggaggtgcggggtgctgggtggtccatttctgtccccaggaggctcgagattactgattacctcaacaagacctggaaacaattttttttttttttgagatggagtttcgctcttgtcgcccagtctggagtgcaatggcaccatcttggctcactgcaacctccgcctcctgggttcaagcaattctcctgcctcagcttcccgagcagctgggattacaggcgcctaccaccacgcctggctaatttttgtatttttagtagagacggggtttcactatgttgggcagctggtctcgaactcctgacctcaggtgatctgcctacctcagcctcccaaagtactgggattacaggcgtgagccaccgcgcccggcgtggaaacaattttatacaagaggccactgctctattaattgcagagaattaaccaaggccacctgggtaaaaagcaatttaattaacagcatttataaaaagagaaatataagtattcccttatccaccttcagaattaagaaccagcagcaaaaaaaaccatattcagcaaccaataataaaatattactgccagtcaagggagagatgaaagcagaatggggagtgatgaggagggaaacggagggagcagatagaggcaaatagagagagggagggagagaagccttgcacagggataggctaagagaaggtaaagagatgcatacagaaggcatgagtttgcacacacatgcacacatgtcagcatatgcacatgttcggaggaaaagacacagacgtcatgctcagagcaacccacctctagacacagaaaacaacatacaactggaaagggacaccagggaaccttgtgggataacagaaatgttctatatctttttttttttttttttttgagacagagtcttgctctgtcacccaggctggagtgcagtggtgtgatctcagctcactgcaacctctgcctcccaggctcaagcggttctcctgtctcagcctccctagtagctgggattacaggcgtgtgccaacacactcagctgattttttgtatttttagtagagatgaggtttcaccatgttggtcaggctggactctaactcctgacctcaagtaattcgcctgcctcagcctcccaaagtgctgggattataggcatgagccactgtgcctggcctagaaatgttctatatcttgatttggactggtagttacacagacgtggacattgatcaaaactcattgaattgtacattaaagatctgtgcatttcactgtatgtaaatttaacctcaatttaaaacagatcagttactccaaaaactggtaccccttgatactcataaaaataatatctgaaatttttaaaaaggagcagacatgtttagatacaggtacaaacataaagagaaacttcagattttgtaaaatcacgtctacatatgatggcctttgaaggtagctaaaggcatgttgcattttcccagcattaggcctaaatagtaagctctcagaactggcctggctggagggtgggcatgagcaatggatatcacccacagctgctactagtaccaacttgagtgccaggagcaagaaggaaatcctggtgctctggagggcgcggtggggttgcacatcctagtgtcgtgccagcagttcacagttgaaataatgatccttccagaagagactattcctgggacagctctagctggccttcgaccccattccttgagcagtatgggtggtgggagtgctggggtccgtgggactgggacagctgaggatggtgtttagaaaggaccagggtgagccttgatgggcggtctcagggaaagatgggagggttcttttttttttttttttgagacagggtcttgttctgtcccccaggctggagtgcagtggtgcaatctccgctcactgcaagctccacctcctgggttcgcaccattctcctgcctcaccctcctgagtatctggaactacaggtgcccgccaccatgcccggctaattttttgtatttttagtagagacggggtttcactgtgttagccaggatggtctcgatctcctgacctggtgatccgcccgcctcggcctttcaaagtgctgggattacagctgggcccggccgatgggagggttcttaactcttaggaggttttgtctcttcccttttaggatcaatctccccatccagacctactctgccctcaacttccgaggtgagtgtctgctggcaggcggaggctggagttgcaggggccaggagtccagcatgggcactgcccaaggccagccaggagggaggatgggaccctggggctagggacagacctggagtctggggaagaaaaaggggaccactgcgggtaggtgggggagtttaggtagaggtggatgaggcaacttatgacagagagagctttttatgtgattatattgtattgtatttaccatgtcccctgcaccttcttggagtattgggcctcaggaagcagcctctgttctgaatcccaaactctgaaagcaggagtgtccttggggacctggcttcaggagcatctcataccacctgccctctaagacacccacagcccattgtctgtttggcacattgccaagccccaccttggctgcttgtcgaacacctccagtttgctggagcaagatgttggatgcacgtttggaaaaaaatgccaaatcttagcaaagccaaacaatgaaaagaacgagctcttagggcactctgccattttgacattagtaatacgcagatcgggtggctttccaaccccagagagcagagaaacacacgataatgatgcattaggaaagcaagtcggagtccttggcagcttctcctttcctagatcaaaccttttctatcttcgatgtacatttccatcaggaaaaaaaacacgctgcgctccagcgagtcacaacattcatcacaggctggttgctagctaaggaaattcgtaagcaccaaactcataataccaaggacctccatttgacctttcctacacaactcagagcctctcttttcagttagttgtttatacagacaccaagtatgagtcttgcatttaaaacttcatagtacaaaaaactccacccacattgcacagtgcttttccaaatcaatagctttgtggccatgataaggttggtaccacttcactccgtgtcctcagtgaggaaactgaggcacagaatggcaagtgactgagcatcagcacaatgagtcagtgccttattcctgctctgtctcactttaagacatcaagttgctcatctgaattttttttttcttttgaaacggagtctcgctctgtcgcccaggctggagtgcagtggtgcaatctcggctcaccgcaacctccgcctcccaggttcaagcaattctcctgcctcagcctcctgagtagctgggattacaggcatgtgccaccacgcccccctaatttttgtatttttagtagagacggggtttcaccatgttggtcagggtggtctggaactcctggcctcatgatccacctgcctcggtctcccaaactactgggattacagatgtgagccaccgcacctggccctgaaatcttaaagggagataggtactgtaaggtcctctaaagagtgtcttgagactgggctttggggttctatcttgaagaaggggagtcccaggagacaaatgtgtgcagggctctcctggggcctgggggtggagaggaactaggagggatggggaatgtcagtgctgtgcagcctgggcctcaggtgtcccctaccctcctgcaccatcctgcacatggagcaaatctgttggctcctgagaccatctaaactatgggacaggcgctggggactgcagaaccacctgctgggtgctgggctgaaggaaaggtgttaaagtcttgaagaagtaacaagcctgtcttgaggggggttggggtctgctagggctctgcccaatgtggccccagatggactcccagcccctggtatagcccagcctggacttggtcaggctgagtgtgcgatggaccctgttacagaaaccagccctgagcaaaggggttctgaggtccataccaagaagacggtgatgatcaagaccatcgagacacgggatggggaggtaagtggtctgtctgggctccttacccttggtgggggctatggatgtgtctggggggactgtcttccacccagctgtgctggtctaggtccctggctagtggggcaagagagatcctgcggccctggggtggggatggctcagggctgaggctccattctctggctagcacatggttggactgggcttctcttcctccccaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctgtgtgggaggggcgcccacctccccacgccctcccctcccctgctgcaggggctctggagagaaacaataaagagattcacacacaagccaagctggcccctgttgtcttgactgccaggtctcctgtggggcccctggggccctgtgatacaacctgtcaccctgagatggactatactgaccttctacccagccagactttccccagggcctcgcgcccacttctgttcccagagccacctggccttgatgtctgtatgcagtgtatggggcagggagggctggacagggcttttgttggggaaccacaaatacctctcgttaggccccagttccaggactgcaccccttgtgctctctactacaccttcaggtcagccaggctgggggacaccacctgctattccttttgaaggatgtagctgctccccactgactggctctgaagtagggctcccccagtcccttcttcaaagatgccaacagccccttttttttctctctctctttttttctttttgagatggagtcttgctgtgtcacccaggctggagtgcagcagtgtgatcacggcttactgcagcctggacttcctgagctcaagcgatcctcccacctcagcctcccaagtagctgggaccacaggttcacaccaccatgcctggctagctttttattttttgtagagacaaggtctttctgtgttgctgaggctggtcttgaatttctgggctcaattgctcctcctgctacctcagcctcccaaagtgttgggattacagatgtgagccaatggcctctttctattaactccttccaatactatttttatacacaggagccaattcaggaaaaataatgtttggaaaaatggaaagatctgttctgtgcttcgataagaaggttcaatactctgaagagaagtcaattcattttccattcatctataatttcaatgccatgcaatctcaattaaaataccaaataaaaattttaagagaattggagaagatgggaggggagtgtaagacgtatgaaaaaaattaggaggctgggcacagtgactccacctgtaatcccagcacttttggaggctgaggtgggaggatctcttgagcccaggagtttgagaccagcttgggcaatgtaacgagaccctgactctacaaaaaataaaaaattagcctggcatggtggtatgagcctgtagttccagctacttgggaggctgtggtgggaggatagcttgagcccaggaggtcgaggcttcagtgagctgtgattgtaccactaactccagcctgggtgacagagtgagactctgtctcaaaaaaagaaaaaggaaaaaaattaggaaatcatagaaagtacatcaaaatatattagaaggctatgataattaacagatttgttaatgaagaggaaatatacaaatattaatgaacaaaatagtgtgtttagaacaagactcacatacaggagacatacacatgttaaaggaggcattttgaatttgtggggaaaacttaatgattcagtatagggtttggagcactttgatagctaagaggtggggtagggggcagagtgaaggctgtctctcttttactccttctaaaaatattccagtggatcaaagatgtaggaaacgatggatccatgtaggcctcagccttcaagtttctcctctgagatttcagggattatcctttaaaggagtcaggaagagggtagagatcacaaagataataagctcagacagtttgtatgttaaataaacctcaggaggttttagtcttaaggtccttaatctgaccttccaaactgacttttccagaaacttccaaaagcctctctggtgtctctttctttccctcctttaatgtggccctggctcacaagtcacccctctctctaagaagtccccttctctgttttattcttcagctttgccccaggaggacctggggtgtagccccgtgtcccctccctctgccactggtgactcatggtcatttcattcccctcagtcctcaaatagggtgaaccctacaggccccagaactaccccagtcaacctgtagagaaactc

SEQ ID NO: 17005 - DNA, 7476 bp, Human
gcagctgcacggcactgagcgtctggcccgccgagttgcgcgcggcgcagacgtagagcccacgatccttggcctggcagtaaagcaccttgagcacgaagccgccgtcgcggtcgcggtacatgaggcggcggcggtccgggagcagcgggcggccctcccagtgccattcgatctcgggctcgggcttgcccatcacgtagcagcggaacttggcgtgcttgccctcgttcacccagaaggtcttaggcgcgcacttgagcggctccaccaccggcgcgggggcctcgtcggggtccgcgggcgggctctcggggggctggtgcacctggagcagcgcccccgcctgcgcgtggccgtgcgcgttgcgggcgtggcacacgtagacgccggaatccggcagccgagccgccaggatgcgcagtgccaggctcgcgccggggccgtcctcggcgcggcccggctggagcgcgaagtggctgctgtcccacacttcgtccagggccatcccgtccttctcccagtacagtgtgggctcggggaggccccccgcccggcacgtcagcaccacctccgccccccgcagcacccactgggatcgaggccccgtgaggaagaccggggcgccctccccggaccccggcgatggcagcgggcgctcggcgggctgcagctcggggtcggaggccggcggctccagcacggtgacggcggccgccgcgtaggcctcgccggccgcgttgcgggcgcggcacacgtagacccccgcgtcggtgggcagtgcggcggtcagcagcaggccgtgctccgcgccgtccgccgggaagctcaggcgttccgaggccgccagctgctgcccgcccttctcccacaccactacaggcggcggctcccccaggaccacgcacttgagctcggcctcggcgccacttaccacccgcacaggccgcgggaagcgcaggaagcacggggggctcccctgatcccccgagctcgccttcatcgcggcggccgaccgcctgcagcggcgaacggtgggggggcaggggggggtgcggagggcgagccgaggcccggggcggcggggtcggggcgcggctggggactgggcgcggggacccgcggagctctcccgggcctcccgctcccggctcgcctccttaccctcggccccgagctgcagctctgcggcggcggcggcggcgattcccgggcccgaagcctggcgctcagggggcagtccttcctgtttgcctctccagcgagtggccccgcagcctcccctgcccgctgcctggcttcctgctcttaggagcctctcttcccagccccctcccacagcttgggcctcttccccctcctccctcccacctccagccgccaggtccccagccgcccgccaggcttgggcctgagtggcagaggcgcctgcagctgccaatcccaaaaatattctctgatgacacagctggaggacaagagcccagactggctccactggtctaagtatagagcaggcaggaccacctgcccccggccctagccccggttctagccccggttccagccctgcccccaagggctggccggccagcagctgcttattgaaaggggccccagaaggtctgaggggtgatgcactttgtctccctgacaaataacactttctggggctggccggctacagctcccaggctcctgtcccacctgatgtcacctctggatgtgtctgtgtgtgtgtgtgtgagagagtgtgtgtgtgtgagaatttgtgtgtgtgtgagtgtgtgtgtgagtgtgtgtgtgagtgtgtgtgtgtgtagggagaaggtgttgtatgtttgcatgtgtgagtcaggtcgcttgaggcgaaatccttcccagcccctcccccacatccctggcgggagtgggagataaggctcatggccacagacatctgcgtcagagataggaggtctcaatgccacgggcaggggcaactcggactgtggggcgtggaaaggactggggaagactggatgagaagggtagaagagggtgggtgtgggatggggaggggagagtggaaaggccctgggcagaccctggcagaaggggcacggggcagggtgtgagttccccactagcagggccaggtgagctatggtgctgcacctactgctcttcttgctgctgaccccacagggtgggcacagctgccaggggctggagctggcccgggaacttgttctggccaaggtgagggccctgttcttggatgccttggggccccccgcggtgaccagggaaggtggggaccctggagtcaggcggctgccccgaagacatgccctggggggcttcacacacaggggctctgagcccgaggaagaggaggatgtctcccaagccatccttttcccagccacaggtaacgagggtgggggaaccggcaggatgactttgagaaaaagcaaggcacagcatgggtttgcaggccaggcggacctgggtttgaatcctagtcctgctactcagttgctttgcagcaataggccagttactaaacttccttatgcttctgtctccccatctgtaaaatgggctaatgcccacctctcaggattaagtgagaggctgtacctagagtgcatggcaggtgggaggcatttgggaagtatgcgctgggagaccgggggtctctaaagatggagatatttgggcttgagccccttcctgccacctttcctcctatctctgcctctgctcgctgctccaaaccctgtttctttactcccaggtagctgacactgagaagctatcagagatacaggcaaaagattagttgggaaacttttctggaaaactagtctatcttctcttgagttcctgtctcaacatatatgtgcccccttgttccactgactgaacggataagccctcctgtgggtgggctttcttgtcatctggtccacctttctcttagagaggacccctgcctccctcgcttcagtccgttcgcagcacagtggggagaaggatggctttgggatcaggcaaaatccaagcctggccacttagtcgttgaacgtcatttcacctctctaagcctcagtttccttatctgcaaaatggaccaattgtgactagataatgagagaagccatgtaacagtatagttccaattgccagtccatgaacgagtgctgctccaggatgattagtatagtctatgagtgtgtcagtgtgaggatgctaactacacattcttgaaaggactgccctctgttctgagttacagccctcctccttctcttccccctcttccttgttctccattttcttccctttcccacttgcctttccctccttcttctttttttttttttttggtgtaaacctgtcttttaaaaatggaattattttaaagaatttatcctacaatattcctgacatgccaaagatataaagagtaatataggccgggcgcggtggctcacgtctgtactcccagcactttgggaggccaaggcaggaggatcacaaggtcaagagatcgagactatcctggctaacatggtgaaccccgtctctactaaaaatacaaaaaattagccaggcatggtggcaccagctactcgggaagctgaggcaggagaattgcttgaacgtgggaggcggagcggaaggcagaggttgcagtgagccgagatggcgccactgcactccagcctgggcgacagagctagactccatctcaaaaaaaaaaaaaaaatggtaatatggctgggtgtgatggctcacgcctataatcccagcactttggaaggtgaaggcaggcagattgcttgagctcaggagtttgagatcagcctgggcaacatagcgagaccctgtctctacaaaacccacaaaagttagctaggtgtggtagcacacgcctgtggtctcagttactcaggaggctgaggtgggaggattgcttgagcccaggaggtagacgctgcagtgagccgtgatcatgccactgcactccagcctgggtgacacagtaagactctgtctcaaaaaaaaaaaaaaaaaagaatataacaaccatccatgtagacaccattcaggatactgtttcacactatctggtgagtaagcattgaagtctaatacaaagtcttagtgctggtgaagtggagagagggcctcttacacactgctgatgggcatgttaattggtaaaaccacttcagagagaagttggcaatgtcttctatttttttaagtcccttcatgatgaaattaaaaaatgggaagcctacagaagctctcccaaaactcaggagagtccccacgtcccggagggcgtggagcagagtgcagcccatcattggctcatgactggtggccacatccctcctgctgaagaggaggggtgccaggtcctgccagtcagggctgccctctcccttttcttctgtctcctgcagatgccagctgtgaggacaagtcagctgccagagggctggcccaggaggctgaggagggcctcttcagatacatgttccggccatcccagcatacacgcagccgccaggtgacttcagcccagctgtggttccacaccgggctggacaggcagggcacagcagcctccaatagctctgagcccctgctaggcctgctggcactgtcaccgggaggacccgtggctgtgcccatgtctttgggccatgctccccctcactgggccgtgctgcacctggccacctctgctctctctctgctgacccaccccgtcctggtgctgctgctgcgctgtcccctctgtacctgctcagcccggcctgaggccacgcccttcctggtggcccacactcggaccagaccacccagtggaggggagagagcccgacgctcaactcccctgatgtcctggccttggtctccctctgctctgcgcctgctgcagaggcctccggaggaaccggctgcccatgccaactgccacagagtagcactgaacatctccttccaggagctgggctgggaacggtggatcgtgtaccctcccagtttcatcttccactactgtcatggtggttgtgggctgcacatcccaccaaacctgtcccttccagtccctggggctccccctaccccagcccagccctactccttgctgccaggggcccagccctgctgtgctgctctcccagggaccatgaggcccctacatgtccgcaccacctcggatggaggttactctttcaagtatgagacagtgcccaaccttctcacgcagcactgtgcttgtatctaagggtggggggtcttccttcttaatcccatggctggtggccacgcccccaccatcatcagctgggaggaaaggcagagttgggaaatagatggctcccactcctccctcctttcacttctctgcctatgggctaccctccccaccccacttctatctcaataaagaacacagtgcatatgacttgacatatgttctccagcttctctgatatggagttgggcccccaggagcatgggactgtcagatctcaggtcactcagccacacttgacctcagagacatgaagttcaagagctataactggatgtgtattggttgggaatctacaacgcttgggggtgacataatagtgctccaagctccttggagagccaccttggagacagagctggacgcatgcaagctgaaccagacatgtcaatcaggttgcctgccctgcacacctaagggagactgctgcactcacatgaccacatccaaggcagccataagtcccctcccctgccattctctgccacagctgatgggcacttagcccgaggtcaggtgatttgtagcctggccagagactgtggcctttggagtcccactgagacaattgtccagagttggccagaccttggagttacttgggaagcttgggtgggatgtaagggagagatatatgtgttggcagcatcagaaagaaattaacaagggcaaagaggtggtgttgtgttaaggtcagacagatcacctgaccaaagacctgaggatttccttttgccaaaggcccttctttgaatccgtcactgactcttgctgtagactccgtgaggcctcctgcagtaggattctagttcatgaactctttgtctcccttgatgtcacctgtacatgtttacataatcccttaactcagcccttagcatcagaagagtggaaagactgaggctattgccagaaaatagaaaagctcttttgtgaatttgtgcatgcaggacatggtgcaaaacagcacttttcttttttcattgcgtttcctatcagtccattctgcctccggatttgggcatggggaagcccctctccgctggccttcctccctgcttttttcactctccttgttatccccctgggtctcgttatccttgtgctccaccccagggtccctgctatcagccactggttccatccagtctccaacacgtgtgtgtgtgtgtgtgtgtgtgtgtgtgtttgtgtgtgtgtgtttaggggaagggctgggatgttcaggtccatcagactggaacttgagagcactttctgatattgactgcacaactacagtgtgtatttatctaaccagagtcttttactggtcaaagactcctttctaccagcctggcttgatggggtggaagggtaagcgcctgctccagtgagcggtgcagcgggaaagaatcctatcccgtcacagttacaccaacacccctcccccaccggagctaacctgaatgagccactgttccctgcagcacaggagccttcagagccatgtacgtgctcctgtacacgccccagtctctgttgacactgagtcccccagaaggctgtcactgttctggagggggaaacctgcttgtttgcagtccccagcctctcccaggaccttcgtgttgactcagcattggaagcgctctgtgctcagagctctgtgcatccctattcaggcagtgggctggggagacagctgcttgggctctgccagtggtgggaaggggaggttttttccaagcctgtctatgttctacgtgctccctgcctggcttctctggctagatcctcccttcccaaacagtgaggtctttccctgggatcttcaattttcctactaggcttcagctcttcattcttcctgctggggccccctagaaccctgtgttatccagatgctccctgtcccagggatgaggatgggcgctgagggctgggggcagattactgaggggtacaggattctccacgaggccagttagcagattggtattgcaagtgaaaagcgtgcacatgtctgagacaaaatgagaaaaatgagtatgagggagtctttcacaaagccaaatatattcattttataaaggctatctttcaatgctacccattaccttttctgcttgtgggtgtgtgacagtgttagctctttcatgatgttatga

SEQ ID NO: 17006 - DNA, 52202 bp, Human
aaaaaaattaaaaagtaaattttctattcaactaatcagatctatttaattagcactctgctttgaggaatgatgtttcagctgtggatataaaaaattgacaagagttttcacagttttctccttctgcttcattagtaaaatacggaaatataaaaggcaaaagtaccctacaaccatgtccaatgtgatattgcctccccaaaggaggctttcactcaaaaaaagtagaccctcattgtttccataagtctccgagcaaattctcttccggccacagactttggatgtagaaaataagcttatctgggcaggtggatatgcagagtttgcaatggaagcaaagataaaaggaaggcatgctactcttacctccataggctctactctaccctgatctctgccctgtctttgatcactgggcaaagaaaccagtgaccatggcaaatagtacccattgtactcagaagaaacccattatacttttgtgaaagaattatcctttttaaatagctaaaacaatatcccagggaaaaagtaaccaagactttattatattgaatggataagatttccactacttctgtctaaaaatcaaataatgcccttggaggacattttaggaattaataaataatcttttgttctacatagtaaataataaaagctggttttcttaattccactttgagagttgtgtggtctatgttaggaggaaagctggctggagccaaccatggttaattcaatgccaggctgtatttcttagtctccctttcatttcactcttctgccatagtgggtccatcatactcccaggccagtgagaagtgccctctagtgattggatgggttcgcttggcgcccgcctccatgcagacagagcaatgcctgtgtgggtgcttcctgatcaagactgatgagtgggatgcaaatatcttctttttaatgcatgaccctggcatagccagagggaatatgagtgatggtgcctcaaagcagtaactttttgcttagagcttgagagtcaaagttaaggacccacatgtatacttcggctctagcgagtctaaggtgagtaaagccttcagattatcaataaagaaagattttaactattgggcatgtgaattcaaataacgatgcaatttcacaaagcaaagaagaacataagaaagtttgtttctctggcctactgctcaacattgctacttttcatgatcagacctgatattagactgagggttgaagtaactgtcttagtagaattagaaaattaatgcatttatttttcagaaataccttaagttttaatgttttacatgattttgggataaaaaggaagagtctttttactttgtaaatgtactcattttttcagttcttttaaatctcttttgatagcatctgttagtgcaccctcatacattttcctcattttatcttatcttaggcatttactttgattttaaattctcatagatattgaaaattatacctgtgtaatttatgttaaagatctggccatgatcaggggctgcaggtgttatttacaataatgtcagtgtctcatagtggtttgggtaatttggtcaaattacaggccgttacttcataaattgtgagctgtctggagttaaattttctgaagttttattatatccaattcaattcaaccaacacatatagaatgtttaaaaagtaaggagcattttgataaggtggtctggagaatggggcaaagatgatgaatttattatccacagtgggaggagtcaaaagtataaagtgctttttaaaaatcaacatatttataaaacccaaagcaaaggcagcagaaaaactgtagctattgtgtaatttattctataatcctacatcagtctcatttattaaaatcagcatttatattatcccttaataggaaatcgttgaggaaaagatatgaaggttaaagagaacttacctagatgctgcaaatactcattttaattatttattttgtttaggatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatggtgagacatcatgtgttccattatttttatactatttattatttttcctaagtctccacaaagtacttgatcataatgaaagaatatcaggtttcttaacttacactgtgaagatcctcttctatccacttatcacatgaccttttcttaatgaaagtataatgaattcaagataaaggattttaaaacattagttaactttactaaggcaaattataactttagaacagtggttctcaactgagggcatttttgctccccaggtgacattgggaaaagactggagatattttgggttgttccaactgggggataggaacagtaagtgttaaagacatctagtgagtagaggccaagaatgcagctaaccatcctgcagtgcacaggacagtcctcacaacaaagaattacccagccttaaatggcaatagtgccttaaaacaatgctagaaataagactattcctgtacagttgagaattctactatagtaaaaacactgaaatactgtcataagactgagccaaaatgaagatgctttgcagaagttaaatcttgattttcctgagtatattaaccacatggtaggtgatttgaaacacatttcaagataatcaaacaagattattaaccactggaatatatgtgtttgtgtccagactcaaggaatagattatgttgtcattggattttgactattacggggtaataggaagtgactctccattgcccaccccccaccccaatctccctctcaggcataacttgggctttatgcctttccttgtgcaccatgatgtattgcaggaagtatcttacattttgttttttaattcagaaaaggggcagcagaaaaggatccattgaaattaagaaaatcagatgtgtggagaaagtaaatctcgaggagcagacgcctgtagagagacagtacccatttcaggtaaagggaagaacgacattgcattgggtggatagttcttccttcaatttttctatcgtgaactcaatatatctaggaaaaataatgatatttcaaaataatctaaacaaggcttggaatattcccacatgggagttgggcattttgctaaaattctgtccaccaatctgccttccctggagggaagggaagggaagcaagacaggagcgtaagtcgcagtgacctgacctgcctcaggtctgatcatctcttttaacaaacattgctgagtatctccgatgtggtacacagtagtaggcatactatggggaacaaaacactgcccctaccccaaggcatttacagggaagtggcaaaatagactaatacacagaccattacaaagcagtgagggtgagagttaaggtggaggtcagcagaatgcatccatggagtcccaggatgtggaagtttcattcctcactccaagaggctagagagatattctattggaggtgacactcaagttgagaaggacaagtaaaatttaacccagcaaatatgagaaggacagtggtacaaaggaagcagcaggtgtcaaggcactgatgagtgaaacagtatgacacatttagagagcactaagtagtccctatgaataaagaagcccatgtgacagtgaaagagatagcctggagaggtgaccatgctaaggagttttcattttaccctgaagtattttaaacaatggtatggtatgtagtgtatgctggtagtaccttttggaagtggcctaatctaagtcatgccctacttttcttatagcataaaatcttacatttctgatccaaaggtagatggattgtctttcagatggcctgactacccagtgctagtattaggaacctgtggccaaaaatgaaatacaataatccagttgattaacaacccatacttcccatttggaaaaaatattaccaggccaggcacagtggttcatgactgtaatcccagcactttgggaggccaaggagggaggatcacttaaggctgggagttcaagactagcctgggcaacatagcgagacctcatctctacataaacattgttttcattaaaaaaattacccaattgggggaaaccaggggagggcatgctcatggaagatgctgcaaactcacctcatagaggcatagtgctcaaaagatcacaggctttggagcccccagagagttcctagttccaccacttatacttgtgcaactgtaaacacatactcaacttctatttctcacagagttgaaataagattaaaatactgaagtagctaggaaagagcccagcaactagtaagtgtttaacaaatgctgtgtatatttaccaacaagagttgaataaactagagaaggatctggagaagatattgtaatcttcaaacgtttaaacatttgtcttaagaaacagaaaagtatatattctggagattcctggggtgccacatgatgaaatagatgaaagtaacagggaaacatatttttactcaatgtaagtatgaactgtataatgatcagaatatatggatattggcagagatgacatagcagagtaaagaacattccatccctgaaggtatttttaaagatagagcagttaaacattttccagtgggctgtaaggaaatcatgcactgggtaggcaaatggaccagaacaatactaagacacgtgtaatgtctaacatattaatgtccatagtccagggtgtccctgatgagaactcagtgttcaccactactatgaggtacatcatcgctgtaattttccaaagtataggagtgtctgggataaaacaaattgataactggaggattttttaagaaaatttttttcatctaattccagagctgatgtatactgtataagcaaactcaaggtttcttttggatgacaaaaaatttgcaggtgcaccaaagtgaagtatggtgcaattatatataaacacaccaaatattttcctttccagattgtctataaagatgggcttctctatgtctatgcatcaaatgaagagagccgaagtcagtggttgaaagcattacaaaaaggtaattcaaaaaaagaaatgttgaaagagaaaggtcaaaaaaagccataaaagagagtcgttttttgaggcttggtggaggaaagacatggcagtaaaaagactcaatgccaagagacaatctactgattttcctaccaacctcagggaatgtgtcagactcatcctcatttttgctttctcattgttacatacaggaagcctgtggattggattccctggcccacacaaagccagtattgtgccttcccagcagcttaggggaagccaggccacctgctctccactcagtatgcttgcctttaccaggggaaagtctaggtcatcatggggctatgtcaagtcctgtagctaccacacttttgatgtttatagaaagttacatctaatacttatactgagcatttaccatttgccagctactttatcaaatgcttgtaaaacatttttttaggtaaccctcttgacaactctattgaaaggggtaatattattctccatttttcagacaagtaaagtttttaaaacatggccactgtcatagatacagtaacgagggactcagaactcaattacctaaacctgattttttaaccaatacattgtaaatgctaggcaaaactgaagatttaatgaagcttttattcagtgatgtttaggccgccctggtaacaacttttggtagaagggagagaatcattgttaatgatttggcactatagtatttccctctgtgatattttcaagatgggtaaaggtgtgaagacaatatttaactcaaatgaatggctccatttgtgaaatttcaggtattatgctcctagatggaggaagattttattttattttattttattttacttaagttttaggttatggttctttcttagtacacctcaaattacacacagttactccactttgatgcaaatacacccttctcacacatagggcttaatttttcctttgcataaaaaggtttagcaacccattctgcgggtagcaagtggtccactgggggacagaagcttccctctacccaccaccagctcattgaaatgagaaagacaacccctctagagttagacacacctgcagcaaagtgctgctttgctgtgtcacctaataaaatcatctaccatctctgggtttaagttaatcctgacctgtcaaataggagatcacatttcttttctcctagagcagtcacgagccacagatgagacactcataaatatattaaaatatcttatgcacaaacatgagtcactgtggttactgtagggcttctaggaggagctctaagattctgcttcccatttagtctcctttggtggaatttcctgagcggtaggtgctatgtcctatgtacagctcttggtcatgccctgctagatctcatgtgtctgagcagctcatgtgaagacatacgaaatgtaaaggaagagcagagaaagaagcaaaaacacatctcctagcccctcataaaactgcagagagtccccatcactacagctgccatatgcacaataagtggtttgtctctatgcacagtaagtggtttgtatcagttagtgatgttttgggctgcaggtaaaaagacatcaaacagttgctgaaacaaatccacttttgttcttctctcacagtaacaaatgcaaagataggcagtcagtcaagggctagtgcagcaactcagtgaagtcagtagggatgcaggctcctcctagctttctgctctgttatccttagaagctgcaggagagattccaagccttcccagaagcctccctgcaaacttgtgcttatgtcacatcatccagaactatatctgatggccattgatgtgtacaaaggaggcaagaagacagtatcttttttttccagtctctgtgctggaagatagtgagaaagaaggtgcatgggatttgctgtcaagttggccaaccaacctgctgcaggaaaacaaagaggttctcctgctcaaatattctcccctacaaagtttcattgtgctataatggctcctcctgccttttgtgtctattatttggctcaagcattataaactgaggtagacatttaagatagaattttccagatgttaacctacacttggaaggtttgggctgattcagtggtagcataggagtgtgtgtcaattatcatggttctgaattcagctaaccagatgtggaaaaaatgtgctcttccttccaaaaattaaaacagaagggggttttgcagaggagttggcacctgtacatcataatgtagtagaaaaagcctgaggctgagtctcaggtctgctatttattaagcttgtgaagttgagcaattgtactacctctctgcacttcagtttacctaactctgtgagaggtgtaataacaatagctacccctcaggttcttgaattgattaaattagaggacatatgtaaaggaaaatacataaatgtaaagtcctatggatatatgaatatatgagttcctcttattgtcgttattaggtggtgagactgttgcaatgtagacttttggatttggttggaaaaagaattagttacccaggaaaccaaatccatgtagtaaggaaataataggaatcccaacatgtggaggccagaagcttagagagcaggaaggcaagtaatgtgcccaagagattgcaatggccatttggaaccaaaatcagaaacttacgttttataattttaactctttttgccttttgtgatttctgtcataatttccctttaattctcattagtaaagttttttaatgccagcattttcagctaaactgagctaagttaaattaagggaatgatatcactaaagcccactgtttattgaacacctacttactctgggccaaacactgctgggtgctttacatacattatctaacagcctcccaatgacccagcaaagtaattattatctccatacgcttccttgagtcaggactgtaaggataagcataactctcctgggatcaacataaggaaatctcaagatgaacataaggtcaagagagaaagagttaaaggcacatatagaaccagcccttctcacctagatactcttcttaaaatatactaagatcttgtaggtttctctgttgtatttcaaaagaggctaatttgttatagattacagtttcatttatttgaattatacattgccctattcccgtggctttttaaaatatgcacatattcctaggaaagtagccccataaaccattcattccttagtataaacatgtcaaagtcacagaagtcaaggaagggatgagaagcagttctaaattaagggaaactaagtgccatgtttgattttgaattggatccttgatcagaaaaaaagtgagtgattataaaggccattattggaataattagaaaaattttaaagatgaaatatattttaaataataaatgcagccataaaaaagaatgagttcatgtcctttgcagggacatggatgaagctggaagccatcattctcagcaaactaacacaggaacagaaaaccaatcaccgcatgttctcactgataagtgacagttgaacaatgagaacacatggacacagggaggggaacatcacacaccagggcctgttgggggatgaggggcaaggggtgggagagcattaggacagatacctaatgcatggggggcttaaaacctagatgatgggttgatgggtgcagcaaaccaccatggcacatgtatccctatgtaacaaacctgcacattctgcacatgtatcccagaacttaaagtaaaataaaaattaaaaaattttaaaaattaataataataataatattgtatcagtgttaaatttcctgagtttgataatcgtattacagttatataagggaacatccttgttaatataagctatgtgctgaagcatttatggatgacattatttaggtcataccatctactacttcctcataaattattaagcacaatataataatgattttaaaatttaaagaataatacatatgtacagagagaaagagatacagcagatgtggcaatcagttaataattggtgaatctaggtaaaaggcatatggatgctcattgtattaatcttattcttgcaacttttctgtacatttgaaaattttcacaataaaaagtagatggaagtgtatgtttattcaggccttttttttagaaccttttgctaaaatttagccccacccttccccttctgccacaagaaaacaccatgtgttgtaacccactcactttctttacagatatatctctaaaatcctaacatcaagctgatctgtatatgcattttactagttattttttcttcaaaaatgatatgtaattgtgttgttctcaacatactcatggttagacttttcttttttctttttggcttattaactgttgagtgaaagacctatatccttccggaaccatttgctcttaccttggttgctggccaaatggggtttttattgttctgtgataacagcacttactgaatgtttctcctcttggatcaacgtttgctaacgtcttgttttcttcctgtctgctcctcagagataaggggtaacccccacctgctggtcaagtaccatagtgggttcttcgtggacgggaagttcctgtgttgccagcagagctgtaaagcagccccaggatgtaccctctgggaagcatgtaatgtgtgattcctctgttggactggacgttgggtggatagtgctccattaggctaaacctgccagaggccagaagagcttgccagaaaacaagatgtgccagattggttggcatcatgaaaattcagccttgcagatgctatgtgacaaatgaaatctcattctagggtcaattgagtcatggccattaagataataacaatattaacatctgccattctttcatttcatgagaaacattttaaaaatttgaatcattaatcaagcaatgagctgttatttcctcccataatttttcttggttcaagataaactccaaaaaggtagaatatgttagatatgtcatcatagttcaaacagctaggtttccagtttggtaagaaaaccagctcgctcttcgtataaataacgaaaatcacaaactgaaaaaacaacattattaaaaaaaaaaaagatataacttaagtaacacttttcatcaccatgtatactaaaatgatggtcaaattttaaaatatatatttaaagcagttcgccattctctatatgtgtgttaatttcttaatgacatgagagaaggggctgctttacgtgaaatcagattctatccagagttgtactcccagggaaacaagagggacttatatgtatttaaagtttataattatttaacataaagttgttgataaatacaaaataggataacttattttggtaacagttttaccagcctggacaaaatatgcctggattacaatggctttaaagaattgaatgagatcagctacaaaatagaacttcatgaaatggaaaagatacaggcacataaaatattttttaaattcacttcatgacagtattgatacccaacaatcatgttaatgttaatactggtcattttacccccaaaaaatcaattaataaatattcattgtgttttccatcttaattagactatacagtgaatatttattaatctcaactagatcacattgctctatatactcatgaattatagttatttaatgaactatacagattggttgcacatgggtcttcgctccactgtaagggactgaggagtaatgtctccttatggtattaatcattttccccagtggttttgtctatggtctatttggtctattatcattacctagcaggtcagattccagctttgacaatgccctaactttctggaaggagcaggaaaaaggccagagagagcactgccttgggattgccttcctaggctctgtctggatgacactcaccatgtgttctgggtgccacaggtgctgtgcctctgaggaaaactacagagtgtagaggtgttgcagctcctgagcagctgtaatactgtctatctgtccaagtataatttattcccttggcttcttctgctgagctactgggaagtccatgggcataacaactaaaagagaaaaagttaggtgtctttatttctttttgtccaagatgccttgatccatcctctttccaggatacatggcctacataggagttgggccttatataggaaagctacagaatcactccagatgttgtgtctggattcacttaatctggagtattgctcacacaagctggttcattcttttaattcataacattgagtgtttctctttgttttgtttaaagttccttctgatattactttgttttaatgttcagatgctaatctgcatactgcagtcaatgaagagaaacacagagttcccaccttcccagacagagtggtaagtcaacattttaaaaatgtttttcatggtcaggatatattaaataaaccaagagttgccagattcaagactagaaaatgtggaattcatttagacttctcagcaaagagagaaaaaccatgagctctagataatagctatgggtggtattgaatagcggattcaaatatagaaccattgtaatatctcatatttttgcatttcattgttgtgtcttttcctagccagtaagcccataaatagtcaccaaaaaaaaaaaaagaaaaaatgggtgcatgcgggagatgtccttaagatggcatcacacataacaggcagctgttattagctgtcattctttccttaccatcaacatggccaagactgctttgtggaagtatcctggtgttgaaatgaaactctataggacaaaagcagaaaacaacataattctttccctccattatcccttcaaagctattcagtgggctttcttccctgcttccaaataaagtctttgccaaattccatagttttgcagtcattctcaaatgataaaaatgtccccattacttgtaatcataagaacagcctctgaattgttccatccaatgttattatcacatgactgcaaacatcattccaagttaaacatctgtcacctagcttgggcctgcatcacctggcagcatgcttttggggagggattttgggggggctgagattcatggccctttcagagttagttccaaggaagatgaggtctaattaaaaaaagacacacatagctgtttctatcatgatttggtggtggtggtatcggagtgagttttccagcactgattctttatctcatgggagacttttaggaatttcctactgaagggcagatccatatgtagttttatgacaggggagagatcttgatcctcagttcttggattttcagccctcaatctttcaagatggctgtcagccaactttttcccaagagtggagttggcctataagaaaacaaacaaaaccttgattgctctggttaattaagctgtatgtagctctctctcgaagtacaggctactgctgtctttttgctctactctcttgggttcatagccacagccttctgtttttagggttcccaggcaggtgtgagcctcctcaaatgccaggatacacaaaaaatggcttcccattggttctctggaagttcacctgaaagcaaggggacatctccgcccatctattggatctatggtgtcttgggtacttattttcagctacacacattcgcacacacttctctctttctaagtaaaagccacataattttcatgaatcaacatgaaagacaaaaataatccattattgtagtagactgaataatgtcccccaaatttcatatccatgtagaacctcagaatgtgaccttattggaactaggatctttgcagatgtaattagttaaagatcaagatgaaatcacacgaaagatgagagtgggccataaatccaatgactagtaagatgagaggacacagagagatacacagaggagaaggccatgtgaagacctaggaagagattggagttatgttaccacaggccaaggaacacctgtttcttagtccatttgtgctctactaaggaatacctgaggctgggtaattgataaagaaaagaggtttatttagctcaccgttctgcaggctgtacaagtagcatagcactggcatcggcatctgatgagggccttaggctgcttccactcatggcagaagggaaggggagctagtgtgtgcagaaattgtatggtgagagagaagaaacaagagagagggaagggagatagcaggctcttttcaacaaccagctctcatgggaaatcatagagtgagaactcattcactaccatgagaatggcactaggccattaatgagggattcgcccctatgacccaaatacctcccattaagctctacctccaacactggagatcacacatcaacataaaatttggaggggtcgaatatccaaaccatagcaacttggaaccaccagaagctggaagaggcaaggaaagattttatcctagaggcttcagaataagtatggcaatgctgaaatgttgattttgacttctagcctctagaactgtgaaacaataaatttttgtggttctaatccaccaaacttgtagcaatttgtcatggtagccctaggaaacaattataatcgttaggagttttactttgttattagcaacattgctgtttgggtttgaaaatatgtttcagtcctgaagcttgaaaagtatggccctctaaaacacctaggagaaacgcccagattaggcaaatctatagaaacaaagggtgatcagtggttgcctgggaccagagtagggatgagaattgactgcaaataggtatgaaggatcttattggagtgatgggaagactgggctgtggtgatagttatacaagttgataaatttacaaaagtcactgaattctgcactttaaaaaggatgaactaccaataaagtttgttttgacaagtctaagagcagaagataattaagagccagaaaccattgcatctagtctccagcagggaactttttggccaatatattgaaaattatcagctaggcaaatcagtggctaagggttcataagcctgttttgattataagcttcccaaatgaaccagggatcagagggtatcatgtaaagtatgtttttctttgttttgttttttatcagagtattcagtagagggcttattttctgaatggaggaaataaaaatcagctctctagttgttctgttcaaagagatttccttaaatgatttccatttaaggaacttcctagtgcatttttctttggacataacccacttcacagctcataaataacactgtcctgcataattaaaatttccagaatgtcaaagccttaactccaagtaaatgaaatttctgaaaaactaaaatatagcatgaaaaaaatattaaatgcatctctttctgtcacacacgcacacacagacacacacacacatattgtgaatttttaactgaaatataacattaacatagaaaagcacacaaatcctaagtgttcagcttgatgaattttcacaaactgaacaattctgtataatccaccctcagataaagaaacacaacatcacagaaccccagggacaccctgatgttccctttcagtcactactaccctccaaaagtagttgctaacctgatttataacatcatagattgtttgcctgattttgacttttatatgactggaattataaagtgtgtagtcatttattgtgtgtcttcttttcttcaatttgtgagattcgcttatttttttagtatgtgattatatttaccgtcatcattgtatagaattcagttgtgtgaatatacaactgttttggtttcttattactgttctaacaaattactacacaaatttagtggcttaaagcaacatacatttattctcttatagtttggaagatcatatgtctaaaatgggtctgcacagctgtgtttcctctggaagctttagggaagattctgtttccttgcattttccagttcctaaggggtacttacatttattggttcctggctccttcccctgtctgcagaaccagaaggttgcaggacctctactctctaacctctgcttccatcctcacagctctctaatctctgaccaccttatctcccttttataaaggccattttgattacatcaggcccacccccacaaaatccagaatagttgccccatctcgaaatccttaattacaatctgcaaagtctcttttaccacgtaaggtattcacaggttctgggaattaggacatgaacatattcgggagaccatttttcagccttcaacaaccacaacatgtttattattttatcctcttgatgggcatgtaggcagtttctagtttttatctaattaaaataattctgctatgaacattcttttacaggtcttttggtttccctgttgtgtatatatacgtaaaatttatgagtcatagggtatgaccagatgcacatccagatttactagattctgcaaacaaatttccaatgttgttgtaccacttcatactccaaccagcaaaatatgagttccagttgctccatatccttgctcatacctttcttctttccttgcctctttccttcctcccttcctccctcccttcctccctcccttctctccttcctttctctctctttcaagagctgatatacttaattgtcagttcccggtacctgaatctgtgcctcactgtgatgtattaaaatttcttcccctccaaagctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaaggtaatccccagctttcagacgggctgcccagcatgtagagtaaacactaccccggctgccctggacctcagcctcaaagctgttgatccaggtcttaggctgtcctctcagaaaatgttcagtgcttgagccagaagtctggggaagcagtggccccactggggctgagaagcatagattttccatttagattatccaatctaatgatctcagtaatgcctgatcattgtattcccttccctttctcctccttctccccccaaatatctccacattccagaatacagaatctttaaaaatctatcctttatatgaaagagcttaggatgggcttacttttgtaatgtgcttcagtatcactagccaaatggcaaatagcatttcaagcaaggccatggcttgccttcttggaatgtacaacctcacctctcctgacctgattagtcttctcacagtttttagcctaaagattctatctaaagccagaattgaaaattccttgaaggcaacatgtaaattgtgtatgtatgtatctcttggtatggcactgaatttgccctacacttgatgcccaataaatgttgaattgaattgcaagatgaccatatggaaagggtcaagtgactccccttccttatttcctgtctcagacctccttcctatcatgttgtctactctctgccatcttctcactcagttatcagcatccctgcagggaagtcatgtctgcctttccccacaatggatacagagcatctctctgactcaccatgtatctcttttcttagttatttttcccatgtccttttattcctttgttctttccatcttcatcatttttgcctaaagccaattactgaaagtttcaataatacagggccatatggaatttgaaataatgtaagtgtgttcttcttgattttttttcagtataataagccatggtccctttcattccaaagtggagctagaatcctagtgtattaatctatacctggtgcccaaggtatggggttacatttgtgcgcctgcagcccaccattcttgtggaaggagaggatcagtaaacccagttgcaaggagagtgaaagtcatgttaattgtgttccaggtccccttcctgacagaaactccagtgattcattgagagaggtgtgaggtgaagctgactgccctgttttcaaataaccaggaggaactgtcgattcacatggggttgctgccattattgagtttttgacactcctttagatttgcacctccttaggtttagtcccaactgtggattttccctagaacttcaggaagctagttattttaacaaaggattgattgatcacctcttagcatgagcagcattgcatctgcaagtaaattataataattgctaaaaggtcttcatggagcttgactttttaaagtgcagccatgattcttatctcatatatgggataatactttttatcaactttctgtcattcttacaatcttccctgagcttctttttaatctactttctgtttagtaagataatctatgcccccattaaatcattcaaatattacagaatattccatttacattcccctaaaatgttttctatgcacatgtggccatgtgcatacaaaagcaagtaagttctcacgatacagtctttgtcatttgttcttttcacttgacatcttcagcatttttcctatttgaatacatgaggatacacctgacttttaaaatttcattttcatttaattttggtgaaatatacataacataaagtttaccatcttaattatttttgagcatacagttcagtagtgttaagtacatttacattgttgtgcaaattgcctgattatttttaatgtctgtaagtaccagttgtatagatactaggtaaacctaagtgatgcactattgatggacattctctaagtgtttttagaaacaacaaggctaaataaaagctattctagtgggcaaggctctttgggaaggtggagagagaggcattttagagtttaagggctttatctaggcattccttgaaatagagccaggggagcatttccttgctaaggaaacttgtttctatgaactgtggttttgaaaaaagtctggactatgaaggcaaacaggaaataggttccacattccagataaaacagcctttagactttgagaggtaggcacttcttcatgctctgcttaataccccaaataaaagagataaaatgatctatggcagaggatgatgaaaatcctccttatccatctgtgtccagaaggagtaaaaagatcagcattttcaagaattttaattgtagtcacaatagctaagaggaaaataagttattttaaaatatataagtgacagaatgcttgcatatatataagaaaatcagggcaaatccagtcaagatgatttattaatctagattttccattgtttaagataattatgagccattattaacaattttcttttgtttagaagtgttgccagactactgcttttattggaatgcctgaaagaaccaaaatgtgaaagtaactcattagcttaaatttcccaaacaagtgaaatgtgtgggtcaaaatgtcaaataaagctaaaacatatctgaacaaaattacttttgtcatttaaaatttataagtagacatatgtttataaacttataaaatgtctcttttttgcagtagcagcagcagtgaagatgttgcaagcagtaaccaaaaagaaagaaatgtgaatcacaccacctcaaagatttcatggtaaatcaaattcagatatctcctacatccagaatatgcttccattttcaggaaaactaaccaaacttgcaataattttgcagctaggctttctacttaaggtaaatataaaccaaaaaagtctatgtagtttgcctctctgaaccctgaatggatggcttttgggttctagtttttcttgaactgactattcctagccagcatccatgacatacaccagtagtagcaccaacattagtatacctgacccaggcatctctagcaggaagaaaagcaacctagagttgaataactcttccataagaatagctatatacacaacccaatttttttttaacttgatactacagccatctctgaaggagtcttcatctatttcgtgagcccactctttggaaaaagtcaaagaaatataagttcttctgggggcctcctggggatctcctgtatcaaagaaccattctttcattaaaacttggcataagcccaacttttgagtgactctctctttactgttgctgtgttgatactttgccaggtgcagaaggagaaacctaacaatctaaatgttatttaggtggataaaatcagggtgggatttgatattgcatggctacgcacttggattatttcttggtgcttttctgcactcacgtttttctcaactcttcttaagggaattccctgagtcaagttcatctgaagaagaggaaaacctggatgattatgagtgagtattgaaagtcttctgggttcttctaaaattagacatagatacttctactctcttcctcaaagacattaaaacagatggctgagaccgtctcaggaggctgtatttacatgggtaaactcacgtaatgttctgggtcatttatctagatgacaggtgacaatgagctgggttgttaccaacgaaaatattttccccaaaactggattatctaaattggatgcaaatacttattggatttatcgtatgtccagcgtcaccttcatttcactttacctttgtagatgtagcatataatgtttctgctcattatttctttcctggagacctctaattaaggtgatgtttgaaagctcttattaacattgagtaatatttttggagaagttattaatgatgcagtaattttacagggtagcacaaatgagaccttgaacatggcaatatttatgtcgacagatctctattcttaggatgaccttgtcattttttttttttttttttgagacagagttttgctcttgttgcccaggctggagtgcagtggcatgatctcggctcattgcaacctccacctcctaggttcaagcaattctcctacctcagcctcccgagtagctaagattacaggcgcctgccaccatgcccagctaatttttgtatttttagtagagacagggtttcgccatgtttgccaggctggtcttgaactcctgacctcaggtgatccacccgcctcggcctcccaaagtgctgggattacaggcgtgagccacctcacccagccaaccttttcatttaacatcaaaattgggatactttagaaagagaaaaagtgcactattaaaaattatacccgttaataataacttaattatacattttaaaataacttaaagagtataattaattgtttgtaactcaaaggataaatgcttgaagggatggataccccataatccatgatgtgattattatgcattgcatgtctgtatcaaaatatttcatgtaccccataaatatatatacctgctatggtgagccgagatggcgccactgcactccagcctgggcgacagagcaagactctgtctcaaaaaaaaaaaaaaaaaaaaaaaacaacacaaacacacacacacacacacacaaatatatatatatatatatatatatatatatatatatatatatacacacacacacacacacacacatatatatacctgctatgtactcacaaaaattaaaataaaaattacacctggacatttgacataaactggacttctgggcaaataagaacgtgtggtcaccccaactatactgagaaggttggcctaagtggctattaaggttctttccaaaatctaagggtctatcattctacaaatagggacaaataattgtctcctagatgtaaagattagtgttaagaagaggtgggaataatagagcatattgcatttctcagacacttgataccaaatggcacagaattcacttgaacactaggattatgcatatttccagttctgtttttgtacaagtgttgtattattgatttattgattacatgtgaaacgagagcttttacaaagtacatgctactgttttcactcctcctctcatctctaacccagcctggtcctagccatacctgttgcattggggaagatgtgctgtaccctccacatctttgtggcatggtctctttatcaccttctagctctctttcggctttactttcttccctaacatctattctcaggaaagcattgatggaataattcatactaagacataaaagactgagaatgaccaacgcatggtcatttccaaagataattgcactttaatgaaacacaaagacttaaaccaatgggagtgaacctctaattgtggattgtactctttagcatttaaataaattagaagtctttccctgattgggtaagcccagatatgaccatttaaacagtctctattcccatcttttctgaatgcaagtggtgtgtgagagacagacattgaggaaattatcagggaagacttgtcctcttcaaaatcaaaaagataccaaaaggagctcgggattatagggctataggatctgggactcagtcacctcacattgtgcttaatgctcccagcttcctattctatcagtgtcatgggagtttttgttttatggccataacttcatgagcaattccagtcaattccattaaagacagaagcactaagccctgagatttagatagaaaatcgtgtgttaagactaggcctggccaggtacagtggcacatgcctataatcccagcactttcagaggctgagctaggcagatctcttgagctcagaagtttgagaccagccggggcaacatgacaaaacctcatctctacaaaaatacaaaaattagccaggtgtggttgcccattcctgtagtcccaactacttgggaggctgaggtgggaggatcacttgagcccgggaggtcgaggctgtagtgagccgagatcataccactgcactccagcctatgtgacagagtgagaccctgtcaaaaaacaaaacaaacaaaaaaaaaccttaggcctaggactctgctgctctgtcattgaatactgaaatattatttaaaacaataagaggcaggcctcagcaaaattatgacacaggcaacgtttgtatgtgtgtgggaggtataatgtatagggtacataggttatatcaccttgcctctccaggcctctctcctgattcttgattttcttccttctattcccctgtaggtatatatcctgtatcacagcccctgaagggccttttgattagctagtattaccttaaaatgttgactaataagaaaaacgatcagttaaaatttcaagtgttagttatacagtatccataatggtagagttaaaagagactttcaaacttatcaagatcaaccctctccctagttttacaggtagggaagtccaaggtcaaacaaggccaagtggcttgttcaaagtcatacaattacacatagggaagttatgcctagaacccagacctccaagctgggtgacctaaggctctttctattttattgagctgtccaccagctgacatcccttcccaaaactcatacagagattatacaaagaatcacttcccatccattcctgccaagttctgagataccttctacattgaatttctcctataactcctcccttctaccctcacccccctcttgtacttatttcctctgcagatgttatcttctagccagtgggtcctcccactcacccaaacccatgctacatcccacctcatgccctgcttttactcatttcctaagtaggacattctgtctaaagcccaaaggccacagacattattgccctcacatgagaaacagctcttggcctgttgagctccacatataaagtaaaagcatttgatgtgaaaatagatgttataatcagattattacaaggaaattatatgattggaagacaagagctttcatccttggcagccctgactttcctcttggaatattcttcataggtctaatctctagcccttactcaaaatggtaaaatgtaggaaaacttagaagtcacctagaagaaaaccaaagattcctaaatgccagcccatttaaaaattagatgtgcagactccaccccaacatcagaatttagtagtggggacttaagcatttgtatttctgaaaagctcctcaaatcattctctggagcagttaggcttggaaacccctgaggtaagccaatgcctcattttacagattagaaagttgagtgtcaagctatacaatctaaaacttattgattctcacatataatttttttccttttgcagctggtttgctggtaacatctccagatcacaatctgaacagttactcagacaaaaggtaaatagtcttgtctttaaaacagcctcacagaatctctttgcattttggggtccagaggttgatgcatttctcatagaaaccttcctgctaattatatagtcaagtcattgtagtgttgcttgtccagtctgtgggttgcccgactcttcatgtctagccactacttctgtgtccattatgtattgctgcataataaaccactcctaaattgggtggcttgaaacagtgggatttatgatatctcatgattctgtgagtcagctgggccagcagttcttaggcaagttttgcttaggggcactcctgtggctgcatttgggtcgtggattgactgggggcttgggtttagctgaggcagtcaactggagttccacagttcttccccaagcagtctctccatgtgcctcacttgggcctcctcacagcatggtgatctcaaggcagtagttgaagaggacgagccccacagtgcaagcacttttcgagtctctgcttttgttgtgtttgctaaggtcctattggtcatagcaagtcacatggctcagcccagagtcagtatgggaggggactgctcacagcatgaataagagagatgatttatcggaggccgtcaatgtagccattaacctcagctctgtcactgctcgttagcacctagaccagagtatagcagatgtgatacagaacatgtttatctgactttattactaattgatatggaatgccagtagcaaactcttttgatttctaaaaatgacactttgatatagtttaacctgataaaaacactaaacattacacttatttctttgaggggtgctagtgagaatgtaatgacttcatttggcgttttgtcacattcatagtttataatctgctctttctgaactttgatctgcttagaattagcacaaatcattgagaaagacaacttgagtatagaactttatcaactgatttattcttgatctttggttttctaaaaccttccaaaggcatgatacggtgatacacggttctaaattgtatttcttaaagatgaaaacattaggcttgcataagcacaacaccgagaaaagtaagtgatagggttaaatattaattggagaggaagagttcatacacatacacatacacatagagcagatctataaagagattgagtgagaaacctgtgccttttgtgatatataaagtcaatctaaaagatttgttttccaactacctaccatgcaaaatcattttcaagaatgatgaaaatattttctattccttctatattttccttccttttcagggaaaagaaggagcatttatggttagaaattcgagccaagtgggaatgtacacagtgtccttatttagtaaggctgtgaagtaagtatgatacggattaatttcttttctctttctgcgtatattctttgaatatgctggtcacaatcacattttgggataagacatcatctttaaactctggaattttaaatcaaagtatttctattgaatgtgaccatttgtagttgcctccaccactctcaccccactgccccaccatccttgccccactactttcaagaggccattctctggctaatcctctcctgccccactccaggcagtaacagagtgcccagagcacagcatgcctcagtaaatgtttattaagagactctcgggtgattccctttcattcaggtctaagcctggaaagaaaaaaaatagcaatggagcgtctatactctcagccctagccacctgctgagcaaagatgcctactccagtgtccagttcttagtaagcccttccactgggtgcagagttagcagaaggttgactcagtgctgctgtgttctctacacagcttccttccagggctctgtcctctttgtgtgactaaaagttcttgtttgaagccaaacttctagatccaaatcctggctctactatttcaatagggctttgtgacattgagcaagtttctcagcctctgtgcctcaacttcttcatttgaaaggggaacataatgattgttacgttctatgagtggggtgagttaattaatatattatatccagaacagtgcctgacacatagtaagcacttaataaactaatagtacttactattattgttgttgttgttgctggggaagggtagttctacctgctccactccctgtaccctaacacttgggcataaaagacaccccacagtcatctcatgcaaatcatcatcaaaatccttctccagagttttacaagccactttcttattggtagttagctctttttttttccttctaatcgtcctccaaagcaaatgggaaagctgtttttatttataccatattgcagatgagaggattgaggttcaaaaagagcttataaagacctacctggagctactaagtgactaatttgaagctgggcttccaatagccaagtcatgtttctttatctacacctctgtgtttacactgaacccccagtgttttggaatgagaatctggtcaaatattgattcggatcttcttttaaatttctatgtgtgcaactcttttttagcagctagattgaatgatcgtctgccttggtgccttccccatgtgccctaccccacagtgcatatatgtatatttataataattaagtaataaaaacgttattttattttgaaattttttacagagtgcctacctacacttgagataataggatgtacctgaattgtcccacagcactttccaatgccagaatccatgtccccagtgtatctcatatattattttgcacatggtaacacctggatgctggctaaagccaacccagtaagaatcaggagaagactttgttgactatcaaaagttttgtggccttctggccctgcagtttcagccaaacctggtatcagatgtccttgtagttgagtttcttgactacagattcattttttaaggtagccaggtagataaatcagcaaatagataaagaatcaaatgaatacagaagccctcttttatgaaacctcatcaatggccttgagtgaattgtatgctgacaccaaaagctgattaaacatttgcagcaaagagaagaaccatttctccttttgtacttgcaatttttactcggttgatgttacagcaacaattttttaattttttagcttttattttaagttgattggtacatgtgacaggtttgttatataggtaaactcttgtcatgtggctttcttgtagagattatttcatcacccaactactaagcctagtgttcaatagttattttttctgctcttctccctcctcccaccctccaccctcaagtaagcctcagtgtctactattttcctctatgtgtccatgtgttgtcatcatttatctcccacttacaagtaaaaatatgtggtatctggttttctgttcctgtgttagtttgctatacagcaacaatttattaactgtttcttatatgccaggcataaccatataggtagctagcaagtgatagaactaaactcaaagcctggttcttgaccactatgtcattgtctacaatctaagacaggtgtattattcctgattagcttaaatcaacgtgcatcaattcagcattattgtataaaagcagaggaaaagaaaaaagtgttttatgtggagaaggtacaagttcacatgaggaattaaaggacatcctcacctacttcattctgcatgccccaaaagagcctcctcccatgttttggggtgaggatacccaacagcctaatcacctttacctctctcatttccacctccattattatcctataagataatttatgttcagaataatgatcctgaagaactacaagcctctctcgatcatcaaagaaagattccagttttatacacttactaagggaggagaagcctggaaagttggaattttactgtacatgaaatctatatgtgcaccaaaagatacattgagttcagagaagaactctcttccataattacttttatagttacaccagatttcaagactgagaaaaacaccagatgccaagcctgagaaaacctccctgacttccctctccaaaatttgcaaatgcacctaaaataattatttaacccttgcttaatcaagctttattgtttattttaaatgttctaacattctttctgttactagtgataaaaaaggaactgtcaaacattaccacgtgcatacaaatgctgagaacaaattatacctggcagaaaactactgttttgattccattccaaagcttattcattatcatcaacacaattcagcaggtaacttattttagtttttcttttatgggcccttgttgtaaaacagcaattttcctggatactactgatcctcctaatattcttaattatatagggaaccatgaaagtaggaaaaaatcctctcaagtcttttgcctatcataatttttagcttacattcccaggaatataacatgattctctccttaatgccagaaagaatgaaattgagtaaactgggtgacttagaaagagaaattctctttataaaaatattcgtagggtttttctgtgtatagaagcaagaggattataaatttaaaatattatagaaatatatacatatcgttggatcatggaccagttgtctattatgacagggttttttgcatgctgccactagcacttactaatcattacatatataaatagaaattatatattatgtatatacattacatttttacagagatgagatcattctacacatattgctcagcttgctttctttactcaacatgtcttagaagtctttccacgcaaacacaaagagcttactttggtctatttaacagctgtgtagaattctatcatagttaccccataatttattcacctagccctctgttgattagcagttggatcatgtccagtattttcacattataatggatgtttcagtgcacaattctgcatgcatagctctgtccatctatatgaggggttctatagccaaatccctagaaatggaatttctgagacaaaggctaagaatacttaaaatgtacagattgccaactgcttttcagaaatgtacaatcctactaacaacattttctttcatcctcaccaacactgggtgctattagtcttctaaatttttgcctaatcaactggtggaaatacatctagaaataccctctgttttctagaatagtgccacttaagagcagtggctggatgaatttccaacagtgagtaaaaataagccataagctcagcacttaatttgtgttactttatatgacttgattgcatgcatgtaggtgaattgacctcacttctggctttcattttggctcttactgatgtttttcctttgccccaatttcctcaattgtttattttaacctgtagtacctcagaagtaccttttgtaaaaggtattgcacaaagagatgcacaggaaacttcacaggatatcagaaggaaatattaagatgtttatttatatttggatttttatctcattctcttacattttctgtttgtgagtttatttttataattcacaccaaatatatattttatagaaatgtactaatttttacattttaattaattaatttagttgattaaaggtaaaggattttaaaagtttggagaccactcatataaaaaccagacaaatatatagaaaaaggaaggaggggaaaagtacatgtgtgatagataggtcccttgacttggagagcattccacatttaaagcaaaaaacatatatacatatattttaatgggttctttcaagccactattaaattttataattactttaacccagttttaccataactaaatataaacaattaaaatggcttgaccacttaatgaaacttagtaataggttcagtttttaaaaattcagatggcttattatttttacccttctgtattgtttgaattttttgtcaaatgtatgtgctgtgtgtatacatattttaagcataagattgtaaagagatagcaaaaaagaagggggagaattttaaaagattacatcatgcaattaatttctatgggatttttaaaaatcacatacagtgttttattcatttaattttcgctttgcattaagctaattagtcaagttaagcacaactacaactgaatggattctctctctgcattacaacattctgaactctttgctttttcagccactttggagagagactagttgtgaaccaatgttacataatgtgatgggatatgatataatgatgtgatgatatgatgctgattccattgcaggcatgatcacacggctccgccaccctgtgtcaacaaaggccaacaaggtccccgactctgtgtccctgggaaatggtatggatacatacttgggttcttaaactccattttccatcattttttatttaaatatatggttaatttactggcaaaaaaaaaaaaaaaggaggaaagacaggaaggaggcctctgttcagattgtatcaggaaggattttctttaaaaaaaaaaaaaatctgtcctctcaacctaaatctgtaagcttctagaatcaccaagaagatcatcaatttgttttcttatcagaccccattattagcctccagcacaccattgtctgtcctatctttttcctggattttgtgcccactgagcagagccagtattcaaccttgtgtgttaggacgatcacatccactgcgatcacagtttaatttttttattaaaaaaatctgacaatgttttaccaatctaaggacatcgagtacattttgatgctaagcctctccaagatgcctctgattggcaaattgtttttactctgagccttcttgttaaataactgtagctacttcaagaatagtgttaccctggtgccattatcacgtagccacaagaccacatcactaagggtttttttttttaacttatcaacttaaaataaaaagtcttgtttatattgtcactgtgaaactcccattggagaagaaatcacttgggaagctgttagccccaaagctttctatgctcgtcctaaagaatgtccgtcttgccttgttaggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgtaagtttttcccaaggaatggctgtttagccctcatcatgggagggcattagcactaataggcctgctgttaactttgcaaggcctagagcaaaagtccacatactgtatcatagacataaatatttagaagttataaattgaactaacagactattaaatcaaatcagtcttatgctcctactttgacaaatataccttcataacaacctgaaaggccatattcaaattgagaattcccaagactctacaaagaaaccagcctctggcctgtggtcttccaaactccacccctcctgcttctcccctcatacccaactccgtcctgcactataaggggcctcagtagttatgtacagacacagcattcagtacacacaagctccctctttgtctcccgcaaacaattatctagtggctaatgatcttggctaggggtagtgtgctttacccttaagcggacagactccttaaggaagagtcagcacaggtcctgaaagaggcctcaggactatatggttgggtgatttcagagtcctggtgctctaagggtggcagagaaagggacatatagggtcggagtaggcatgtctccttggccctgtggcctccttgccctgtggggaggtgcatggtgggatgaagaacagagtggggctaccacccagaactaatgcagtactgaaaattaatgctctaccaacaatatccttttccttcttggtaccttcaatacagtctaatactcttcctaatgtgtctcagctcccagcacaacagccttcaattattggcaatacatatgtgttctctttccctctgtgtcttctctctctctctctcttccccctctctctctttctctctccctctctctccctcttcctctctctccttctctctctctctccctctctctccctctctcagttgtatataattctccctcttcttgtcaacatagtaaatcagactttgtagagtgaccaccattcaggtttgctgaggtctgggaggttttagcactgaaagtcctgtgtcctaggaaacctcccagccccaggcaaaccaggacagttggtcactctacttttagagaatcaatcagtatggtatgaaaaatgatgttatagtaggtctctggtcaaaaatagttgaaataaaaaaattcctagcctgctagagattgagagcactttttaaatttttacttaaacagttatactgtacagtgtttacaggcatttctctaagcactttacaaatattaactcacttaatccccataagaaacctatgagggttgtaccatcgttatcttagatttacaggaaaccgaagcacagaaatgttgaataacttgtccagagtcggcaagctagtaaaagtcgaaaagcagagatacaaacccaggcagacattctagggtccatttctttagttattcttttatgaagaccaaaggaattaggaaagtcagaacaatcacttttaccataattgcaaaattatttggaagcagagatgctatgtgaatataggcctttggccctagctggcttcatgggcatatgagatctgcacagttgcaagggcctagaagtacctagtacctagaaggtacctagaagggcacagtacctagaagggccctgtgcttggtttaatgctctgctgttgtcatcttgaagtaatacttcgtgatttttaaacaaggattcctgcattttcattttgcattggtgcctgcaattatgtaactggttctgccttcagtgattggactgtcataaaactgggaagggggcccctgatattctcctcttgtaggacaggaaaatctggcagaaactttctgccagatttttctcatggttacaggctcatgatgtaacctctgtgtcttggtgtaactttaaaacatatttttgccattaccaagctggtatccataaaaaaatcacaagaagtcatttaaaaacatcacctaatcataaagaaaaacgtcaaactgtgccacaatgggaaaaagtctaatcccaaatgtaggggtcaagctgaagcctatcatgtggggaatatcagttaatatggcgccctcaccttgagccacctgggcagtgactgaatttgttcaaagaatatttctttattgggtgatggacctttgtgccatcacaagccttccctctgaagggagcagtgttgagtaccatgcaggtctccaaaactgctaaaagatgaatactcccaagctcatcaacttgagtgacatgataagcattgtccctatagttaaactaagaaggaagaaaataactaaaaatttaataaattcttattaaaatatttaaaacttcacatgttaaatttagatttctttacacatttgaacattacagaataatcctgtaaattgttaaaattagattaatcatataagaacaagttaatgagcttgtaaaaactgagtgtcccttctcaaaagaagacatttatgcggacaacaaacatatgaaaaaaagctcatcatcacttgtcattagagaaatgcaaatcaaaacgacagtgagataccatttcacgccatttagaatggcaatcattaaaaagccaggaaacaacagatgctggagaggatgtggagagaaataggaacgcttttacactgttggtgggagtgtaaattatttcaaccactgtggaagacagtgtggtgattcctcaaggatctagaaccagaaatatcatttgacccagcaatcccagtactgggtatatattcaaaggattataaatcattctactataaagacacatgcacacatatgtgtattgcagcactattcacaatagcaaagacttggaaccaactcaaatgcccatcaatgttagactggataaagaaaatgtggcacatatacaccatggaatactatgcagccataaaaaagaatgagttcatgtcctttgcaaggacatggatgaagctggaaaccatcattctcagcaaactaacacaggaacagaaaaccgaacaccgcatgttctcactcataagtggaagttgaacaatgagaacacatggacacagggaggggaacatcacacactggggcttgttggggggtgggggataggggaaagatagcattaggagaaatacctaatgaagatgacgggtgcagcaaaccaccatggcacatgtatatatatgtaacaaacctgcacgttctgcacatgtatcccagaactcaaagtataataaaaaaaaaaataaaatttaaaaatcaacttctgcgtggcaacaaaacaaaataaaaaccctatgcaaactaaaagacaaatgataaactgagcaaaattatttgtaattcatattatggacaaaagactaatctccccaaaaaggctaatacctccaaactcattaacaactacactactgcactgtttgtttgtacaatggatcactcagagtcagctcagaatctaagagtaaagtacatgtcaatccaaaaatgtgtccaaattcactgaaatacaatgtagaacagaaaagaaagagtaattggagttgctaagtactttcaaaaggctttatgcttaaccgtgaagacagtaaagagagtaaagcagcagttcgggagcctgtctggagaagtaaaggtgatatggcagcacactgctagagactccgctagacatttagcttaacctatgcatctcacaaatggaaaaaaaaaaaaaaagataggtgagaaaagatatcatgagaaaggtaattaaggtagaagaatcacactttacaagaaggtttgcttgatttcttttaagctctaggctagtacaaaatttaagattgatattacttaaattaataagaaacactaaaggactcttcaattcgcaagattaaacacttccatctggaacatctgattactaaataatagcccatagctacattacgctccattttcttctacttaactttatcattttaaaaagggtgctgggaagaggtacggtaaaaccatctgccataataaaatgaaaattatctcattaaaaaaaaatctgagtgtccatgccatcatgacctaccagaagtgctacatcatatggttagtattttataaatttgttattcaaaaataatgaaaacaataatgtaaaataattttttaaaaaagaaaaaaaatcaaacctcatctgacttcatttagcctacattcttcgtattctaatatacttttttagaatgaaatatttagatgtgaaagttaataaaagagaaatgattgttcttagggtgtggcttcctctaaataagtcatggacgttcccaggatgccatgagactcaacagggtttccagtgcaacagaccattgctaccctgattctctgtaggaaagttgaatacagcattcacaaactgctaaattgctgctgaagtcaccaatgtctgatatgaggcagaaattttttttgcctccaaagataattgtgcttgaaatataagatcctaaacttttccctctctttctctgttcaagtgaaagagggtgggggtgggaattaaaacaaacagaaatctgagagcaactctttttcagtacatgtagaaaatggagtgtggagcattgaactttgaaaatctgttatttccaggaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggtaagcaaagccattggaatttcaaagaaaagaaagcagtccacggctcccacttctggagatggggtcactggtagggaaggcaagaagggcaccatcacttctactttgctcacttgtgacttgtttaagcaaatgacatttttacaaaaatcaatgtaaaaatatttgaagtatggaaagaacagtgagaataaaataagctgttaaggtctacatagctgtgttgtggcaagaaggagaacagatggaaaggaaagacttctgccaatttagtgtctctcaaaaccattaaacccaaattgaccttcatttcaggaagggcttagtgctaaagcagccatttgatacaataactgaacatgaaaaaaaaaaaaggaaatagaatttgtgtgtctttggatcagaatgagagtggggaatgctgtgtttggtattcactgggatttatctttagagattttcttgcgctcaacagtagacctgcattcacactaggccagtgtgttccctaagtcacaggtgcagcgtttatgccttcaaagcatctgtgaatgcacggtatctggtggtggaaagggagattctagaaatttctcatctttccttgataagctaaggttctgtgtttaaagtgtaataccttttcatgttgtttgacaaggatggatgcttggttgaaagtactcatgggagaacatttttattttgaaaaattgaaaattgcaaaggaaaaaaaagacaactttagagcacttgggggttgtgctaggtaatcttagattttgctgagaattctactcaaaaggaggaaaatgtcaggagattcttggtcactttcactacttggtgattttgtttttcctttaaaggctgctcgtaactgcttggtggacagagatctctgtgtgaaagtatctgactttggaatgacaaggtaagccaattccgaaagggcaaccagtgaaagggggatttccattcacatttgaacaccatcataattgaaggctttgtggggatatagaaggtgctctgaattgggggcttagaaacctaagtccctcccatgggattgttcttcagaaattatctgacgtcacttttagttctttcaacaatctgatactttctaaacttctaaataaattccatgaaagatcctaaatttaaatacaacatgttacagccacattattggattgttttactttcttttaaatttttttatttttaatttttgtgggtacatagtaggtatacatatttatggggtacatgtgatgttttgatacaggcatgcaatgtgaaataatcgcatcatggagaatggggtatccatcccctcaagcattttggagtactactcagccatttaaaaagaatggataaatatttataattttttaactcaatcaaggatctgctagctctttttgtctgtcattaaaaaaaaaacctgatgttcaaatgggtagagcattcacactaggaaaatttttgttgtcacatcattagattttctgcatcacaaagtaaggcataaaactagactctgagattctcttgatgggcattctaccaccacttaatgatgtggaacaattattttgattacgatcgtttttttaaagtcttcttttaccttaatcctgtatcctaatactatttaagcctcagagcaaattttcatagttttgcaaagaaaacgaagacatacacattaacctttctattcaacatttattgagtgcctactgaatacctcagtcctgcaggagatactgatatgaataggatagtccctgctctcaaaatgaccacagtttagtctagagggcaagtagatatccctgacattgagacaaaatataactataaagttgtgctgactcaatatgtaattctgaaggtgaataatgcagtttaaaagagatctgaagagttgaccaaggccaggttaatatttagcaaacattgccctaaaatgccataggaggatctgtttttttaatgtcttctccaaaattcagtgttaggggatgctttttgacccttgtggcacataccgtggaagctatggtaattcctctgggagccctaaatattggcaagatgtccttttagctgtgtactagctaccgtcactccaaccaccatacactgagtcccctacactgaccctccaaacatgtagctttctcaagagcaagaaaaaaaaaatctgctgacaggttcttaaagcagggagaagctcccaggtcaagggaactgatccccacctttactctaaaagcaagaatattggctgttatgccagcatccagggaacatgctttcacgttctctgtagctttggaaaagggagacttttccaaaaaaagatccaaagaaaaaagagatcttgctctgagtaagagatcctggaagccatgtaccagccctgttggttatgaagctctgtggccacatcaattagatgcctgtgacttcatttgctcctactagcttgaaggaaggtttaagccatgagcatccccaaaccaggagtgccagggtagtgtctgggtatctggtagtgtctggggagctgaggggttctggggagaaaagtatggaatgtactgtatgtaatcctatgaaagtgtagtttattaatattattgttaatatttagaaggatgatcttcccagccagctattttaaattacagtgagatctctaaaacatttggtgtgtaaattatatccaaaattccaattgccataactcctgttgttctattttctctaattaagagtcattatgtgtttgtttttgttgtggtttttgtgggcaaatatatgatgttctcttttattaatactataaataatatgtacttattataagaaaaatagcattagtgtagaaagtaaaaagtagaattgttagcagcagtgaatccgtaaaggtctgcagcaactcaattcttgcctcctcaaaggaaaggattcatctgaggggcataaggcagagagagagactgaggcaagtttttgagcaggagtgagagtttattaaaaagttttagagcaggaaggaaaggaagtaaagcacacttggaagagggccaagagggcaacttgagagatccaactgccctacttggcccttgacttagggtttcatacattggcataattccaaagtttgcatcttttctcccctgattcttcccttggggtgggctgtctgcatgagcagtagcctgccagcacttgggaggggccgcacgcacagtgtgtttacttaggttgtgcgcatgctcatttgaggcatttttcttttaccagtcgagtattcttagaggaaggtcatataccagttaaactccattattttgcctcttattgcgcatgtttgaccccagttgcccaactcctgagatcatatcaggaagctgttgatcatcagcttcaagtattttctatctattgggagactgccgttccctggcaccagctgcgaccaattattattttagagagacggttaacaactgcctgactattacctgacggtcacctaatattcctgggttgggggtgggggatctctcctgccctgctcatgtctgcctagctacctattctgacagaatctgtccctcattttcagtgctaggagtaaccactgctcagatgtttggtgggtatcctttcagacctcattcttaagtgtatccaatcatatacacaaatatgcacatttactacttgttcccacacacaaaaaatggaatcacattatacacactttcttttgcacataaccatataccatgagcacctttttattttggtgaagagttatctcatttttgaatggctatgtgctattctattgtgtgagtgtgccataatatatttaattactcctcaacattgggaacattgaggttgctttcattttatcattattacaaacaaagagtttagtgaacattcttcaacatgtattttggtcttgatatctccataggatatttttgttcatcattattcataacagcagaagattagtagcaatttacctggttaaataaattatgtttaattccttccataagaagaaataataagagggaatggtattcagccactaaacatgatgctgcagtagaaatgtaaccgtatggggaaatgctcatgatataccattaaaggaaaaataaaagcaaatctcaatataacagaaaccctattttgttcaacttatatatgtgggaaataagatcagaaagtacaaagaaaaatgtattttgagtgatagaattacaggttatctttagggtgggtttctgagtaattttatctttacttttttgtgtttttctatatttaccaaacattttgcattgaggttttgctgtattcagttagatattatcttttaaatgcttacaaaccataagcagcctccagctaagcccacacattgaaaggaaacaaaagttccagaaaactgaggcaatcgactgagactctgggtggcttccgtgtccttcatcagcctgtaccaccacggcttaaggtctgtgttgatgtgttttccctggcaggtatgttcttgatgaccagtatgtcagttcagtcggaacaaagtttccagtcaagtggtcagctccagaggtgtttcattacttcaaatacagcagcaagtcagacgtatgggcatttggtaaggatgtggccacatacgacctggccctgtttcataagcttacttccacaacaggaaaccacaagagtagcaatgtccattttaaaagggcccttgaacacttacgaagttacacatatagcctgagagaagcaagctgttgaagaaggtgatttattttcttgggtttggtattaggatgtcttctacacatcttgtaatttacatcctgctagcactttctcataaaatcaaaagggataaatctactcagaggttgaggtggaaggattgtttgagcccaggagttcaagtccagctggggcaacacagttaagaccctgtctttagaaacatcaaaggggatgaaagtttttccagtgaagatttcaaataattttttaaaaggagtcattgaaagctgaatctgagtttttgctgagccccaaacgttgaaaagacatcaattttctgcatgaaaataatgggatagccattcccttctgcgctgaccaattcttagtgtaaacaccacacatgacttggtactttctttgactcgtgcctagtttcaagtagtctcctctctgttaaaatttatattttagattgggattggcaaaccacagcccaggaccaggtcagttggtttttgtaaataaagttttattggaacacagtcatgcccattcatttatgtattatctatggctcattttgtgctacaacagcagagtagagtagttgccacagatactgcatgtcccaaaaagtctaaaatgctatgtggccctttataggataagtttgctgactcttattttactaaaatatctatattaaaatttagtaaaggtcattagaaaagggaaacaattcttaaattgtgactacattttatgatattttttctatgttgtgagaatatcaaggctattttcaatcactgtcggatggacccaggataagtaatccaaatgtgactgagacctatttcatgccttagttcataagtgtaatttgatttactgcttgtcacctacaagactgcctttgaaaaggggaaaatttagttatttatttctctatgtgacacaatttttaaaactaactattccctttgtaaaagtggcattgttcgttgttaaaaaaaaagataatcaaatacacacagaaaaagaaaaaaaatcacaaagatagcattttggtgaatacttgatgccatgttgtactgattaacttttgtaccttgttgtcaaaattagttttgaggctgagtgcggtggctcatgcctgtaatcccagcacttcgagaggctgaggcgggcagatcacttgaggccaggagttcaagaccagcccagccaacatggcaaaaactcgtctctactaaaaacacaaaaattagccaggcatggtggtgcgcgcctgtaaccccagctactcgagaggctgaggcacgagaatcgcttaaacctgggaggcagagtttacagtgagctgagattgtgccactgcactccagccttggcgacacagcaagaggctgtcttaaaaaaaaaaaattagttttgataatcatgcatcaattataagtgatagcaaaaaatcaatgccctaatttaataattacagcttgtttttgaccaaaaaatagtattacccagcttgattatttaccgtatgccatagaagttggccccagatattttccagctgtttataaacactaaattcattcttaaacaatatatcccagtgaggatacccaaaatgaatcagggcctctgatagcaattcccaaagaagaaccccacagatattttgaaataagtgtgtagccttccaaagagaaagttatgaggaaactgcattcttttggattgttgttttagactgtgtgatttaaaagaaaaaagcagccataaaatttataaggttgctttattataaatatttgaaactggctgactgttgaaattttctgaccttggccagcacagcacaactgccaccatttagagagcacttgaaacatctcagtgctcttttaagtgctttacgtgttttatcctatttaatcctcacagcaagtccatgaggtgcaaataccccattttatagacggagaacctgaggctgagaggggttgagaaacttatcccacctgtaagtgacagaagtcaacttcaaaggccatgtctaactgatcccaaatgccatcctcctgaccaccatgaccagaaccgagatttcttaacctggggactgcaatttcctggatgagttttgggggactgtgaacatcctgaaactgaacacaaaaatgctgtgtattcactttcccaaaggcggccagtggctttcatcagattcccaaaagggtgcctggcccatatgagattaggaaccactgcagcaatagaaaggagaatgttgtcaatgattttatcttgaaatttccactgaagtgtaatctgattgtgcaatgaaattgttgcatgcagctgccaaagccgagagacggaatgggtgaggacatcaaccactcattcataagggttggggcaggggctcactacacaggtagttgtcactgtgaggctgacaactcacacttcacaggactagcgcaagaattgtgtcttggccccaagaggttcctctgtggctgcccttgccattcacccactttccagcaagcacagatgtacaggtatcagggaacatggggaagaaaccccaggctccagaagcaatggcacaggctcaccttccaagctctgctcatttcgctgggactcatttcccagggatccctcactctgacccatagccttcctgacctgttgtgtgaaactcactccacaaaccctgtactttctgataacagctctcttccttttttatctgggccacctcttggtgtggtgcagggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgaggcaagtgtattctctgggtgggctggaaggggtctcaggcacatccggggtgattactgcatcaccactgggacaaagcttttttgagggaaagcaactggtacagagcaggagagaatggtcctcagcccctgccctaaaatgtttgtaatctaaaacatgcgggtgccaaacaatttactgaacaacttacatacagcagtgttctaagaacactataaatattaacttacttatgcatcaggaaacacactgaggtaagtactatcattgctgaaactaacagaagagtaaacaaggactcagaaaggttaagtgacttgtccaaggtcacatagctagtaagaagtagactagctagtgccagcgtccctgttcttaactgcaacactatggagctcctcgagtagaaaataagtagcagaaaacatctaaccacacgtagagaacacataatggacactatcccatcttctctccccctgcctcccaaacactgaataaaagcattccatgcaggtagaagataagggtatcttatggggaagacatggagctgaagcttcaggggattaatttgcaaagcatccactaagttcatagaactaatggaggttgttaaggaagtatgaggctccatttgtgccctcactgaactcaaagtctttacacacacacacacacacacacacacacacacacacacacacacacaaataggactgaaaacaccaagcagtttataattatgtgcccaaattagaaagacaaggtttttgccataactttcaatggcaaaaaacgtgattacttttgcaccaacctaatacaagaagcgctcagaggaaagagaaaccagcttcctgagagaaagcagcttcttgaatgcattggtacctgagctgaagcaggaaatctctacaaaatttcctaagtatgtgagtggagacattgtaaaagggtgtccaggtgagaacagcacaagcaaaggtgtggaggcaggaacgagcatggcacgctaggctggtgctatcgttggaagggctggagataagtttggaagagtaggtctggttcaggttctgcaaagtgaataacaaggagacaagtgagagttttggtttttgtaggcgatgaggagccactgaagacttttgagcagtaacatgataaaaggaggcttttgagaacattattctaagagcccatgttcataatcattatatggtacttcctcaatggcaaagggcctaatgctgcattcatttattcactagtaaaaggcaaattggtgtaatggttaagcctgtgggttctggcatcagaatacctgggttgaatcctgtcgtgatcacttactagttatatgaccttgtacaaacctcctattattatctctgtgcttcactgtaatgtaatgcttacctcatagaatttttgggtggattgaatgaattagcattataaaggccttaggacaatgcctggtacacagtgctgtttttctgttattaatattgtgtgtgtgtgtgtatatatatatatatttttttttttttacaaagcatctatgcaccaggcagtacgcttggtgctaagaataaattgacgcacacaacttaaatagtttctaaactcttgtaccggagcctagagtcccactttggaagagttgctgattgcatcacataacaatatttttcgtttagccttaaattatcacctggaatatgagcactctgtaatttcccaccctatggcatttggaacagtatataaggtttccacacctttttctaccccaaatgttgactatgggaactatggatatggacagagatatgcagactacagtggccaacagagcacttatggcaaggcatctcgagggggtggcaatcaccaaaacaattaccagccatactaaaggagaacattggagaaaacaggatgagatgttaaagtaacccatcttgcaggatgacatagaagattggtcttctgttgatctaagatgattattttgtaaaagactttctagtgtacaagacacagtgtccaactgtatatggctgccaattagttttctttgtttttactttgtcctttgctatctgtgttatgactcaatatggatttgtttatacacattttatttgtatgatttcatgttaaacttcaaataaatgcttccttatgtgattgcttttctgtatcaggtactacatagctctgtaaaaatttaaagtaagcaataattaaggcacagttgattttgtagagagtattggtccatagggagaaactgtggtcctttataaatagccagccagggtcaccctcttccccgatttgtagatgtattctatgctcttaaggtttcatcttctccctgttaactgaggtttctaccacacttttgaataatgttctttcccctctggttatctgaagattgtcctgagaggaagacataagtgttgtgattagtagaaactttctagtagaccatgtttcttctggattgtaataaaattgttagtagctccttttgctttgttcctgtctctagaaagccatctttgaatcgttaattactttggctttaatcagtggtcacctagaaaaagctttgtaatcataacaccatgactttaattcttgataaaaattcagatgcacacaggaaggagcactgtaaaactggtaggagctatggtttaagagcattgaaagtagttataactcaaggattttggcagaaaggtatgagtttggtcaaaagttagattaaaatttgaaatagcggcaaaataagatttagttgtattttgttttctcacagccaccacaagactgaacaaaatattttctgtttgggcattctgaggaagctgtattacagttaactgttaatgctgtgtgagtttagaaaaagtcttgatagtaaatctaacttttaacacagttagtgcatgaactgagtagttaaacatttccgtattcagacaggaatagtggaaaaggtatcttaggtgcgttactcaatccaaatgtgactgaatcattacagtggaccctcatggtgcattgaaaagaaactgttttatatccaggtttcagaggacctggataaataaaagctttggattttgcattcagtgtagttagttggattttgggacctttgcctcaatgttagctactgggattggcatatgtgttcacaggcagagtagttgatctcacacaacgagtgctctcacaaaactggtgtaagtttcttatgctgatgagcccccgcttttttttaatttggtgcctacaactttgttacaatgattgtacttgctgggctatcaagttacaatgctcttggtcttttttgctgctgtttcgctatttgtccttacacctaggccaagtaccaatgttagctgttggaagggattctgtttattcattcaacatgcaactatctaactttagggaatggaaggaagttcatttttaagttgtgtgttgtcagtaggtgcagtgtctagggtagcgaatcctgtaagttcaaatttatgattaggtgacaaattgacattgagattgtccttttccctgattaaaaaatgaataaaggctttttaaagaaacaaacaaacaaaaatattgtgtctaagattatcaggcagcactagagggtcagactgggtctgggtagagttggtcacagccaggctgacttactgctgtcacctgtcagatgaagaagagcagacaagggtttttcagttgaagcccagaacctccctggccctccctactctagctcctgggaatatgactgcaccataggatggacaggggccctgagtcgggaggaactgccttcttctcatggttggttcataaaagcatgtgaattgtggcagaatctgtgaagaggggtttgcactgagacgacaatatccagttaaaacattgcacctaatgagcagagcttatagatttgggttttccctccttttttagattttattttgtgactttctcaattcataaagagattgaaagaacattcacaattttcattagattttgattcatccttctggtatttctgtatgcaaaaacaagcatatgtatagatgtgtgttttcttgcttccctttctctcttacaaagaaaaagtagcatatgaacttctcctctccataggcgttgcctcactagcaatgtaagagggtacctattttcttataacctcaccaatggagtgcattgtcaagcttttgaagaattcttgccaatctgataagtgaaagcttgatggcatcttagtgcagctttaatatatatatctttcattatgaggttgagcctcttttcacgtttttaagggtcattttgtgtctttctgaactgtcatgtcttttttcttttttctgtcaggttttaaagatctctttacaaattagggagagtaatactttaagttatcagctttatttgattgagggtgggtgggtttttttttctttttttgaccatgcagaaatttttcttaatatagctgaatatatcaatatttgttttcattgcttctggaaattgtcatagataggctttctcatgcccaaattataatgacttttgccaggattttcctctagtacttttaagattgcattattttccatttatgtttctgatatagtttgtgtttgttatggtatatggtattaaatatggctccaaatatataattttatgtgactattctgttgttggcagccctatttattaaaagaccatcttatcatcaggaatgagataccaccttaatggtggtgaaatgccaccctaatattatactaaatttccatatgtacttgaatctatttggagacttcctcttctgttctttggtctctttgttcatgtgctagcaccacactgctctgattctgtagagactttatgatatgtttgaatactaggtaggctagcacccctcattgctcaccttactgtataatttcttagccatttttacatattttttaattctataaaccaaagaatcaatttgtttagcttgaaacaaactcattcatatttttgaggagattgtatttagtttgtattttaagttgggaaatttgacatctttatgatactgacttgtcctagtctagaacgagggaagctttttttttttttttttttttttttaagacagagtcttgctctatcactcaggctggaatgcagtggtatgatctaggcctactgcaacctccaccttccaggcttaagtgattttcatgtcccaccctcccgagtagcttggactacagttgtgcacaaccacagctggctaatttttgtatttttagtagagacagggtttcgccatgttgttcaggatggtctcgaactcctggcctcaagtgatccactcacctcagcctcccagagtgctgggattacaggcgtgagccactgcgcctggccagggatgcttttttatatagtcaagtctacatttgcatttttcagcagtgttttaaagtcgtccccattttagaggggcacacttttttagtgttttattttggtggcgttgctattataaatggggttttctcttacatgataacttctaagtggttactgtaggtatatgtgaaggctattgattttgtatgttaattttatatcctgctctcctagtgaattcctttattctttaagtctgttctaacattgatactctcagattttccaggtatacactaaaatgcttgcaaataaagagactttttcttttccagttattggggctctaattgttcttgctttccaattgcattggttaacaccttcaacataatgttaagagtgattattatagtgagcgtccttgccttatttctgacctcaattgaaatgtctgttgtgtttccacattttaaaagttgctagctttaggacttagatgtaaatattttatatattttatcattgatcataactctcatcatctaaaacattgggtttcttgttgtttttgtttagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtggacatttgtcttaatatttcaatgttttcaaacttcagtaggcatgataatcaaatgcagagtttatgaaaagattcctagaaactacctccataaaacctggcggaggaggtctgagtgcagcctgtgaatttgtatttttagcaaactcccagatgttactgaagcagttgttctgaactgccctaggggacctcattatatggtggggtatcattaggtggtccattacccaatccaaatggcacaattctcgtctaatatccagattagtacaatgactctttatgtcatgtataaaactaaagttaaataatattaaataatacattaaatatgttcacataaagcaaattttttaagatgctgaggtacaatttctagaattaattacattgttgctttctaatcatcttttttttttatataagtagacagtttatttgggtcaagtttaaggattataacctgggagcaaagactcaagttgcctggaatctacactttgattagcagcagttgcaagaggagttgtaaagacaaaaacaaagggacagagagtgggctgatacagagttgtttgtcagaaatttttatttatttaaagaaataacattggttattgattagatatatatcattatggtttagggtatgagatatagtgtccaatgtggtattattagtttaatatatatctacttgtggcaatagtgaacagtttcaagcgatgaatacataatttaaagggggagaacgacataactgcacgttcatttcaatgtctgagtttgataaccaaaagtactttcattttttagataaaaattttctatttcccaaatctcaagacctggatacaaaatgtagagctgcagatttaaggcctgaatggctggagtagcaggtgttacctgaacatttgtgaacattttaccaagagaaaaaaggggaaagtggagattctcatgtctacatgtgtactcaatgaacacatgttactctgattaggtttgtgggccccatggtctccgaatcagtttcaggtctgaagataacaagagtcattgagggaaataaaacgattgattgttgcccagtgaagttggtagaaattaggatgaactatgtatgacatggtgctgtaaattcttctacttgtggactaattttggtgaccatctgtctaatcatcttaaatccttgagtttggggatctggggcttctggctagtttgataactgaagtttctatttcagtctgctatcttaacacaaaaatacagaagtactattttagcttctcatgcctattactaaatagtatttcacctttaaaacagtacctgcggatgcccttcttcacggcctgctaccgaacccacaggttttaacctctttctgagtattccattgtcttttctataatgtcaagaagggagagacagattctgtagagggcaccattacaatgaagagacaccccaattaaaccctgctgctattttccagagatcagtcaataatctctcagagacacttatatcctctctcatcccactctgtccttcagccaccagctagtttcaatgctccctcttgcttatttgtttcttgacatttcattaataattccttcatttcaacacagaattgacactcgttaacagtcttctattttttacagaggtacacaaatctcaatttataattaaatgtaactcaaaataatcactagggcatttgtatattttatttttgtgggtttttttgtagtgttgactgtatgctaggttctttcctacccaagagaaaagaaagaacaggtgacccaaaccctctttctcaatggacccacagtccgatgggggtgccagcctttcctgcaccaaagactgtttccccactcagaggatgagctcatgcacaagctgggtctttctggtctccctcttgaagatttttttcctttcttcttcttatttttgtatatttacctttt

SEQ ID NO: 17007 - DNA, 45456 bp, Human
gacagagtctcactctattgcccaggctagagtgcagtggtgtgatctcagctcactgcaacctcagcctcccggattcaagtgattctcctgccccagcctcccaggtagctgggattacaggctcccaccaccacacctggctaatttttgtatttttagtagatatggggtttcaccacattgaccaggctggtctcgaactcctgatctcaagtgatctgcccacctcagcctcccaaagtggtgggattacaggcgtgagccaccatgcccagcctatttgcgcatgtttcctactgccggaagaaggaacagttctcccatataccacattccagggcatcctatgatcacataagaacacaatcctcctgccacaggtaagcgcaatgtaccaggaaacaggttgcgggtaaaccattgttctccctctgccattatgatagaaatatcatgacaggcagctctgcccccaaatcttgcaaaatctcaatgtgcacctcaagtttgtattgttttagcctatgatggaactgacaggttggggaaaatggaaagcaaagttccatcagtctggatcgccttttgtagtgtccccagtgagatcatagctggagaggcaaggatgtaactcactcaaaatttaaggcttatggccaaagttgatgactaataatatagaattgtaggtttgggctttttgctttcttaaaaaactctgtcaggtttggaaagggacctccaatctaattttgagataccacaggtaatgtccaattgtcttaaggtgtgactaaaatttttcttttgtttgttttttgttgttgtttgtttgttttgctgtgttttgagatggagtcttgctctgtcactcaggctggagtgcagtggcacaatctcggctcactgcaacctccacctcctgggttcaagtgactctcctgcctcgcctcccaggtagctgggactataggcatgtgccaccacgccaggctaattttttttttttgtatttttagtagagatggggtttcaccatgctggccaggctggtcttaactcctgacctcaagtgatctgcccacctcggcctcccaaagtgctgggattacagacatgagccaccacgcccagcctaaaatttttcaaaataaacttgctgttacttttcttctttaatttaaaaaatacctctataggctacatgagagtttttgaaaaagtagccatgtttggcatggaaataggccccaaatatgtcaacacctgtatttccttccagatttcagtcctacaactttggactcccaacagattaagaatcactggtctaaggtttctaaagtcagggtagatccctttcccaagtgacagccacaaatccaacgctgtatcataccctatctaaagaaaagataaaagtaaactggcttggcacagtggctcatgcctgtaatctcagcactttgggaggccaaggcaggcggatcatgcggttaggagttggagaccagcctaaccaacatggtgaaaccccgtctctactaaaaatacaaaaattcgccgggtgtggtggtgcacgcctgtaatcccagctactcaggaagactgaagcaggagaattgcttgaacctgggaggcggagtttgcagtgagctgagattgtgccactgtgctccagcctggatgacagagcaagactctgtctcaaaaaaaaaaaacaaaaaacaaagataaaagtaaactgaaaacaaggatagaaatgtctgctaacatgctctgtgaccttgatcaacagctttccccgctcttggccttggtgtcctaacttaaatggggaaactgtgatctctctcagctcaaaatttacatgacattatttacataccaaacctgccctacgcttcctggaaactttactacttatgagtgtggctcctccttccctttcaatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtaagtagacttttctcattgctttttccttaaaactgtgttcccagcaaagtctgataaggcaagcgtcaggtttcatcttatccttggattgtttcccagagaccaggctctgttcaaactcagaaagtgaataatcaagttttgcaagttcctcttaatgaagacctaacgtgtcctaacaaaaatattttttggtcgctgtttttttaggggttgctttttatttgcttttgctgatgttatttatttacttactttacaactgccttgaattcagattccttttgacagccacaccagtccagaagaaaccacagctggcgctgtttatgtaccaagagctggcttcattcaatttaatcattatttgtttgcaagccaaaaaacagtcattttctgaattaagtagtcctttcacctttgtttatcaggaaattagaacaactatttgtaaacaaccttgaagcataaaagtgaatctaaatttggaattttaggatgattttctgatatatagatttagttgacgattaaaatcattggcacatgtgaccagttatgaaaaaaggtggggggtggctgatgcataatatcaagaaaagaaaatatactgttgacattgtttgaaaatagatggaaagagggtttgcaaagtgaaggggattcatcatgttacctaagagtctgattttctgtttctgtatctttttttccttctgtttcactctttctctgcctctaagcctctaagctgcttcttgcctttcctctctcgttttctttctcttccctacatttttttatttgagatagtgaaagtgggctgataagtaggtaaattttctttctgtcaagaatactcaaaaattatttttataatttgaaggaaagtcactgtttccttaaaaattaaagttcaggcttttttttttttcagcatgggatattcaaagctctttactttctacagaaaatatgatacccatgtgcttatttgaatcattattcttatagtccagtaaatccttactaggtcatgagtcaacaatgacagaaaacccagtgaaacaaactatcaatttatttacaaatgattcaccagctgtcagacttctgtgcagaaaaaaaatatataatactgtgtgccttctttagggaaacccatgtgagctaggcttgtacttctatcagtagttttcttgctaacatgtgcatgaggcaagtttagggactgtagaaattgtactgcatctgccgtgcttgtaatactgtaaacctgtgacaagctggttgagtggcagtcctctgagaaatccaagttactccaagctcactgtacatgatgtattccctcctccatgttttacccaagttagcccaggctaacttcctttgactaccaaattgttgtgggtttcctatattcagggactgcaagttaattctttcctgaggaaagccaaaatacaaagctagctctcttagaactaaaaaaattaacaaatattgcacaaagccagtgttaactattttttcctaccatgatttccttccattaatggtagatgaagggccatttaatacatctttcttggcccttataaaacaacgtccatctaagtacttaagccaataaacatcagtttcttatttttattgactaaagagaatatttgactataagtggttaatttatacaaatgagataactcttagaaaattattaggagaaccagaattgttttaaaagatgcccataactaaagtggtaatattaatgataataaccaatagtcaattgagtgcttactgcaagtacttactgcaattgagtgcttacaaggcactgttctgagtgttcaatatgaattgtatcacataagcctgtcaacaatcctctaaaataaggtcgttaaataaaatatgggatgaccatttgaatttgaacttcagataaatagcaaataattttttagtcccatgcaatatttgggcatcctgtatgtttatttgccaaatctggcaaccattctataaagttttgtaaaacttattattcctattttatagatgaagaaattgaggcacaaaaaggttaagcatcttgcccatggtcacacagatggaatggtggagacagaatttgaacccaggctctctgaccccggatgcctttccctttatcactagacatggtcttttcctgctgtgtgtatataacccagcacatggagctagtctgagatccccctgtaaggtttgctggattagcttgactctgaatcagcaggtggttcccttgcttttcctctgtgatccgagaaaaataaatcctccccaattctgaaaagctgttctcagcagaaagaggaggaaactgtccttggttcttgttctcggactaactgaagtgcctgtgacccatgaaatgctagtttgacaagttgttaacaggtgtacatggggaaaaaatcagtttcaatagtcaagttagctttgggaatagaactgggttaaactgtgtttaaaaggtctctttaatgcagtaatcctaagtctttaacatgctaatacgcactgtggctttcaaggaaaggatctagtgttttccaaactctgttttcaaaattttgattacagcattcacctccctctttttttccccaatgtcctgtagaaaacactgagagaactgacatttttaactttatatggaaagaatcgtaaatatggtgaatctggatgtcctcatcaaccagcttcaaagactatcacccatgcaatcttgtttcatctgcatagccactcatttcccacacacacccacttgagttttttaagttatttcatgcaccatatcatccagaaatagaaaaatgtcattttaaagcatcctgtctcccctaacccagagaaaacccacaagttcagctgatccaagacagaaaaattccatctcatttcaccggtgttaagaaaggaatgatgacttacaaggtatacactcttctcattcttcatggttgactttcttcatgcagaattcttaatcaagtaatataatattcttgggttttttttttttttttgagacagagtcttactctgtcgcccaggctggagtgcaatggcgtgatcttggctcactgcaacctccgtctcccaggttcaagtgattctccagtctcagcctcccaagtagctgggattacaggcgtgtgccaccatgcctggctagtttttgtatttttaatagagactgggtttcaccacgttggccaggctggtcttgaactcttgacctcaggtgatccaccagccttggcctcccaaagggctgagattacaggcgtgagccactgcgcctggcataatatgatattcttgatggaagcagcctccaaattctcagcacataatctatatactggaatgggtaacttccacattatggacatgaaggacctcctagctactagggaaggtggagctagaggatcacttgagcacagcagtgtgaggccacattgagctaggatcacaccattgcactccagcctggacaacagggaaaaaccctgtcgcttgggttggcttataaaaagaggtaccagaggctgggtgcagcaactcacacctgtaatcccagcactttggaaagccgaaacagaaggattgcttgaggccaggagtgcaagactccaggctggttaacatagtaagacctcatctctgcaaaaaagaaaaaaaaaaaagatggaccagataaaattccactgaaaagcaaaaatcaggtctcctgcctcagttcacaaacaaccttacatacaatctctctcccttgctgtatggctcctaatcactgtatccaaggaacagccaagctgtctggagaccacaggtttttcaaagacatttgccggaaacagcaccgtgcgctgagagttggtactgagccaggctcagttcagtttgcttacatgagcttctccccagatttatgccaatgcatttcacaaattttcagggtgcatttggccaagacatttcagccaaccaggttattcctgtgggtgcttctcagtatcctaaatgcaaaggaataattaattattcctctcagccaaggaaataaaagtagggagagatgattagaaattaacagaggtatgtctcgaaggagagtgctgtttcccattgctcaataggtagtgctcatttgccctatatgctgcaaattattgtcagcaggaaaggaagtatatatgttagctaagctaaatgtctgaataatataacaacaaaaataattataacaaatataataataaatcccacatatcaaatgcatccggtgtgctcggtattatactgatggctttacatatattacacatttaattttcatgatgctcctggatgagaaataatgcttttgtgttttacacgaaaggaaattgaggaaaggaaagggaaattgaggcatgcagaatgttaagttaaatcattttcccaaggtcacccagcaggaccttgacaaagcaggagtttgaacccaggtctaaccaactgaaaacccagaccttttctgatatatcacacatcttctacacaacataatacacagtttttacagcttcccttatttgcaggcctctgtgttcgtcccagtctctggatcaaagtcttattagacttgtcctgattgcttcacggggagtacagaacatattctcatgctgattcctttcaaggtcagccagctttccttctaacctctgaaatgacactcatttacattactcaattatttctgcccaaactattttatttttaattttctttaccaatggatttatttcttaggtcctaaaagaagaaaataaaatagacttctactcatagttatctttgtgcatcacgagattttcacaacttagagtataccctaataaaataataagaagaatttaatgtcaggagataaggttccttttaggacttccagaatcaccccaaagttttatgatgtgtctccaattccaaacctgaaaggagaacatgatggtttatgagacttcaatccagtctggaagcagactcactgttctagaagcaaaggcacaaatgaataggatagagactgctacaatttgaatgtttgtcccctccaaaactcatgttgaaacttaatcccaatgtaacagccttaagaggtggggcctttaagaggtgattgggccatgggggctctactctcctgatggattaatggattaacagattaatggattaataggttatcacagaagtgggtgagttatcatgtcagtgagtctatcataaaaaccattttggctctcagtgtgccccttcttgtcctgtcatgccttctgccatgttatgacacagcacaaggccctcaccagaagctgactagatgcagctgcctgatcttggacttcctaacctctagaattgtgagcaaaataaacctctttcctttataaatttcccagtctcaggtattctgttaaagcaacagaaaatgggctaagacagaggggaaagacaagaagatgaaagaaaggaaaaaaaaaaagcacacatagcacaccttgctgataaataaggatgatgatcaaaaaccctcatgaaatgagaagattggaaagaaatccataatgtacctggaagtactagacccaatccgagattcacctgttcatcagaacaggccttttttgcatattactatgttccaggcactgttttggggttatagcagtgcttgtgacagcaaggcttctgctttcaaggagtttctagggacagggagggagccagattttttttaattttagtaaaaacaaaaaataagaaaacatcaggaatatttatttgaaataaaacagtgagataagatagagattgagcaagaattataatgatggtcaagggatgtctctctgtaaaggtcaaattttcaggacagacctcaaattgatgagtggtgtgtatgctgagagaagacgcagacttgagacattcaaagcagacaggacatcaagagcaaaggccctgaggcttcagcaaatttagtatattggatgtaacagcaggagggcccatgtgggtaagctgaggacatcaaggtgagaatatcaaggtgggtagggaccagatcaggtaagatcttgtgagcccttgtaaggacctttaatttatgcaaagagcaatagaacatgatataatatctaagagtgatgaggatataaaagaaacaagactagccacatacaagttgataattgttggagacagtggtgggctcatgataaaaatctccacttttaggctgggcacagtggctcacgcctgtaatcccaacactttgggaggccaaggcgagtggatcacctgaggtcgggagttcgagaccagcctggccaacatggcgaaaccccgtctctactaaaaatacaaaaattagccaggcgtggtggcaggtgcttgtaatcccagctacttgggagggtgaggcaggaaaatcacttgaacctgggaggcagaggttgcagtgagccaagatcatgccattgcactccagcctgggcaacaagagcaggactccatctcaaaaaaaaaaaaaaaaaaactccacttttgtatatctttacattttccactggatatagcctcgactgtactcaccaggttctccacaccctaagccacatgccagatttgtttagcagattcagtggagcaggttcattcatgggggcaccaaaccaaaagtccttttaaaaacagttacctatgatttaaaagtgtgaagtgattgtagtatgatggggaaacagtgggccaactatcatgagaattaggagatctggacagctacatgatctctttgatcatatagttttcttacttgctcagtgcagcagtagtgccaacctgtcctcagacggggatgtaataattaaaagaggtagcaggggaaaattctacaaaccatggagggttgtgcaaatgtaaggaattattatttttttttatttttatttatttattttgagacggagtctcactctgtcaccaggctgaagtgcagtggcacgatctcggcttactgcaacctctgcctcccaggttcaagtgattctcctgcctcagtctcccgagtagctgggactacaggcatgcgccaccacacccagctaatttttgtatttttagtagagatggggtttcaccatgttggccaggatagtcttgatctcctgacctcatgatccgcctgcctcagcctcccaaagtgctgggattataggcatgagccactgtgcctggccaggaattgttattatcttggatgtctttctattacaattaccactactactgcaaaaatcctaattgctaataaagtatttttaggtttttaaaggatttcatagagtatgattgctggactgagcacagaggtaataattggtagagcagcagttaagaagattgctctaccacagaattaaaagaatgtcttcgcatagtccaagaactccagctgaattttgaaactccaaaagctcaaggaacaccagcttcacatttgcctgcgggaggggtgtgtgcacacattttgatttccagccctggaagtggagaatggtttattaagtgtttctccaggacatcccttccaaagggttgacagcatgtttgagcaactaccttggaaacacttaaaacctactgaaatgtaggggagtacaattatttctgaactatgggccagagtgagaaagtttgcccaagtctcatgattatgttccagttctctgctcttcaaaacactctgctaaggtgaccacacttgtttttctctctcaggccattctgtcatttagttgcataacctcagttctattctttcaataatatacatagttcacagtgccttcggggtagtttccgtatcaaggttttggtttcttctgatacaaaacacacacacacacacacacacacacacacacacacacacaccccttccaatcctagaggaaaagagtatactaagtagagttaataaagaagcgttagatcccagaccattcagatttagctggtgggactgtgaggagtgtgatcatacagaaatgaacctctcacaggtggttaagtatgctggagttggaggcacagcctgtgtttgaatatcagctctaccacttcttacatgctgtgtgagtttagacaggtcacttaattaagctaaacttcctcatttgtgaaatggaaataataatagtaactgctttgtggaactgatgagaagattacatctatgagaagcacttagcacagtttccaggacaaagtgagtgttcaaaaaatgttaaggagttaccgttgtggttataggttggtgggaagcaatgtaaattattttattacaatgtctctcacctgacttctctttggctaactcagtggctctcaacttggggtgattttctgcccctatggcagaaaatgtgcctttttcagttgtcacagctggggaatgttactggcatccggtgggtaaaggctagggatgctgctagacattctacaatgcacaggacaacccccacaacaaagaattatctagcccaaaatgtcaacaatgctgaggttgagaagccctagaaactaaaacagtgtggggtttgtaatttattgaaaccatgtaacaactttagttattcaaagacacatttacctgggatataaaaactctaaaatgtacttcaattgtggaaagaggcatcaatgattaaccataatcatttctgatcatgaccaagtcacccctgagactagtaactgcaggtgctcacaaaaaaatatgcagctgtccttcctgccttcaggggatcattcatgaaagtaatttctcacctgaccaaaatgatcgcttaacatttattgcatcattgcccctgtttctgtagactactctaccgaagttttaatttgtcactagtttaaagggccaaaagatctgttttcttcagatattagagacacaaaccaagcatctcccactttcttggaattccttctcaaaaatgactaaagtctgagactgttttcttatttaatgtctattgaattctgttttacagaatttcaaaagagcaggttcttagcttacttttcaatggaacattttagccaggtagtataagtacaggtgcgggtaacctcagataaatcaaggtgttatgcagctgtctctatattaaaaatatttgctgacatcagtgtagacttcatcttgtagttcttcagtgttttctttccttatcttttgctcataagatggctttgtgtttggtttgatattatactgagaaagcatattagaatcaaagcaccaagatttcaaaagtccagactactcttcccaaagagaaatgtgcaatcacaatagcatgacatgggtacaaatatagaagtatgttattaaagtattgagaattagctttcctaacctccccacctgcaatcttttactcctaatctccaaaaaatgaacaaatcattggctcaaaatggtcacaaattgtatgtggtgttaaaaatctattatttttattgtatataaaatgttgccaggtgtggtggctcatgcctgtaatcccagcactttgggaggccaaggcaggtggatcactaggtcaggagttcaagaccagcctggccaacatggtgaaaccccatctctactaaaaatacaaagattagctgggtgtggtggcgtgtgcctgtaatcccagcttctcgggaggctgaggcatgagaatcacttgaacctgggaggcagaggctacagcgagccaagatggtgccattgcactccagcctagatgacagagcaagactcagtctcgaaaaaaaaaaaaaagttatactagttgggcacggtggctcacacctgtaatcccagcactttggaaggccgaggcaagtggaccacctgaggtcaggagttcaagaccagcctggccaacatggtgaaactccatctctactaaaaataaaaaaattagctgggcgtggtggcaagcgcctgtagtcccagctactcaggcggctgaggcaggagaattgcttgaacctgggattcgccactgcactccagcctgggcaacagagcaagacactgtttcaaaaaaaaaaaaagttataccactattactgtaatcattaagggaagaatacttctcatcagagtttgtctgcagtaaagtactcttgtcagctttgtgttcctttctgtcctatcttatgtacaaaccgatctccattatgtgtcacctgccttctaatggctgatcatcttgattcttacattacctgaaacacagtgaaagtgttagtgaacttagaatagtggttcttaactagagatttacccagggagattttttaaatcctgatgtcctggccacatcccagactaattaaataaaaatcactaaggttgaaagccagtcctcagaatcttttaaaactccttacgtgattacaatgggaagccaaagttaaaaccaatgagttagaaaaaaaaaaactattataatgagcagaagcaaaacacccaagtgacgtttgtaacatcactctctcacatctactttcaggtgtttcggcatggagaccgaagtcccattgacacctttcccactgaccccataaaggaatcctcatggccacaaggatttggccaactcacccaggttggttggacttttagctaaagattgttgatgaagctgggtgtggtggctcacgcctgtaatcccagcactttgggaggccgaggcaggcggatcaactgaggtcaggagttcgagaccagcctggccaacgtggtgaaaccctctctctactaaaaatacaaaaattagccaggattggtggtgggcacctgtaatcccagctactcgggagtctgaggtaggagaatcgcttgaacctgggaagtggaggttgcagtgagccaagatcgcaccattgcactccagcctgggcaacaagagtaaaactctatctcaaaaaaaaaaaaaaaaaaaaaaagattcttgatgagtctcaaggggaaatgtatatagaattgtctgttttgatattttttgcccttctggctttatttaaatgtaagagatgtacatgaacaaagactatatgagcttagaaatgctgaagagagccaagtggtaatcataagccaggatttgaatttcttaggcttcacatgagaaagtgaaaaatagtcttgtaatcaataagctgaatcaacagcattgggaaacatgattccccaaagtgctgatatcagaatatgatttcttgtcagctggatatattgggatttgaccttccttataagtggtcagttaaacacagggagccctactttctgaagagcatctaaggagaaggtgaactggggagcaaagccatctttagtcactgttccaaagccctattccctttgcttgtaagattggatgactcttctgtttggagccacaaggccaggtgaattgcttctgtcctgatctgtttaaatatattaattaagaaaatgtcacagaatctttagagtagaatgtctcaaaaactaatgggtcttaatcctgccaaaacattgggattatctggagaggtttaaaaaatatattgatgtctgcctgggaggttcttatttaattggtctagtatgtgtcctgggcattgggatttttagaagctccttggtgatcagttcactctaatgtgtagccgaggctgagaatttctgccctgactatatttcatagaggagaaaactcaggcaggctatttgagaccagcatcttctgtctcccaggtcaaagctcttctcaccatagcctacccatcttctgtccctttgaatgaaagagaggctacaaaaattcagatttgcttgttaatacctatggctctgtatagactcctgttctgttgctatgttttcccattaagaccaaaagattcttctaggctgcaggatctgagttcttcttctgaagaaccttgattacccatcagattctattagggcagtatttctcaagcttccatgtgcaaatgaatcacttgggaatcttgtcaaaatgcagattctaattcagcaggtctgatgtgggacctgcgattctgcatgtctaacatactcccaaggatgacaatggcactggtacatggaccacatttgaagtgacaaggttctagggctcagattcctacccttgtctaggtacttttttttttttttttttttttgagatggagtctcactctgtccccgcaggctggagtgcagtggctcgatctcagctcactgcagcctctgcctcccagattcaagcaattctcgtgcctcagcctcccaagtagctggaactacaggagagcaccaccacgcctggctaattttttatatttttagtagagatggggtttcgccatgttgccaaggctggtctcaaactcctgagctcaggcaatccacccgccttggcctcccaaagtgctagaatttcaggcctgagccaccacacccagccttgtctaggtactttaaatctacataatcataagatgatggctgtctagatcagtgtctaggtacttttaatctgccttgtctaggtatttttaatctgcataatcataagatgatggctgtctagatcagtggtttttaaagtgtggtccctggaccagcagcatcaccatcacgtgggaacttctcagtaatgtaaattcttcacgcaatacccagtgaaccataaactttggaattaaagcccagaagtctgtgttttattgagtcctccaggtgattctgtgcatgctaaagtgtgaaaatcactgcttcatacagacgactatttaaaaagtcagctgtaagaacacaattagacctaaagtacctgcttctccgctactcaggtcacggtatattattcctttcccaccttgtccctatcgtagatgggaagtgattatagtggtggtcaagcaaatgacaagtgtgacaagcaaatgacaagtgggaccaagcagcagccaccgtaacaacctcctctctggctcccaaagctctagtaaggctctggattaaagacaaacttgaatgctgcatttccaaagcatggtgctctactacatgcatctgaatcacttgggagacttgttaaaatgcagatgtcagggccccactcaggaactaatgagctggaatctctgatggagatgctgaggaatctgcatttcaacatgcaccgctggataattttgtttctgatgcacggtaatggttgtggaccactgagctaatgcagtgcatctcagtgattactgtccatcagaagcttgttaaaaaatattcttgagcaccacccccaaaggttctggttcagtaggtcaagggtggggcccaagaatttgatttctataatgcttttaagtgaagccaatacagaccacacttagagtaacatgttctaatttttttatgaaccaggaattaataaactgggcagatagtaaagcattgcccacagaggttgaaagagactttcagattcatcgagtctaatctcatcagatggttgagcttcttccacaaaatccccaccaagtgggtctctttgaatgctctaccaacaaggatcccactacatcagagatgaaccatttacttaaatcagatcaatcacccaactatcaactaagcacttactatgtgcaagtctctatgttaagtgctaatgaagataaatgagttttctcagggagtcagggaactgtaactaaagagtacagctcttttgttttcacttaaatatgtgtcattattgtggaactattaaaccacaccattgttcattctacacacataatgaaaaaaaaaatcaacaaatttttatgatagtgtgattcatagaacttactttcattaatttttgcttttatttttttcccatagctgggcatggagcagcattatgaacttggagagtatataagaaagagatatagaaaattcttgaatgagtcctataaacatgaacaggcaagttggggagccaagagtgggaactttgatctttgaaataattaaaataattctgcatatataaaagtgctttgcctgttttccaaggaacttatacaagtcagaggtcttgtttacaaatatattcctctttatgcaaatttttgttccaaaaagtttgtgaatatgagtaatttcaagattttatgaacacctgaataaatactttggcttgacaagtagccactgcttaattgatctcatttgtcaattcaactattggccaaccaggttgctttgtaccatgatcataatattgctcattccttaacaagtattatgattctgatgttagcacaatgtctgtaatatttcactgtgggtgtcctttcctttctctaataccttggcagctctgtagaaaaaaacctcatgctccctttacgttcgcttctgctttgattttcctactctaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcaggtcagtatactgggaaaaccaggagatttcagatggacctagaatgaggaaggcaggctactcaacagttgtggatttgggagtctggacactccttgagctgtgcagttttaattctttcttaaataaagatacaaaggacaatttaggacatggaaaaccctagctaagagagagtaggaaccaaatttctctttggatctgtatgatccactttgttttgccactcttgcaactcttggcaatttgccccctcatcgtcatacacagagagagagagagagggagagggagatagacaagtcccccagtgttctgccttaattcccaggcttttggtgccccaaacaggtttctccactctccagattatccaaagatatttataccaccaaacactcctccactcatgaaaatccacattcctaggtagagaaaaaaagatttgagtgcataatcattgcctaacattttatgtgaatcattgtgttacctttcataacaactctgaatggacaatattcttgctctccttttatagtgagggaaataagtgcttggagaggttaaataacaaacaaattggtccaaagcaacactgctggcaagcatcactctgggattaaaactaggcctatttcattccagagcaattttcttccctataaaatcatgattctcagacttagctgcatattaggatcacgtggttttttaaaaaaaatcctgatgcccagggcactctccgtaagaaatcggaatgtctgagggtggacccaggcatcagtgtttgaaaaataatctccctcgatgattccagtggggaggcaagtttgagaaccagtactataaactaagctgcctgaatggggctgtttgagagaaactctcaaacgtgtttacacaggttgggaccgaccaagctttctttaatcttttcagaggaatgggtatttttaaagtagcaatagataaatctaactaatcttccaggtgtgaaacttaaggctatatgaaagaaatagtttgggacaaagaatcccttcctaatttccctgcagtcccatcataggcatgaccatcgcatctctttatggctgaagcttagcctgactgctggacccagacttttgcccagtgacctctggggtaggttactatcctctttgtcctgccagtacccctagaaatttgacttaattgctgcatctagggacttagggatttttcccaaatgctgtgtagaaagtcactggagttaaatctactccaaccatttttctgctgtttcttgaaaagacaggatgattcatttacatctcttttccttcacagaatcatgagggaagtattgtgattaccagtgttaagcatttgtgaatattttattccaaaaagaaaaaaaatcactttaccagccttttctgcagagataaagactggaggtcaggtgcggtggctcatgcctgtaatcccagcactttggaaggctgaggcgggcagatcacctgaggtcaggagttcgagaccagcctggctaacatggtgaaaccccatttctactaaaaatacaaatattagctgggcatggtggtgcacgcctgtaatcccagctactcaggaggctgaggcaggagaatcacttaaacctgggaggtggaggttgcagtgagccgagatcgcaccgttgcactccagcttgggcaacaagagcgaaattccgtctcaaaaataaataaaaaacaaaacaaaacaaagactggatagcagcaccaaaatttagcaaaatgtagaccacaacagctatttaacaattaatcctgaatgatagtaattaagttacacagaaagagaatgcaggtgctagtagaagaggaggaaagaaacagggagagtgagggagagaaagagagaagcaaggaacattatctacctatggcttccatctatctgattcactaaggtcaaaaaaattctctcatatcaactaagaaatctaatgaaaccaatcaacactagcttattcctagcatttagctgtgctgaatgctgtagagaaataggaggcgaagtttttctaatttatagtttgatgaaagcaaattagcatgtgtgaaatgtgtagaagacattataagatggcgggcaataatttcaagtacaagccacatatgctgggtgaagtcagagaatgagacttacgtgcagttaccacagggccgtcgttcaggtcttcataaagagagtgagaacttgaaccagacctcagaggagagggaggaaggagaggaaggcagcacaaaaacacgaccatgagtgaatatgtagaatgccagttcttctgtgcccagagttcatatttagaaagagaatgaaaataaaattgattatattggacacagattagataatccaaatttaatagccaggaggaatcttgagttgaaagaaaggcagtgtgatgttagaaggagggctgaatttgaagttggaaaacctacatccaactaccacttcagatatatgaccttgagtaacctccgtaaacctcagtttcctttctgtaacatgggaaaatagcacccacctaacttcttcttagggatttgtgaaagtcaagttagttaaaaaatggaaaacaccataaactgcaaaattctggacagatgtctcggtgattattctgtttattttcagcctgactcaatttgtggatgaaaaaactaacatccagaaagtaattaattaaattccaggccttttaatgaacagtcttctgctttttctcttaacaatataatttctcctatggaacaatttgaaagccatgcatgcaaatttagactaaaagcaatggacacaaaagaaacctgtatacattcttcggtattacgcacatgtgatgagtggtgcttttgggcacttgcctgacagtagcttggacagaaaagacactggagcctcagagaataactattgaagcaattctggaattaagaaataaggcctgaaatgagatggtaaaagatgttagaggaagagaagcaaggtaagacaaggtgacacacagaatcagaaatgatgaacaggaagcaacttttaaaataaatgttttctgagtagctactaatatgccaagccctgtgctgggcattgacattgcagcagtgaacaaaacagacacgatcctggctctcgtcaagtttatattttataggaaatagatgataaagaagtaaaataaaataatgtcagatggcgatgagttcctggaaagaaatgaaacaggttaatatgatagagactggcccaggatggctagaagaggggtagaagtcaatgggggagtgttcaaggcaggaaacagttttaggcagagctcctaagccagtgccttccgggacagcaagaaggcccaaagtgttgctggagaggagtgacaagggacagtaataggaaaagagggcagtgcagttcctagaggccaactcatgcaaactcttgatgtagtctgtgtggtggtgagttttgattttattttaggtaaaatggaaagccaatgaaggtcatgaaccacaaaatgacatgatctgatcgatactttaaaaagattcatgcttaaaaaataataataggccgggcgcggtggctcacgcctgtaatcccagcactttgggaggccaaggcaggtggatcacgaggtcaggagatcgagaccatcctggctaacacagtgaaaccccgtctctactaaaagtacaaaaaattagccaggcgtggtggcaggcgcctgtagtcccagctactcaggagagtgaggaaggagaatggcgtgaacctgggaagcagagcttgcaatgagccgagatcgcgccactgcactccagcctgggtgacagagcaagactctgtctcaaaacataataataataataaaaggtattagtgtaactgctgtgtggagaatgaattaggatggctgaaagagtgaacactgatttaccaaataggaagttctcacagtagttgaaacacaagttatggtggctaggactgggaggggactatgaagataaaaaaaagcggtctattttgaaatagaaggggatatgttttgaaaatagagaaacaaaagtgactatgaagtaggttgataaattctgccactagcaaaagcagagaaaattacaaagagggaatggttaaaaatgaagttgaattcattttaatatgatagaggctggggaaggatggctagaagagaagtagaagtcagttggggagtgttcaaggcagggaacagttttatgcagagatcctaagcctatgccttcagggacagcaagaaggcccttgtaacatgtacaagtttagccttgtacatgttaaatttgagggaaaaaaaatgcaaattagttatttctaccaagggctagaaatacaggactagtcacagatggaaagtaagggcaacaaaataaacttgagagccacaaacctgtgggttacagttaaaattataaaacactgtcaaaatttaattaattttaggaagttcactttgtcctcacaacaggtttttgaagtatatttttctaagtatttaatacgtactcttaacagtctgcaaatttgcaaaacctgaagttaatgagtggttaattgacttaagattttttccagaatcaaattcctttctccatacatacatgcgttggggtgtgtgtgtgtgtgtgtgtgtgtgtgtgtgtgtgtacaggtgtgcacctactgcaagaaatgaaagtgattgggaaggaagcaagataacagttattcacgtggaagatcgagaagtgtaaatatttaccaccaacagctcagttatattatggcaagtttatgaatgaaaaaaaggattttcaattctgaatacatatcctactattttaagacctatagatcatttgattctttctccccaattttggaatttccactcagctcaaaacacatttgaatcttttattaaggttgctttgaacctaatgaggcttaaaatattgctgcagcatatttagcaaagtttttctgactcataacagttttatgatttttctcttatcctcagttgctatacctgcctttcaggaactgccctcgttttcaagaacttgagagtgagactttgaaatcagaggaattccagaagaggctgcacccttataaggttaaaagctagttttgtttagtggtacttgttagtttgttagtggtacttgagtgtgagggccaagacacaagatgaagctttggcttcttaaaaagatgggacgaatgcatctgtcagtggctggttacagcaatgggttagaatatttaatgagggaggtcatcactcctgcttcccttccccatacaggggtcacaagccaatagacaagccagtccttttgaatcctttactcatggccttgagaggaaccaggtgtgagtaaatggctggatgagaataaatataagtctaaaatcacctgccttattcaggctaaggggctgggattattgtcttcatatacaaaggatagtcttttttttttgtttctattttgcaaagtacccattttcagcacaatacaaaaggtagatataatgctgtgtactttttaaaataatcttttgaatattatacattcatactgtccaaaaattagaaaatataaaaaggaatacagtggaagcctccatgaccccacaggtaaccactagcattattttctagtagtcttttatgtgtttattttatgcagtcttttatgtattttatgtagtattttatgcagtcttccaatttccttatgcatatacaaacataaaaatatattctgatagtttcttcttttgttacacgaaaatggtatactattcatagggttgggcaccttggttttgttttgtttttttttttccatttaagaaaatatattggaaatatttctatatctgtatgtaaagagtttcctccttttctttcttttccttttttttaacaaatgtgtaatatttatatttatgccataatttatttaaccagcccctattgataggaatatgggtcatttttcaatctttcatttttacaaacagcatgtatgaataacttgtgcatctaaatagtttcacaagaatacctgtgggataatatcctagaagtagacattctgggttaatctgaaatattattaatttaccctccaaagaggttttactactttctacttctatcagcactgcatgcaaatgcccatttctccacaactttgccaacagtatgtggaccactctggggatatttgccaatctggtaagtggaaaataatatcactagaagcatccatctcctctaaaattaggaataagacaaggaagctcactattataactactgtacaacatcgtgctatagtacttttcttcttgtgatgagtgagtttgggtatcttcatctagttaaataccattttttggtttgttttttgatattgtatttcttttttaacttttattttaagttcaggggtacaaatgcaggtttgttatataggtaaacatgtgtcatgggggtttgttgtacagattatttcatcacccaggtataaagcctagtactcattggttatttttcctgaccctttgcctcctcccacccttcaccttccaagaggccccagtgtgtcttcttcccctctatgtgtccgtgtattctcatcagttaaatgccatttatatttccttttatatcaatatcccttgactatttttcttttggatgattgattttccttttgctataagtttttagaagcttttttctatgtattttaacatttctgtctgtgatattttgtgtgtgaaaaaaaacacactcaatgtgttttttcctatttttctcacttgaaaacaccaatcaacacagacagaagacttctgtgaccaaatatgggggatctctctgcaagaaaaggcagcccgttctgcagtagacaccagctgggtggcctccaattcagttttgacaccatctatttggagatagcatcagatcctacaggttgagggctcaggccccaaaactggccacccccaacccgccacctcagacacagatgaaagtccagacctccaaacttctgacaggctggctttaagttggggttcccacaacttcctctttgggttcgatcagtttgcaggggcagctcacagaactcagggaaacacagttattggttattacaaaggatattacaaaagatataaggaaaaggtcaaggagcttgcctgccttcttcaggaccaccacattccaggaacctctaagtgttcagctctctgaaggctctctgaaccctctccctttgggctttttatggagatttcattgcataggcatgattgattaagccacaggctattggctatcaacttaaattttaactccctcccctccccagaggttctgaagtagggctgaaagtcccaacgctctaatcccggccttggctttctggtgaccaacccccatcctgaagctggccagggactgccagccatcaatcaatcattagcatgcaaaaagacatactttggagactccaaggattttaggaattctatggcagaaaatggagatgaacaccaaatagaaggccgggcacagtggctcacgcttgtaatcccaacactttgggagaccaaggtgggtgatcacctgaggtcaggagtttgagaccagcctggccaacttagtgaaaccctgtctctactagaaacacaaaaaattagccaggcgtggtggcaggcgcctgtaatcccagctactcaggaggctgaggcaagagaatcacttgaacccaggaggcggaggttgcagtgagccgagatggcgccactgcattccagcctgggcaacaagaacgaaattccgtctcaaaaaaaaaaaaaaaagaccaaatatatatttcacaatatcatagataatgaatggcatttttaaaaaaaagtttgtctattaactgcttaccgtgttcttgccatgtaggttctgtatcaatgtattcttatatggcttctatattttgagtcatgtttagaaaagctttccccactcctaggttataaaggaagtctgcaatgctttcttctaattccactctagcttcatttctcatttatatattgaattcatttacagttcatactggtagaaggtatcctgtttaagttttttcctggaagattatctaattgctccatcattgtttattgaatagttcatttttttcctacttattgaagctattatatattaaaattcccataggtgtggggtctatttatgtaatttttattctgtttaattttttattagccaaaacttgggttttaactattaagactttataatatgctttaatatctaaagggctagtcatccctcattgctttttctgagtttccatggctatgttttaattttctttgtgaacttcagagtcagcttgtctagttccaaaagtattttttaatttttagtattttcattaggatcatattaaatttatttaacttagggagaatttgcaacttttcactgtcaaatcttcctaagaatatggtacatgttcctacttgttttatcttaaagattattttagggttttcttcatatatgtctttacattttttgttaagtttgtttcaggtttacagtatctccagttttcaaaaatgtgtatctctgatttcttccttttgcctatttgcactggccactacttacagtataatgttatgggcagtgttggtagcgggtattcttgtcttatttctgattttagaggagttttcctaataagcatacaggcttttgaaccaaaatagacatatttttatgaaattaaggaaatatccacctttcttattttcttgagtgtatttttttaaatcaatattagttgtttaatctcctgaatgattgttttaacattttttaatacaatcaaattatttttctccttggattaattacaatgattgattacattcatagatttaccaatgttgaacaatctttatatttctcaaatcaaacccatttccttttatgtgacattgaattacttcctgttattttacttacaccttttgcattgatatttacaagtggcattgaactaatagttttattttgggggcaatctttgtcagtatcagtgttacacttaattcataagaagtttttgaaagttttctttcatcttctatgctccagaacagttaaaatagcattagaataatttactcttgaaaagcttggtagaattcctctatgacagtcatctggccctggagcttttatgtttgagaagatggcagtaggagctctttaacaataatttctattattttatgaaaatctattgaggttaatattggcaaattgtagttccctagaaatttcatccatcagacagacaatatcttccaaaaaggcttcccagaaatggctgccaatttcagcagtcagatagctgaacattgggtctcattattgcgacattccaagaaacatacagaacctagcgaaagatttgcattccatccaagttttatatgtatagccaaagaccaagccctatttgtgttgcatgttccaggatgctttggcctgaaatatgctttcctttctcacctgggacatatttacacatgagttatactttacccacttctaaaaagaatctgaggcagtacacttcaatccaattccagcacgaaccaggaacatgtggcagtcagccagcatctatctacattttaaatgtaataataaggaataatcaattcgtgtttgtaaaattctttggaatgacattatcgtaaccaatattactggtgcatttttctgtgaagaacagcggttctcaacaggggcgcatttgcctcacaaggaacatttggcaatgtcgggagatattctgggttatacaagtgggagattaggaatgctactggcatctagtgggcagaggccaggatactgtgaaacatcctataatgcacaggagagctccctacaacaaacaattgtctggcccaaaatatcaataatgctgaagctgagaaacctgtgtaggaatttttctttctctgtttgtgtttcaggattttatagctaccttgggaaaactttcaggattacatggccaggacctttttggaatttggagtaaagtctacgaccctttatattgtgaggtaaaagaaaaaaaaatcacaggttaacttgcaatctgattttatgatttatgcttattttgaaatagatgaatatcttttctttcacttctttatgaatgtattacttatacttcttttgacattgaaacgtaattcacaacttccttatattaacttgaaaatgctgacttctcttttctctctattattatttatgttttcaccctttagaaaattacaagcaaaattgcttttcttctatgagtttccactttagttttttccccccttggattcagtaggagcttatttattttgcagccactcaaaaatgctgggttcctgtccttggtcttaatgaaaaaacaatgttgttataaagaaagaggggaaaattacctgatttccgaatgtagaaataaacaagcaaaatataagccaggctatttatatttgcttaacaagaaagaacttctttcttgctttgcgatgcatttgaaataccgtttgtggccagataaattacgattgcttttcaaggttacatggtgtttctcactcaccatgctccaccttctggccaaaaggagtactctctgttcctgttttcccaactagctcactaaatatggggcaagattctgaccacccacctaattcatattgacttctaactttgaggtcatcgtgagagtctggggggcagcaattacttccgtagttctatcttaataacagatgacacagtttgcctccatccatcctaaagttaattgacccaatcacatgctactttcccagtattttcacttaatcatcagcaactatttcagtgaaaattcattagcattgtaaaagactcttcagtgaaaacaagagcccccatttttgttccagtcataatttttttttcttccttactacagtttgatctgagctattccaaaatgtggtcatgtcatgtgatattttttccaaatctctctcacttatttcctctgtaggtcactccactttggtctcctctttcacgaactcactttctctcactcttaatcctgcctttgaaactgggggactcctaatcaactcttcctaacgggtaataaatattggcacaaggtctcacctgccctgcttgtacttaaccattcatttaacgcatatttaccaagtatccactgtgtgcaaggtgcaggctttcctcaagagtcagtgaactacagccaggtatggtggctcctgcctgtaatcccagcacttctgggaggctgagatgggaggatcatttgaggctagaagttcaggatgagcctgggcagcataatgaggccctacctctacaaaacacttttaaaaattagccacgtgtggccaggtgtagtggctcatgcctataatcccagcactttgggctaaggtgggcggattgcctgagctcaggagttcgagaccagcctggccaacatggcgaaatttcatctctactaaaaatacaaaaattaggcgggtgtggtggcgcatgcctgtaatcccagctactcgggaggctgaggcaagagaatcgcttgaacccaggaagtggaggttgcagtgagctgaaatcgtgccactgcactccaggctggatgacagagcaagattctgtctcaaaaaaaaaaaaaaaaaaaagtgccacgtgtggtggcatgcacctatagtcccaactactcaggaggctgaggtaggaggattgcttgagtcctggagtttgaggttacagtgagctgtgatggccactgcattccagccttggtgacagagcaagacaatgtctctgaaaaaaaaaaaagaaaaaaaaagtcagcaaactagaccttgatgggggtaggggagaatatattactgaaggctccagaaatatattgcctttcctaactggcctctcaggcagcccattcagcttttaaggaaatatcatttaactctgtcaggttcatagaaagatttctaaccctttcataaaggaatgaggtattatttccctactgcacccttactctgcaaaatatgagccacccactgatccagagttaaaccaaaagctatggactgggtaggaatgggtaaattcatttatataagcttttcttctgaaagtcaataccactacttatcacaatatgaagttcttttagaaagaaatggcaggacaagaaagtctggccctactagttcttgtgaggtgaaaaaggataagtcaacaaagaggacagtcatataaatacacatacatttttcttcctttttctttgctacagagtgttcacaatttcactttaccctcctgggccactgaggacaccatgactaagttgagagaattgtcagaattgtccctcctgtccctctatggaattcacaagcagaaagagaaatctaggctccaagggggtaagtattaaaaaatgagaggagcatattggatttgtggttgaatgatccaggtctgagtcattccctccactaatcaactgtgtgatctcagacagttcacttaatcactcttgcaccagcttccattctgcaaaatggggatattaatgatacctacttcatagacagtgagtattaaaatgaatgtatgtattcaaatggcttagagcaaacagtacctggtacataatacactgtcaataaatgtcatatgttagtataatcataactattactcactcaagcccttagttttctatctggaaaatgaaagctaaagctaaatgatcctttccatcccctccagatcaaaaatcaaggatctgtgtctgagccacatgaaaatcaattgtgtcttgtggcctatatgatgaatttttcaagtgggaggtatgacaaaagtggcctgttttcctgaaaccctgagtggtagtcattgtgaaagccgataaaatatatttttcaggctaattgttatatttttcagaccaattatgtgctgttaaaatatgttgcaattgacaagtttataacacagcttgaaatttttcattgacattgaaagctgttgagatttatttatcagtgatgcctcttcttggttagaactggctcttcgtagcacaggacaccctgtcatatgaaggcagacccaggcaagaggatgctggattcttgtaatcaggataagtggatggaagaaaaaagtcaggaccagcaaagacaaggacagatgttggggcttatgagaaaaactggatgggcaggccaagataccaaatgaggtgtcagacttagatgtggttatcataggtattaaaactagggataaagaagaagagaaagttcatcatgtcaggttgacgtaatgaggaaagtccaagccacaggagatggtccaagtcaggctgacacacatattcaaggcattttgagattaatacaatcacatcatgattccagccattgacagacactattcaccacagcatcaggacaagtccatcaaaatcccaagagaatgcatagaggcaaagcatattagggctggaccagactgggaggttgttcactgaggctacttaactagggaaaaaattcaaatcactgaccagaaaaggaatcaattatagctagaaaagcagggctgcacaccaggtataaagagtgaggcaagctgtaaccaggggaatgaggtatgaaaccaggatggtcaggagcaaattcatgtgagatgaataaagtaggttggggcaaaaaatttaggacagtggccattaacgacatgaggttgttgtagatctgctattacaaaaatcctgattgcatggcacagagacagacttgatagaaatgtgcaagtccttacttcacattaaacacatgagcaacaagatccagccttgaggaagggagagtctccagagaggagtcttagatggaagctggagtgttggaaaaaattaccaggcgggatacagactgtgtctatgggcagaacccaggaagaagctcaatcttaagtgcttaacaacaaaagatgtagagggtgccttggaagccacataagcactcagcctcatttctggcccaccaggtgccagcagtgtgactcagttgcaagccccatcaaatggtggaagcgggactcttgatttatttcccccaacctagttatggtggattcaggcacctagtccctcacgactcaaagtgcagtctacttttcagcatcggcatcaactaccacctggctagaaacacaggccccactcccaaacgagttgaatcaggatctgcatttgaataaaatcccaacatgctttataccagacaggagttgacagtagtctaatagtagatgtagggatgtgtatgtatgaataagaaatggagttgctccactttcctcatgtttcctcttttatttcccttgcctactagaagattacatttgggagaagccacttcccctctctggatctctgtttcactacctatgaggagattaaactagactgtctataagagtccttctctgagttgttctctgatcttggattctaaaggctggcacttgtatgaaaccagctgtcctgctttctggaaaaagtccagcgccattgttaagcaggaaaatttctcctgtgtggttctgccaaaacaaaagctcagactattattcagatctggctgggcaagagagatttgtcaactacatgtttattgaatgatgaaacagctgcacacattcctgcacagaaaacacacattgtctaggtgacaaagagtaatgtggacacatcagggccatcttctgacctttgctagtttttttgttagtttgttttgtttttgtttctttgtattttttgtttgtttttgtgtctgtttttgagacagggtctcattctgtcctccaggctggagtgcagcagcatgatcacggctcactgtagccttgacctcccaggctcaagcgatcctcccacctcagactcccaagtagctgggactacagtcatgcaccaccatgcccagctaaattttttttaaattttttgcaaagacagggtctccttatgttgcccaggctagtcttgaactcctgggctcaagcgatcctccaccttggcctcccaaagttctgggattataggcatgaactactgtgcccagtctagaatttttatttcatcatttaacttcaggggtgacactgttcagtaagacacacacacatacacacacacacacacacacacacacaccaaaaaaatccctggggcaaatttaggatcatatggctggtcatatcagtgaaaagagagctcttcttgctctaggccagaggttggcaaactactgcctgtatgcctaatccagcccactacctggttttgtaaataaagttttattgaaatacagccacactcattcatttatgcattgtctattgctgctttcatgctaccaccgcagagctgagtagttgcaacagattttttaacccacaaagcctaagacatttactctctggacttttacagaaaagtttgccaacctctgctgtagactagaaatgaaggaagcaaagtttatgtcttcaggtcaatgatatttttgtctagtttacgaagatttaataaaggatacaacagataactttgaagctagctttccacgatagcatgttctaatgattacaaataaaggttttgacacaggacatgctagatttaaagccctccttctctgcttgcaagttgtataatctaatcaagtttctgagcctctccaagcctcagtttcccctataaaacagaatattgatatgccagagcctgaggataatcatgatagtcacccctaatcactcctgggataagggtgtaatcataccagaaccaagaactgatatattcatgaccaaaactgcagcctgactaaaaggcacttgttgacaaagggcaacttgctgatttcaggtggctgtcatggctcccaaaagcttggccacagagtttagcaccaacatggcatgtgaatcaagctaaagtccctaatgcattccacagggcaaccctctctgagatggagggatttagacctgttagacatgtacattcagattatcctattcatcctcaaggaatttccagtatcttatagaaagagcagatacctacctccttaattaacccttttttatacttactggtgtacagacctgtctcttcttactattttatgagtttttggagggcagggaccaggtctgattctcctagcacagtatctggcgcatcatagctgctcagtgtgtgtttgttgagtggactacagaacctgagattatagtcaatctgttaatatcaatgccctgctcattacaactcacacacacacacaccctaacacaccctactggtcattctcagccaagagagcacatgatgcagggtaaagagaccaacagagacaccagatagttacagacatctctgaagcaacatgtccttaaaacaggatctgttttggcaccacaaggtaccccacagccctcagtgcctagaaataggataaatactgtaagctctatatctgtctttcaccacctcaggagcaacagcagttaggtgttcagatgtgaagtgtgaagagcaaaagtttcctctactgaagacagacagaaactcaaatgaaagctaaagatgctggctgtccccccaatagtgacacctagggtaacctggagaaatggtccacagagaatagtccatgatctgtacaaacatccagagagctgctttctcccatggcctcccacaggtctgactgccagagagtagaagcaagaggggtgaaaatagaggagtacctgctgtgctgtcatttcaggtctgctctggagaagaacatgggctaagaattatcttttatgatctgaaaaagctgtctgaagttccttccaagcttatcagcctcctaacctgagctttaacaaaacccggtatggtagagtcctagtgtgccaatccagctttccttacctggctgtgtgagtcacttaatatctttggacttaagattccttacctaaaaatgagggttgagacgtaggattcagtttaaaaaaaaaaaagtatgtaaatcacattacctagcacagagcagatgctcaataaaattagatctttgcccctcttcttaagtcatggcagggagagtccgcaactatgaagtgacaaaaagctaatgaactaaaatagaagcttatgtttggttcagtttggttattgattcatcttctttaaggtgtcctggtcaatgaaatcctcaatcacatgaagagagcaactcagataccaagctacaaaaaactcatcatgtattctgcggtaagtattttcatcttcatttaacatatgtttgttcaagtgtgtgatctcttgaagcacaggacctcatctttttttaatcttcatttccccatctccttgtacgtggtaggcacttgcacaaagcttttagaattaaatgcatcattctgtcctttaagggatttataatctaaactaacaagaagacaaacataaacactatacaaaatgggatggaaataccatgcaggcaagtgctatggcacctcagaaaatctagccatcccttctgttccaagagggtggagaagagaagcagaaaggcttcctagacaaggcagcacatccaacacatcaaaatgaaaggggttagtaagtgctcctcactagtgtgtaggacaaataaagtaaattattaggacagaagtggaaggccaggaatgttgtgtcgaaaaagtggtaccaaattagtggatgttaactgtgctgctcaatatggaacctagtagccagaagtagctacttacatttaaattaattatgattaagtagaatgaaaaattaagtccctcggttgtattagccacatttcaggtgttcaatagccatatatagccagtggctactgaattggagagcacagatatacaacatctccatcatcatggaaggttttttagatagccctgatatggagtgtcagaagtttatgctggatggcagctgaagggccatgttgtcctgctgcttctttgtttaattgtagaaagaagcaaggaagcaagggagaacccccctgtcagtgtttgctcagggaaggcagggcaggagtgacaggataggagcagcattttggaaattaattattttatagaataactggatgttgggaacaggatatggtgtagaaagcttttgtgatagtctagaaaaatggggatatggcctaaaattagggcagcggcaggagaggaaaagaagtgagccaggttacaagaaaagctgagtgtgcattctcagtgatgaattggaagtgggtggaagacaatgatgtggaaggtgaagccccagatgaagtcaagatttcagttttcagtggcaggaaggaggtggtcttgggccaggcaaatgtactgattaggcaatgggtttgaaatgccacaggggcatcccagcagaaaacttcagatggcaaagagaatagaaggaggaaagggaagaaggactgcaactcaaagttggagctacatttgggagtagaaagaaaagagagcaagagatcttagaaaaggctttcatcttggagaagccagggagagaagagtctgagacgccaaggagagacacagtgtttggggaaaattctgcaattgtattatacattcaaatagctgcccatggagtctgggatgagcagggaaacaggacatagcatgctgactcctttcactcacatctccatgacaaaaggtttctcagctgtggctggagaaagaaagtcatgttttcattcatgcaagaaggtgaaagaggtgactgaagatgccaggaagtttgtttattatcaggagccctaaatggtatagactagggaaataggcctgggcaggagcagagtgcttcctggagagagataggcctgaaattagtcatttctgccaattttcgtagtgtctaatctgatttctagttttaacttgtggtgtgacttccagcatgtcatatccgtagctcctttttttttttctctattagattacttctaacgccttttgaatatgtgcacgctgccatacagtttaggcagccaaatgttatcccaattttgcagatatggaagttgaggactgcctaagattagatagctaatcagtggcagaaagggggttgaaaaccactcccctataccttccagccactctggggtaaacatttagctttacaattattttaaattgcatcctatacttccttgtattttatcttccctaaacatttaaacctcatatattcttccacaactttaaatcacagatgatgctaatctatagaaaaatataatctagcattaatgtgtttcaaaatatttcaaaaaggcacagcacttaaggaggcttgattcaaatttactttcttccatttggggttatatgacattaagcaagttgcttaatttccctgggtctcaatttcttcatcttttattattatttttaaaattattttattttatcgagatggagtcccgctctgtcaccttctgagtgcagtggcacgatcttggctcactgcaacctctgcctcccgggttcaagcgattctcctgcctcagcctcccaagtagctggatttacaggcccatgccaccacacccagcttttttttttttttttagtagggatggggtttcaccatgttggtcatgctggtctcgaactcctgacctcaagtgatccacctgcctcgggctcccaaagtgctgggattacaggcatgagctaccacgcccagccaatttcttcatcttttaaatgaaaataatgatacatatctaaatcatactgcctagcacaccgctaatgctcaaccaaaatctttccttctctacttattaagtcattgtgggcgtatgggaaatttaattgaatcagaagccatcatggtgctgtacaagtgcttcatacctattgaatgtgaatctgaacaggcgataaaattgatttcaatctctgtagcatgacactactgtgagtggcctacagatggcgctagatgtttacaacggactccttcctccctatgcttcttgccacttgacggaattgtactttgagaaggggtaagtgactaagtgcttttcaaaatcagtatcactggaccttgggtttcattattattattttgggttaagggttgtgtgcctgtttgtctttgatttggttttatattcagagggaagaatggtggtaacaagatctttgctagtcatgtctcttttttctttttcatgaagacttttactggaaaataatatacacagtagatgaaaaaattgggaaatagcctatgtaacagaaattacatttttaaaaaaattaaggtattctaagaagtaggcatgtattgtatatatacttggcaagagaaaaatttcttgatggttatataataatattttttcaattaaagaattcaaacatattcattcagcttctgatgattcatatccacaagtcaagattcttaaagtacaatttctaactggtgtctacctctgtgtgacctggtgtggccctccccagatgaccacagcttagcttgaacccattagaagggtcaaagttagcgtagccaaatgtcccagttcaccagaattgacccatgaaatctggtgttctcagaacatgtgaatttcattgttaaaaccagaaatgtcctggaaaaactggggaagaattgattatcacaccaaggtcataccaaaaatatttatctgctgtgacaacgacattctcattgggaggagaagaaggaggtatttggaacaagtcaccagacttcatgggatattattagtgaaataagagcaaggaaagggctgagttaaggcagtgaccccagagtttgttttgggattagtcagggagatctattttgcccttccctcaaggcattcacaatagctgcacaccaacctgactgtgcagttacatggggacctggctcaaaagagcccatgcttgttttaatgatctgctgtggccatctttaaattgtaataatgtttaaacaatgggccctgtatttcatcttgcaaattttgtagtcttggatgtagctttctggcccctgaatttgtagagtaagaaagtaacagcacagagacttcattctcaaccaatatcttcactgcttacaaagaagtgagttctgcacagttagggacaggtagatacattctttattgaacctctaactgagtgtcaggcacaatgaactagaactaaaatgtggtcttagttaaccttgctctcaaatatctagagtcagcatggagaggtaagacccacaaaatggagactggccaaatagaacagaaaatgggaatgaaacgactagagacataaaaccctctcttaataacaagcccggcacaagtctgcccatcagaaggccagctctgggcacagagttaataaatccaaccaaattccaggatcagcttcaggagcaggcaccatctcctttgggataagacaagagaagctactgactctactcgtacctccctgttctctggtttctggaccccagtggtccagagcttgctttctcagtgcacagaagcattttctcccactgaattgccttgttttacgaccctgagttaaatctatattacaaatcaagtgtggagtattttttcaactgaaaggcagtgacatacagaaaaaattaaccaagggccacgtaaaggtcaagtccaatttgttgttgtattaggattttttttattggcactccagggaaatatcaaaggtgaaacgtgattgcttttaaattaggatcaaggaggcttcgagttaacgaattctgtctaagcctgcttattaggtgatcctgactgtgaagtgatctcacattttcttatgagaagatacggagagagacagaaagagagagtattttagattttcaaccatcttaaatacgtaaacttttcaggttgtagaaaaggtagctaaaaatattcttaaaagatttaattttgggttagatacagagatttaaaatcatagactatataaaataattcattaagttaatattgctttgtttcacttttacattttataaaatgattttatctaaactctttgtactcatctttggcttgtgtcttcaccactaaagccaattttgagtcttttaaaattgtttcccagatatattcactaataaaagataattttgtcttctatatagatgaacctcagatttttgaagtcttaacccaatgaaaattaatttcacacttatctaacagtacaatgcaggtgtacattaatagatgtgattcacacgtggtgattcaggcacccagggttccctctttggacctacggtttcaagagtgctgtgctcacttgcaggcagcttgtagaaaggaatgaaagggtggaggcagcaacccgcttatcaaccacgtcagccttttaaaggggacacatatcatttctgctcactttctactggctaaattagtgacttggtcctacctaggtacaacgtagtcttggcaatgtggtcacttctgagccataattcaattctatggaaagagaataacagagtttgatggagtattggtcatctaggccatatcatcttaagacagaagatgctgttactgaaaaagttattccaagatataagtacccattcataatacatattagggaggtttttgtaagttttatagacatcttattttattttatcttattttattttattttattttattttatttttattttattttattttatttttgagatggagtctcgctctgttgcccaggctagagtgtagtggcgtgatctcggctaactgcaacctccacctcccaggttcaagtgattctcccgccccagcctcccaaatagctgggactataggcatgtgccaccacacccagctaatttttgtatttttagtagagacggggtttcaccgtgttagccaggatggtctcgatctcctgacctcgtgatccacccgcctcgacctcccaaagtgctgggattacaggcgtgagccactgcgcccagccttatagacataagtgaatatttgctgttactatgtttatatggctttttaaagtgatgttttaaaaggcttgtttataatgacaaccaaaagtagccattgtaaggttacaccaaaagaaggatctctaaatccttcttgagttcccctcctgactccttgattagcaaatggcttccataagcaactcacgctggtttaactcaggttagtttacaccattggaccttcccaaatagtacattgtttttttgagataaagcattgagagagctctccttaacgtgacacaatggaaggactggaacacatacccacatctttgttctgagggataattttctgataaagtcttgctgtatattcaagcacatatgttatatattattcagttccatgtttatagcctagttaaggagaggggagatacattcagaaagaggactgaaagaaatactcaagtaggaaaacagaaaaagaaaaaaaggagcaaatgagaagcctaaaaagaagggaggaggagaaggaaaacccaacacccccacctgcctcccacttcttatccaaaggctcaaagtcccacccagctccctgcaaccatcacttctcaccacctcctctgatttagcatcctggtgcctacctcctatgtccctgttcatctaacaaaccagccctcccatttccaccctgcaaatctctcccgcctgccccagtctccccatttacacacctaaattggctaaaatctccccataagtttttccattagtccctcaactggcatgtaatagtccaagtggaaagaaattcagtggcagttcaacaacacagaactaacagagctctctcctctgcctttgtctgccagggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattagtgtgcacagagatctctgtagaaggagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgtttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctctagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaacctggtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaataaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctccctttgtgtttggggtttttgttttagtataacaagatggaaaatattaatataaagtaaaatgatttgactggcttaaatgaacattttacattgaaaatatagtttggactttaccacttcagataaaggtgaagctgtggatggctctgcctcatctatttaagatggaatttgctaaggaaacaccctcaggaagtgcacaatatactagggaagtaaagagatacatactgtacaacatggaaaaaccagggctatgtcttatgactacacagattactgtgggaacaagagttatccagatttggagtaggggaagtaaggaaggtcaggaaaggctttctgcagaaggtagcaactgtaccacgtaaaatcagtttgaggccaggcgaggtggctcaggcctgtaatcccagcactttgggaggccaaggtgggcggatcacaaggtcaggagattgagaccatcctggctaacacggtgaaaccccatctctactaaaaatacaaaaagccgggcatggtggcgggcacctgtagtcccagctactcgggaggctgaggcaggagaatggcgtgaacccgggaagcggaacttgcagtgagccgagatcgcgccactgcactccagcctgggcaacagagcgagactctgtctaaataaataaataaataaataaataaatttgttaccttttcccctgaccctactcttgtctatcttgatgagcagcaatacctggtaacttaggagttattttttaccctaccctctccttcattctccatagtctctcacctcctcttgtaaatctacctgtggtatgtttgcagaattctttccctcaaaacacaaataacaatatgcaggtagagtgaaatatgattaagcagcaaaaaatgttaatagaaagaaaaatgtaagggttgatgtgctgcagcccgctcatacagatctcaagagtggaatgtgtccatcagttcccaactctcagttcaaccacttcacctgggcagctccaatgtggcaggagtattttcaccaaagaaattaaatgctacaaatcctaccaccacaccactggtttgggctcatagaaagtttgttaagagtctgtgacatgaggtggcctctaatacagtgagttcaatatttgaacttctgtaaagaaaaggattagatttattcagtatgatcttaaagagggatgctaggggcagcaggtaaaaatttcagggagacagattttcgttcagtgttgggaaactcctgaggtaagaagtgcccattaggctgggtggccactcaccttagaagagagatactacagagaaggctgaaacatggaagattgtaggggttgagtggctcattagtttggccaccaaatctagcaaataaaagtacaggatgccgagataaatttgacaaaaggctgtaactgccaagtttttgtaattcattggaaaaaaaaaaaaaaaacaatacaggacacttaggatgttctgaaaaagccgatacaggaagcaggacaaaatcattaaatataggatatgtcctatatatgcaagatactttgcaaccctactccttagagtaggggtttccacccattaaattctatccataactataagcagtgtttttagctagtgccagtaggctcacttaaccagattccagatcgtatcaattaaattcaccagagtctttgctggaaaattcacaagtctaaggccatagcacattgcttgaaaataataaaatttgtcaaactgcttctttaattccaacattttactaacacattcagactttcttcactagtgctctcccacccccatctcaatgtccaactctaattatttcacaagaaggagacttactagtgagaagtcccagttttctctcattatctttctaaagctgagaatctacagcacaaatacacatgcccaagattcaaccttgagcttcttaaaggcaggatccatacat

SEQ ID NO: 17008 - DNA, 42246 bp, Human
ggactacaagacggggaaggctggggaaagagctaaaaaatgaattattcagtacctgcatggcaggatcaatcataccccaagcctcagcattgtgcaatataccaggtaacaagcctgcatacataccccctgaatctaacatataaattaaaattattttttaaaaaaacccttttcttctttgtgtgcgtattgctttatagaactcatattctttatctcattaatcctctttcatttgtcatcagaactatgtaatgtagagaatcattttacatgtggggaaactggagtatgtaatcttttgaattatttatgaattatttatttattcactcttatttcctagaagtacagtagcctggtccatggtcagaagctcttaattctatggcctgaatacattctagaaaggttacattaatttatatgatcctttgaatatatatcgatttaattataatctgtccagcaatgagtattatcatgtagaaaactgcggacgaatgtaaattctataaactagtttctcagtattctagttgcccctcttgggtttctctcatgattaaccataactttatatgcttgttaattgtgctttttattttgtgattagtctgttcatgttgattacctctttattttgggagacttttattatattaaccctttttatattttgacttttcctttttattgtagttacagtatttttcattgtatagatgttgaaattttcttgcaactgaatgtattaaacttttcctttgctattttcctacatcgcatcaaaagaagaaagagctgacaggtatatatttatatttttagctgttttttgttggtttgtttagagacaggttcactctgtcacctaggctggagtgcagtggcgctcatagctcactgcagcctctaactcctgggctcaaatgatcctccctcctcaacctcctgagtaactgggactacaggcatgcacgcctggcttatttttagctttttaaaattacatttttatacttttgtacattttttcaaagtcaaagaataatggatgtacattttagaaattttggaatatatgtaaaattataaaagatgaaaacatctattattaccattctgggtgtacttttttctagtactttttcctagtactttttcacgtttttttaaatgtattttttttctgaatttggatagtgtttaccgttttataacgtattttttcagttacaattatactgattgaactttcacatattattaaatattctttgaaaataaataattttttgaaaatctgtatgaagtttatttcaggatggacctaattactccctgtttacctccaagccagcaattaaacaacctgttcttcccaggttggtccatggtggccgctttagctttctagcccattcttatctggtgtcaagtctatttctttttttttttttttttttttcttttgagacagagtctctctctgttgcccaggctggagtgcagtggcgtgatctcggctcactgcaacctccgcctcccgggttcaagcaattctcctgcctcagcctcccttgtagctgggactaccggtgtgcgccatcatgcctggctaattttttttttgtattttagtagagatggagtttcaccgtgttagccaagatggtcttgatctcctgtcctcatgatcctgatccgcctgcctcggcctcccaaagtgctgggattacaggtgtgagccaccacacccggctagtgtcaagtctatttctaggctatctgtgctgttcacagatccagagcattgcacctttaataggcttttctctctctctttttcctgagccctggaggcttcctggattgagacctagcctaggtctgcataagcacctttccatcttgttaatgtttaacactgcctctgctggaaaacagctctcacctcctctctttctgtctcttattttttgcctttgcagatgagttttgatcatcctgagaaaaatgggccttggcctgcagacccaataaaccttccctcccatggataatagtgctaattcctgaggacctgaagggcctgccgcccctgggggattagccagaagcaggtaaggaacacacagaggcatgggctagcaaaggggtacattcctgagtaaaagctggtgtggcagatgtcctggcagggaatctcaggatctcagtatctggctccagctttgctgttttctttttgtatgtattttttagtcctctttaactgctgattcaatgtgggtttcattggggggtgtagagaaatggcttgtccatttctattaactatataagatttaagttattctgtatttcagtcaaccattctgagtacctactacctgccacgaatgcaactggtactgagtatgtcatgacgggtgggtcgggacaggatttccttgctttgagcattgatttctgccggttcagtgttggccagttctttgaaggtgatgatgcaagtcgctgtgttcttcctctagaagcctcgtgatgattgtaaagattctctgatacaattgcatcagttcaataatctttcattgagtatccgctctggtccaggcactgtgctgggtactagggtttcagaaaggataccaggaggagttttccttgagcagcaaagtcaggcatgaaaagcaagcattacaaagcactggctggcagcaaaggggagcagggatagtgcggaaggggaggtggcctccactgaccttcagaagcagaaaggtgatgctgtcagagctggcaggcacatggacaaggagaaagagtgcagcagtgcagacacctggaggcttaacacagtctggtgtaattggaaaattcaaagcttagtgtgtttttccaaaacatttgtagagaaaagtttgctactcttttccctcggttgcgccatttagagaaagtttcttcagcctctgccttcttcagacaatttgagagatgagaaagggtcttgcagttataagtgcctgtgaccagaaactccagccacctggtggacttggagcctcaaccaagggtggtgtcaagggaccacatgagcccttatgtgagatttcagatgagtgccctgaggccatgacagagcacaggctgtgaaggctgaggctgtctgatggttgcaagactgtcgctagacccagctgtttggaggaactcttctttcctgggaaaccacaccttggagagtaggtactgggcagctgctgcctgagcctccactcctgtgacagtgaatcaggcccttcctgccatcttgtttcattcagacatgtgaaagtcaggttctaagtccactatttccaaatcactcatgcaactttgaaaattatttgtatttccaaacctcactatactcagctataaatggagctcataaaatctgctgtgcttatctcacgggagtataataggtctgtaaaaccttaccaatacggaaagtacctgagtgttaccactcagtgcacagcagggatggcaggtgcagcactgatggtgaaggtggcttgtctgcgactgtctgacagacgaagttgcctctctagtgaccttgagtccgacttgatcacactgacttctcactgtcccttatcacagatgcatgtccttgggtggaaagatgatgaacttttagagtcagacagacctgggctggaattctggttctagaactgacttgctgttgacattggagaaaccctataaccttgctaagtctcagttttttccatttcctaaaataggattgtcaatatctctatcatagtgttgtagtaaaggttcaatgagatattgcaaggaaagtgactaccacgtagtaggccctccttaaatgctactttccttcttttctctagttcttcttcagttgtcatatggtcatgtgattacctgtgttgggtgtctgcggaaattgaattccttagtttctggtaatacaacaagcttccacccttcacttcatgatcttctatctgaattcttcttccactgtgtacatttaatcatttccacaacttcagcagcccaagataggagcccatcgttcccagagtcactggttcctgaggtctgggatggtggaagcactgctttggttggtactgccaatggattccaggaatgagctggatgtcagttcatggagaattcccagggaagagcctggagctcagggctgctgagtcatggctgtggcttcacactgctgtcttcactacccgtatcacctccacatggcccccaggctgagctgctgctctcctgtctctgttcagaataccttctgtgcctttttgcttatctagttcaaatccaatgaataccatgctcttgttttgccctcccaacactctgcaaatcacatagggcagagataattattctgaaaaactcaggggcagaaatattaagtgacctgcccaaggtcaccaagaatggggataagaacccaggttttgtgaacacccagtccagtactcctactaccttttcctgatatccttaggagcgggatccatgggaagggacctcagacccctagtgggttagcaaaaccccggaggtgattgctttgatttattattgtaaataaacccagtgattggggaaagaatgtaatgttttccaaaagatacagacattatttgagttcaaagtgcttccagtttccattcagttacacaataaattctgagaaaacaaagtaggtgtttactcagaaataaagagactattcagtctctatttgctcagtgaaatctattttccagagcttcttgcagttctgtgcatgttgtactggaaaggacatgggttatggaatcaaatccacttcgatttgaacctcagtgcaaccatttcctcagctctgtgagcttgggcacttcccttgacttcttagagcctcaggttgctaatccataaaatggagattataacacctttgaagtgaaccctgtacaggttaggagatgcccttcgtattagactatgctatgcgtggtgcccccagagttgtgtctcatggtggccctggttatggtgaagttaagtgaaataacatctagcgtgcttaatgaatttttgtttccatttccttagttggctacatgtctgctatcttacccagaattcctagcctctatcatgaggtgagtcagcttcctgtctcagcagtgctcttcttgcagggcactgcacaaaactgtggtggagataaccctcgatcttctcatgcaggagtccagcatcgcagcccttagagagatacatcagaaatctatggcatcatctataacgagaagtctttttctggccattttgaaggggtgttgggccacttactattttaggaagtttaggtctggtgatgtaaaacagtcagcctgcttttttttattctatttttttttcaagcatgcatggcttcatttaacaaatgttacaaggccctaggaactgagtgatttgcaagatgtggtttctgacttcaagaaactcagagtgcagtcagagaggtagaccaaggcaaccagaaactaatattcagcatagaaaaagtaatgatgggaggacatataaagtgttcatggctcaagaggaagaagggagtggaagagtggaagaggaagagggactgctgtccacgttcaaagcccaaattgagtctgacttttgtcgagaattgcttaacaggctgcagaggtggccaggaggtagaccagggctggaattcaagtcacctcatttcaaatctattgctcagtccatcgctccgcctcatgccacattgggtttttctttacatcatttgtttttccttgtctcactttttttaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcggtatgttctggggttgttctgtgaatggcagtgcttattgggactggctgggcatattgatggtatgggagacaagtggcccaagtgtggctcagcggaccagtggagtgggcccagggcagtgtttttttcagagtcacaagtgacacagagggagttgaacagatggcgctctaggcccccgcatcttttatcaattagaagagcttcattattgtttcctaatatttttagttgatatataataattagatatatttatggggatattttgatacgtgtattcaatgtgtaatgatccaatcagggtaattagaatatctatcaccttgaacatttattgtttctttgtgttgggaacagaatagttttattttcatctgttttaaatattggaattgtgtagaagatttcatttgaaaaagagagttccgctgctaccaataatcaaaagcctacaattgacctttgaaaagacttgaagcatagatctgcacatcatttccaggttctgaaattctgttgtttttcctgattagtggaggactctattggcctcaacaacctgggtaattttcagcttttctctttgaaaagatttaattgggtcagtaattcttaactgggggctatggaccaacttcagagggtcatgaatccctgcaattgcgtgcaaaactgtctgtggattaggtgtgtagaatgtatgtgtatgcgtataagtgtgtccgtgcatttttccaggaagggagtttgtagactgcagtttattctctaagggatctgtgacccaaaaaagtttcagagtcactggtcacaacatattaatttgcttttcttgaaaccctttgtagtgaatcaagatagaaagtctgtctatatttgtaaacctgtgtaacagagagccttatttctcttatgctgaatgtgttttccattatttgaaatgaatcagctaaagaaagcaaagcacaggaagctttgctcctctgtcagcctggaggtactggagcaggtgaggtcatacgtctccttttttatttccttcatttgactgccaggaaaaatggtctgaaacccagcacaggctctcaaagaaaagtaggcccaaactggattctctagagcagaaagaaatggtgagatcacagtttctacctccccaaataggcagctgccccgctggccggccccacctcaacttctgcttttgtatttttggtttttcttggactttgttttcaagaaactaaatgtgattggtttttgttcatccataatggagctaagtttctttcttctccatttttgctgcttatgtagcaaatgtttgggatatcctaggtattagctgatccttcttcttcatgtcaagttaatattgcgtgcctggctgaaattgtactgaagtttgagacagggcctgatagctctgttaattagaactacagctttaattttatgcactccttaaagatttggggtgatttaagtaaacattaatacaaataatatttttctatagattgcagtttcaacttcaaaataaggatttccacagaaggactttgatcctgagatgtaatcaaaattgcatgttagacttcgaatgttctgctgttatggggtatatatcctcttggcattttgtctaacaaatattttaagacattcatatattcttttatttattcatggattcatcaacaatacaaaggggaaagggaagggaaaggccctttgttgaagcccgagttgcaggcagcgtgccaggcccatacacttcctcctgcatctggaatttgttgagtctcttcccaactactggatggatcagattatttcaaatggttttcttttacaaataacattgctgacaaggtttttgtgcagataacttaggtaaccactattgacattcaacagggaaatatcctcagaagtgaggctagaagacacgagtaagagacattttatgacttttttttttttgtccatagcaagattttctatcagagagagtgtaataacatactctgcctccagcagtctcacaaaccagccaatggtgggctcagtcattttcaattatttttgatagtttactcatacatgttaagtatcctagatttgctggaattttcatgtcaaacagtagcataattttaaaacactatcatcaatacaagtgatgcttattatgcatctgctgagttcctaacatgccttgctcttttcatcctcccagaagtcctgtgaggttgataagattattggtctcattttgctggagagctaaatgcggaggctcaagtggtcacacaactggctaatagcagactgaggtttgaaagcagagtgcttgcttcaaagaccccactcttggcacctctgctgttgtgcctcataataattgtagcttcataataaaattcggtgtgattattcttttattatgttaaaaattttcttctattcttgtctattagctgtcctagagagaaagagaagggtattctgagttaaggcaaaggcaagaagcaaaggctgcacggggaaaagtgtgtttgggcatcacaaataatcctgtttggacggcatgtgggtccttgtgggtgaagatgggtgaggaacgaggccagaaaggtagctaggcattagctcttagagaacgttgatagtcacaataaggactttaggtttcattctttaagccatggagagccctaggaggtttttgaacaagggagacttctcacttctctatgagtccctgttttgtactctataatgtctccattattagggactattgccacaaccaggtcagaagtgccaggcctgcccaggctgtggtagcagtgatgaagagaaaggaccttacctgagagggctcatgaagtaagaggcagaacttactatctagctggaaatgatcttgagtgagaggcaggagccaggatgtctagcctgggagcaggctgtatcttaccaaggggagcatgcttccagaggaacgcagattccactttggatgttctgagactgaagtgtgtgtggatttccctgggtagatatctatgctgttgagtacttaattctagagaaggatcagatatcgagatagatttacaagtcatttgtatcaaggtgagataatggttataatccagggaagaagaccaattagaaaatctagaaaaagatttacatttaaaggacaaagaaaagaacagggaaaagtcagaagggtcagagaccggctagaggagaactaggtgtgcaccatacaatggaaggcaaagggggatggagtttgagggatgttggctgttggtatcaaagtctgcagaggtgggacatattcttgggcagaataaggactgagaagacacctgtgaactgagtagcttggagaacatgatcagttatatcaggggtcagcaagcttttcttaaaaggccggatagtaaatagttttggctttgagggccatgatgtctgtcacaactactcaactctgctgttgtactgcagaagtaacaatagatagtagtaaatgaacaggcctggctatgttccaacaaaactttatttacaaaatgagggatgcaccagatttgtccttcaagtcatagtgttttgttttgtttttgacggagtcttgctctgttgcccaggctggagtgcagtggcatgatctcggctcactgcaagctccgcctcccaggttcatgccattctcctgcctcagcctcccgagtagctgggactacaggtgcctgccaccacgcctggctaattttttgtatttttagtagagacagggtttcaccgtgttagccaggatggtctcgatctcctgatctcatgatccgcccacctcggcctcccaaagtgctgggattacaggtgtgagccaccgcgcccggccaagtcatagttttttttttttttaactctgatctatagtatgtctgttttcttcaaccggactcagaatgtaattttccataaatggttgtaggatgtattaggctaacttgaaaatataaaagcgtttggtgataaattgtgataaaatttctttcataataatttctagctatttagagttaactacacctagaggcagtggattttgatgtatttatgaatttactaacttgagctgattctgttgaattttctaagcgtgtgattgtataatctgaatacagtgatgcatttattttttcttctcctaatttgcctctttttctgagctctaattctaagttacagagaggtggtagtttcttttttctgcagcctttccccctcgctaggcttgtttgctgggatctcagtagttgtggatttctcttggtgatttcttagaggcctatttgagtttgaaagttcaactttcaattagcagggaggtttgacaaacaggatttttttctctttaagtacccaagtcagtttaaagttttctttttaaaaatttgatatataataattgtacatatttatggggtacatgtgatattttggtacatgcatacaatgcgcaatgatcagattgggtaattagaatatccatctcctcaaaaaagttttctcctttgattggcttttttcttttcctttcttttttttttttttgagacagagtcttgctctgttgcccaggctggagtgcagtggcgtgatcttggctcactgcaagctccacctcctgggttcacaccattctcctacctcagcctcccgagtagctgggattacaggcgcctgccaccatactcggctaatttttttgtatttttagtagagacgaggtttcactgtgttagccaggatggtctcgatctcctgacctcgtgatctgcccaccttggcctcccaaagtgctgggattacaggtgtgagccaccgtgcccagcctgattggcttttttcttagaatcacgtccaaacttcatacctgggcccccatgtccgtgtatgatctggttcctgccaacctctgtaactgtatctttgatttttcttcccctcactccttgtctacagtcaagtccctgccctcattgtggtcctgacacttgctgcatcctctgactggtggacttctctgaacccttcccaaggctggccatcctttgggtctcagctccaaggcattccctgaatcatcactctatgaaggaaattccctcagtgtctctggcacacagctcagcttgttagtgtcacagtgtttgtcacaatccgaaattatcttatatgtaggttgttgtccgtctttactgtctatgtccgtgcagtagaatgtaatatctctgagggcatggaccttgtctttgttgctcacaggcgtcgtctcccgtgtctaaaactgtgcctggcatagagtaggtgctcaatcagtatttgttgactgaacaaaacaattctcctttcttatggtcaacatcaagcatctgttctaacctaagccttctgtgctggatgttctccagtggcacctccaaatcccactctcacccttttccatctggctctgtccctgagaaattgaatttttttttttttttttttttttttttttttgagaatgagtcttgttctgttgcccaggctggagtgcagtggcacaatctcggctcacgctaacccccgcctcctgggttcaagcgattctcctgcctcagcctccagagtagctaggattacaggtgcgtgccaccacgcccagctaatttttgtatatttagtagagatggggtttcaccatgttggtcaggctgatgtcgaactcctgacttcaggtgatccacccgcctcggcctcccaaagtactgggattacaggcgtgagctactgcgcccagctgagaaattaaaattttgaactgcgttaattggcatttctcactctctggattttctctgggactggccaggagaagcagtggcattaaagctgagaagaagactaaggtcagggcacctattccgccatgtttcgccttgcagagtaaactcaagctgtatctttctcttgactgaaggtctcagatcctgccaggaggccgtcccagtcttggtcctgctctgtcccttttcccttcagttctatgagatccaagggaaggggcagaaccaggttgggatattgactccctcaggctccttcttgcccggaggttggcaatagctgtgttcctctcctaaaggcaacagctcccgacaggtgtccctcctcagctcagggtctccgctcatcaggccacagtagacctggggtggtaatgacaccctgcagtcatcaaccctggggctttagcctattccgtgttgatttctttaaactctaccccaacttggtaagtagtccttttatgaatctctcaattactccattggagcttctcatctcttttctactgggattctcaccaataatttattcatctgtgaaatggaaaagttgactaactgaagtttctgatggatctgtgtttctcatgcaattactactaatccctttcgaaccagtgactgattctgacaaaatgtgttgtaattctgagttgtgtaaagatatacctcctgccctatgtgcacttcagtgtacctgccctgtaagatgataacagtttggactgtgcccttctcagataattttcaaaccattttgatgaaattttgccctaggattgaggatagggttgtgttgttttcatgaatgatgtttctgtgttcctgaggtttagtacatacattggaactgaaataaagagagaggctttcatccttaattctgtggatatcctctttctaaatcatcttgtgttcagtcaaatgccctcacttccccaaatcctgtgtggataaagaatgatccaaaacaaacctgaataggacaatagaggattcagctgacccccagatcccgtgtagatttcagtggtgagccccaaacttgcttgaccgagtaagattgaaagaagttctcataggatcacaggatttggatggctccttaaagtcttcagttccctccttcatcagataggtcaacgtggggtagagaaacttttccaagtcttccaaacactgcttaaacagttgcaaagacaaggagctagcccaggaagcttttaggtttttcaagatggcctgtttgattttgactggatttagtacattgtttctgacaatggcttacaaagaaagagagagagagagagagagagagagagggagggagggaaggaaggagggagggaaggaaggaaggaaaagaaggaaggaaggaaggaaaagagagagaggaaggaagttagtttagctctctgacctcctcttccatttctgccacaccagttctgtgactcttccctgggcctcaggttcctaaatggaacgcctgggggttgtcttggatgccatagttaaatcctgtccatttgctgagcactgcatgcttttcaaagtgcaatggggtcctttgcacttgtgggatacactgaacatatggtagtgttttcatttttctgacagagatagaaatataatctactggtgataccaagagaatatctggtttgctgctttgataactggagtagctactccactgtaagtagcacactggctttgttcacttttctgtgtgcccaggcacaagcgaatgtctttgaatgggtttcaggaatgccacagtatggcccccttcagcccttacagtggctggcagacaggtggtcatctctgcctaggagctttacctgagcaccacacaaatactgccatttcgccctgtggatcatgatggggtaaagatggggaagcattattcccttgccccctcccccgcctctcgtctttctctttttctgcatattgccagtgctcatcacctcttttctgtttctttgtggtttatagatgatcatgacgcagtcctgaggtttaatggggcacccacagccaacttccaacaagatgtgggcacaaaaactaccattcgcctgatgaactctcaggtaaaatttcttctgtgcagctatggagtaagagaaggaccacagtgtgggctctaatgtggaatgtatctactgggagcatatctaggctgccaattaagtctcttgatcttcctgagttcctgattcctcactggagaagaagacaatgattccatgacccaacctgatgatgtgtttatttaaagaaaaaccctttagtattagtgtctgctaatggaggtgtctggtacccaggaaagtagagttgagctgtccttgctgctgcaaggtcatacctggaggtttacatgagggacagcagagcgcagaacatccaggggagagtggggagtgttgtgaaaagtgaatgaaacaatacacaggagagcactttatgaaccgtaaaatgctatacaactactataagacagtgtcaccatgtaattatgtgtaatatggcactagaattcatgtactatttcataaattcccctggataattaggttcccggagtattttcaggtagcacatgccgatttctcaatactaagggagacttgagaaatattcttgccacagggttctgttagtatattttattagtgggaaaaactgtattacacatatatatgaaaatatcaaaaattgcacaatagggctgcaacctgcccatctcacaaccaccaacatttgcctttttctgaataaacatatgtgctctgggggtttttatgtcagtatttagtctgcatacttccctaggagtcctgggcatggggtggatcctggaacagatcagaaatgccttttcagcagtgtctgtggaatgtgtgtttctttccttctctactagggctccacttccctatatctgtctcttcacttccttactttcaggaactcaccagctaggcagaagctgcttcctgcatagcccactttctatttgaagcccacaaccttaagaaacttttttttaaaattatactttaagttctagggtacatgtgcacaatgtgcagatttgttacatagatatacatgtgccatgttggtttgctgcacccatcaactcgtcatttacattaggtatttctcctaatgctatccctccccttgcccccaaccccacaacaggccccagggtgtgatgttccctgccctgtatccaagtgttctcattgttcaactcccacctgtgagtgagaacatgcggtgtttggttttctgtccttgtgatagtttgctcagcatgatggtttccagcttcatccatgtccccacaaaggacatgaactcatccttttttatggctgcatagtattccatggtgtatacatgccacattttcttaatccagtctatcattgatggacctttgggttggttccaagtctttgctattgtgaatactgccacaataagcatacgtgtgcatgtgtctttatagcagcatgatttataatcctttgggtatatacccagtaatgggatggctgagtcaaatggtatttctagttctagatccttgaggaattgccatactgtcttccacaatggttgaactagtttacactcccacccacagtgtaaaagcattcctgtttctccacatcctctccagcatctgttgtttcctgactttttaatgatcgccattctaactggtgtgagatggtatctcattatggttttgatttgcatttctctgatgaccagtgatgatgagcattttttcatgtgcctgttggctgcataaatgtcttcttttgagaagtgtttgtttatatcttttgcccactttttgatggggttgtttgtttttttcttgtaaatttgtttacattctttgtggattctggatattagccctttgtcagatggataggttacaaaaattttctcccattctttaggttggctgttcactctgatggtcgtttcttttgctgtgcagaagctctttagtttaattagatcccatttgtctattttggcttttgttgccattgcttttggtgttttagtcatgaagtccttgcccatgcctatgtcctgaatggtattgtttaggttttcttccagggtttttatggttttaggtctaacatttaagtctttaatccaccttgaattaatttttgtgtaaggtgtaaggaagggatccagtttcagctttctacatatggctagccagttttcccagcaccatttattaaatagggaatcctttccccatttcttgtttttgtcaggtttgtcaaagatcagatggttgtagatgtgtggtattatttctgaggcctctgttctgttctattcgtctatatatctgttttggtaccagtaccatgctgtttcggttactgtagccttatagtatagtttgaagtcaagtagcatgatgcctccagctttgttcttttggattaggattgtcttggcaatgcaggctcttttttggttgcatatgaactttaaagtagttttttccaattctgtgaagaatgtcattggtagcttgatggggatggcattgaatctataaattaccttgggcagtatggccctttccacagtattgattcttcctaaccatgagcatggaatgttcttccatttgtttgtgtcctcttttattttgttgagcagtggtttgtagttcttgttgaagaggaccttcacatcccttgtaagttggatgcctaggtattttattctctttgtagcaattgtgaatgagagttcactcatgatttggctctctgtttgtctgttattggtgtataggaatgcttgtgatgtttgcacattgattttgtatcctgagactttgctgaagttgcttatcagcttgaggagattttgagctgagatgatgggtttttctaaatatacaatcatgtcatctgcaaacagggacagttcgacttcctcttttcctaattgaataccctttatttctttctcttgcctgattgccctggccagaacttccaacactatgttgaataggagtggtaagagagggcatccctgtcttgtgctagttttcaaagggaatgcttcagtttttgcccattcagtatgatattggctgtgggtttgtcataaatagcttttattattttgagatacattccatcaatacctagttcattgagagtttttagcatgaagggctgttgtattttgttgaaggtcttttctgcatctattgagataatcatgtggtttttgtcattgttctgtttatgtgatggattatgtttactgatttgcatatgttgaaccagccttgcattccagggatgaagctgacttaatcgtggtggataagctttttgatgcactgctggatttggtttgccagtattttattgaggatttttgcatcgatgttcatcagggatattggcctaaaattctctttttttgttttgtctctgctagactttggtatcaggatgatacttgcctcataaaatgaattagggaggataccctctttttgtattgattggaatagtttcagaaggattgatacaaagaggtttgtacctctgctagaatttggctgtgaatccgtctggtcctggactttttttggttggttaggctattagttattgcctcaatttcagagcctgttattggtctattcagagattcaacttcttcctggtttagtcttgggagggtgtatgtgtccaggaatttatccatttcttctagattttctagtttatttgcatagaggtgtttatagtattctctgatggtagtttgtatttctgtgggatcagtggtgatatcccaatttatcgttttttattgcgtctatttgattcttctctcttttcttctttattagtcttgctagcggtttatcaattttgttgatcttttcaaaaaaaaaaacagctcctggattcattgatttttttgaagagttttttgtgtctctatctccttcagttctgctctgatcttagttatttcttgccttctgctagcttttgaatttgtttactcttgcttctctagttcttttaattgtgatgttagggtgttgattttagatcttttctgctttctcttgtgggcatttagtgctataaatttccctctacacatggctttaaatgtgtcccagacattctggtatgttgtgtctttgttctcgttggtttcaaagaacatctttatttctgccttcatttcgttatgtccccagtagtcattcaggagcaggttgttcagtttccatgtagttgtgcagttttgagtgagtttcttaatcccgagttctaatttgattgcactgtggtctgagagacagtttgttatgatttctcttcttttatgtttgctgaggagtgctttacttccaactatgtggtcagttttacaataagtgcgatgtggtgctgagacaaatgtatattctgttgatttggggtggagagttctgtagatgtctattaggtctgcttggtgcagagctgagttcaagtcctggatatccttgttaagtttctgtctcgttgatccgtctaatattgacagtggggtgttgaagtctcctattattattgtgtgggagtctaagtctctttgtaggtctctgaggacttgctttatgaatctggatgctcctgtattgggtgcatatttatttaggatagttagctcttcttgttcaatcgatccctttaccattatgtaatggccttctttatctcttttgatctttgttggtttaaagtctgttttatcagagactaggattgcaacccctgctttttttttttttgctttccatttgcttggtagatcttcctccatccctttattttgagcctatgtgtgtctctgcatgtgagatgggtctcctgaatacagcacactgatgggtcttgactctatccaatttgccagcctgtatctttcaactggggcatttagcccatttacatttaaggttaatattatgtgtgcatttgatcctgtcattatgatgttagctggctattttgcccattagctgatgtagtttattcctagcattgatggtttttacaatgtagcatgtttttgcagtggctggtaccagttattcctttccatgtttagtgcttccttcaggagctcttgtaaggcaggcctggtggtgacaaaatctctcagcatttgcttgtctgtaaaggattttatttctccttcacatatgaaggttagtttggctggatatgaaattctgggttgaaaattcttttctttaagaaagttgaatcttggcccctactctcttctggcttgtagagtttctgctgagagatctgctgttagtctgatgggcttccctttgtgggtaacctgatgtttctctctggctgcccttaatattttttccttcatttcaaccttggtgaatctgacaattatgtgtcttggggttgctcttctcgaggagtatctttgtggtgttctctgtatttcctgaatttgaatgttggcctgccttactaggttggggaagttctcctgggtaatatcctgaagagtgttttccaacttggatccattttccctgtcactttcaggtacaccaatgaaacgtagatttggtcttttcacatagtcccatatttcttggaggctttgtttgtttctttttactcttttttctctaaacttctctttttgttttatttcattgatttgatcttcaatcactgataccctttcttccacttgatcgcattggctattgaagcttgtgcatgcatctcgtagttcttaagccatggttttcagctccatcaggtcatttaaggtcttctctatactgtttattctagttagccattcatctaatcttttttcaaggtatttagcttccttgccatgggtttgaacatcctcctttagcttggagaagtttgttattactgaccttctgaagcctacttctgtcagctcgtgaaagtcattctccgtccagctttgttctgttgctggcgaggagctgcgatcctttggaggcaaagaggcactctggtttttagaattttcagcttttctgctctggtttctccccatctttgtagttttatctacctttggtttttgatgatggttttggtgtggatgtcctttctggtgatgttgatgctattcctttctgtttgttagttttccttctaacagtcaggtccctcagctgcaggtctgttggagtttgctggaggtccactccagaccctgtttgcctgggtatcaccagcagaggctgcagaacagcaaatattgctgcctcattcttcctctggaagctttgtcccagtggggcaactgcctgtatgaggtgtcagtcggcccctactgggaggtgcctcccagttaggctacacggggctcagggacccacttgaagaggcaatctgtccgttctccgagttcaaacaccgtgctgggagaaccactgctctcttcagagctgtcagacagggacgtttaagtctgcagaagtttctgctgccttttattcagctatgccctgcccccagaggtggagtctacagaggcagcaggcctggctcacctgcagtgggctccacctacttcgagcttccagggctgctttgtttacctactcaagcctcagcaatggcagacgcccctcccccaccaggctgctgtcttgcaggtcgatctcagactgctgcactagcagtgagcaaggctccgtggtcctgggacctgctgagccaggcacaggatataatctcctggtgtgccattttttaagacagttggaaaagcgcagtatttgggcgggagtgtcccattttttcaggtaccgtctgtcacgacttcccttggctaggaaagggaagtcccctgaccccttgcgcttcctgggtgaggtgatgccccaccctgctttggctcgtcctccatgggttgcacccactgtccaaccagtcccaatgatatgaaccaggtacgtcagttggaaaagcagaaatcacccgtcttgtttgtcgatcgcgctgggagctgcagaccagagctgttcctatttgaccatcataagaatatttttataacgggatagaaattgaggaacttaacttatttgtaagtggtcaccatcttgtttttttgttcttcctctaataccttttaatttttttttaagaaaatcactttctatcaccgtcacatcttctagtcacctctaggtgcttccaatgcctgtttgttgttcaaatttatattttggcttttggtattacttttattattattattattattattatttgagatggagtttcgctctgtcacccaggctggagtgcagtggtgtgatcttggcttactgcaacctccttttcctgggttcaagcgatcctcttgcctcagcctcctgagtagctgggattacaggcatgcaccaccatacccagctaatttttgtatctttagtagagatggggtttcaccatgttggcccaactggtcttgaactcctgacctcaagtaaccacccaccttggcctcctgaagtgttagtattacaggcgtgagccatcgtgcctggcctacttttattgttactagaagagataggattgaaaggaatggactggctagcaagaagctctctggggcaaatgacagttgagctagactttgaaagatgggcaggacttggggaaatagcaatagccgggcactccagaaagtggaattggcaagacagaggagaacaggaaatgagggaggcgttacaccactccaagagtagtgtaatgatcactcccctattagtgatcaggctggagtgcagtggcgtgatcataggaaatgagggagacattcagatacccctggctaagttggaggtggaggtgtagaagaattggctggccttgccccgtagagagagatgaggctggaccttcatggctgcttgtgctctggcaagtgtggaaattcagacagagggttaggaccagctttgtccctttcccttctcatgcctagtcaggaaccctggagctggagagcactttagggagcactaaaacctcatctccacttctatataagatgctacctaaatatccaggagagatgttcatttactcttaattaattcattcattcaacaaatgtattcagtattgagtagactgtggcagtcagtacataaactctatagttagcctgcttggggttgaaatccagctctgtctcttactagctgaaggatcatcaagttacttctctctaaaaaagggagaataattcccttacagggttgttgtgaggtgtaaataagaaaaatctgtgcaaagcacttagaacaatacctggcacatgtatcaataaacgttaactgcacttactattgatatttgcagacattggtaggggagggtacaattgtgagcaaaacaggctcagcctctgttcttatgatgcaatcaaatagttttacaaataaataaatttgcaaaaaagaactagagaagagagtggtcaaggtactaggagagccctgaaaggggagatttgagctattcaaggaggtcagaatccctaagtaggtggtacttggctgtgtagaaggaatgtgtggatgttgaaaagggtgggataagagcttttcaggaagaggcaacagcatgggtacagttttgtgtggaaggaaatgggggactggaaggactcaggaagaggtgagtatatgtgggactatgtggtgagagacaaggctgaaagcaagaaggagtcaagccatggtgctgcaccgaggcatcttcttttttcagtgggggtaggggggttggcctgtcacccgggctggagtgcagtggcgcgatctcagctcactgcaaacaccacctcctgggttcaagcgattcccctgcctcagcctcccgagtagctgggattacaggcgcccacaaccatgcccgactaatttttgtatttttagcagagacgaggtttcactgtgttggccaggttagtctcaaactcctgacctcaggtgatccacctgcctcagcctcccaaagtgctgggattacaggcgtgagccacctcacccagcagggtgagacatcttctttatggcatgatcagatttgcattttgtaaccatcactggctttcatctgagcagaggggctgcagtagatgaagacacatagttaggaaggtcttacaagtagtctgggttagatacgctgatagcttgcacaagagtaggggtgaaggtgaatgtgagaaaagaatgtatttaagggctgcttgcgatttgcagtcaacaggttttaatgtcgcattagatgtgagaagtaaagggagaggggccaaaggtgcagctcagtttctttcttgtgtaacttggcagctagaagttgaaattagaagtcagccccttatccatggtttcactctctgcagtttcatttatttgtggtcagctgcaggctggaaatactaaatgaaaaattccagaaataagcaattcagaagttttaaatgacacgttgttctgagtagtgggatgaaatcttacacatcttactttgtcccttcctcatcacaggaagaaggatgggtacagtacaataaaatattgaataaataagcaaattcaataaagtagcaggatccgaagtcaacacacaaaaaatattcattttttctattatgtgcaataacaatgaatgatctagaaaggaaatttaaaaaacaattccatttacaatagaatagcataaaaaagcataaaatacttaggaatgaatttaaccaaggagttgaaagacttatacaatgaaaactacaaaatagttctgaaagaaattaaaggagacacaaaaacctggaagacatcccatgttcacagattgaaaaaagtattgttaagatgtcaataataccgaatatgatatgcagatttaatgcaatcgttgtgaaaatccaaaagatatttctttttttgcagaaatagaaaaagctatcctaaaatttatatgaaacctcaagggaccccgattaaccaaacaatcctgaaaaataagaataaagctggagttctctcacttcttgatttcaaaaaatacatatgttacaataatcgagagagtgaggtacaaagacaaacatataaaccattggaatagaataaaagtccagaaataaagtcttgtatatatgtgtaaatgatttttgatgagtgtgtcaggatcgttcaatgaggaaaagacagtctttttaagaaatgatactgggaaaactggctatccacatgcaaaagaataaagttggacccttacctaacaccaaaaataaaaattaactcaaaatggatctatgacctaaatgtagaccaaaaactataaaactcttagaagacaacatagggcaaaaactttatgacatcagatttggcaatgatttcgtcattattacaccaaaggcatacatacgtaacaaaggaaaaaatatacaagttggactttatgaaaattaaaaataattgtatatcaaaagatactctcaacagagtaaaaagacaccacacataataggagaaaatatttgcaagtcatctatctgataagggattaatgtacagaatatatagaacactcttcaaacaacaataaaaaaaatcaaattacccaatttaaaaataggcaaaggacttgaatggacgtttctccaagatatacaaatggttagtaagcacatgaaaagagactcaactcttttttgctagggaaatgcaacccaagaatacaacacagcaccacctcacccccattagggtggcttctatgatcagaaatcggaatccgtgggcactgttgatgggaatggaaaatggtcagccactgtggaaaacagtacggcagtgcctcaaaaacttaaaaatggaattaccgtgtaatctaataatcttatttattggcgtatatgtacagaaattgaaagaagggtcttgaagagatattcatacccccatattcagactactcttattcacaatagctggactgcagaaggaacccaagtgtctgttgatgttgaatggatacacaaaagctggtttatacatacaataaaatattattctaaaaaaggaagaaaataccgagattggctacaacatggatgaaccctgaagacattatgccaagtgaaataagccagtcacacacacacacacacacacacacacacacacacacacacaaaatactatatgaatgtggttgccagggaatgtgaggtgggagggggaatggggagttactgtttaatgagtatagagtttcaattttgcaagactgaaaaagttttggagatggtttgtggtgatagttgcacaacaatacaaatgtacttaatatcactgaactgtacacttaaaaatggttaagatagtcaatgttatgttatatgtattttaatacaatttttaaattggaaaaaatgtcagtaggggagacagtcacagaagtacaaacactgtatgattccactttatatggaacacctggagtagaaacaaagtagaatgatgtttgccaagggctaggaggagaaaggaatgtggaattgttgtttaatgaatactgtgattcattttgggaagctgaaaaagttctggagatggtggtgatagttacacaacaataggaatgtactaagctgaatacttaaagttgctaaaatggtcaattttatgttatgtatattttaaaagctttcttttaaatcaacagggagaaaccagttgatagagggagaaagtgaatatactaaaaagaggagaaaatgattagttacccacaacatgatggtggtggagccaaagcgtagtggaggatgaaccccagcaggcgggagtcagagggaagaaggtgcgagtggtgtagctggaggcagtcagtattagaaggatgagagggcttctattttctctgcaaagtggcatgcaaggccaagtcagaaggaggctgagggggaaagaggttttagtagagaaggtttgaacaaagagatttataattgtcattgaggtgagtgggaccgtcagtaaacctgatgaatggagtaggatttccaggccatgctgggctactttgaggttgaagagaatgaatttagagagaaaccaatctctgtttgatacatggatggtaggatctggaggtgagcaggcagcagcaaagaggagaggggagaggggaggagccctccctgagcactctcttggactgcggaggctacctactctctgagcacttcttcgtgatgattcagtcttcctcactgtgaagaacgaaaccccagtcctgcaaagatttgaaactgtatttaaggccaaagtaaggttgcctgggaattaagagtactggagtcaggcaggctttgatcagatccctcccccaacacttcctgtgtgagtgacttcagcaagttgctttactttacctttctgagcctcatttcccttacttgtaacacagaaatatgaatagttactatccagggtttttttttaggatcaaaggagttactatgtgtggagcatgtcacccagaggctggtatgcagcaagtgctttgtaaatagtagcgatgggcactactgaaacctgaatgtctgcctctgcctgtttgcgaatgactccaccttcccaaatcccaacagggaaggtgagtcagcttgagaccacttgagaggcatctagcagaagggaggcaaaacttctgttaaaggataatttttagggaaaaaaaggtaagatgatgactctcatacagatattaaaaatgaattcatcatgaagattttattttactcgtatgatggaaccaggcagatattacaactggttcaaaggaaaagtcaaagcaacacaaatttggagtaaaggagttgaactagtttttctgtgagataaggcagggggaggggagaaatcaattgaaactctcctgggcagcatcctgcccagtaggcacatgtattagttgcctacaattcacaaagggttgcgaaatagctcccgtggaatcagaatctgacagggaggaagagtgtgctcagaaaatgcatggctttctactgaagcagatttttttcccattacacttctagatctctgtgcaccattgtgccagggctgcgaggaaggtggcccacttcccgggatacactacccaccctcaagagagcctttcctgctgcttcttaggcaagtcagctctcttttctcacctcctgtaagcaacactaagtatctggctgttcctttcgtactcgagtcctggccgctccatgacagcacttgtggtggtactgaactgtgatggacactttctatcattgccctttcttaccttgatatcctaaaaagctggtggtctgtcttctctatcttttgtcctggtcagttatcctaactattttgtgtctgtttctgtggattagtaaacggggtccccacccccactccacaaggagaacatctggcacccagaagtcactgagagaatagctgttgctttggtagaattctgcctctgagtggcttgttcttttcccagacggagaggtctcctgacagcagctctcttctttttcttttttttttttttgagacagagttttgctcttgcgctcaggctggagtgcagtggtgcactctcggctccctgctctgcctcctgggttcaagtgattcccctgcctcggtctcccaagtagctgagattacaggcatgcaccaccatgcccagctaattttttgtatttttagtagagacagggttttgccatgtttgccaggctagtctcaaactcctgacctcaggtgatccatctgcctcagcctcccaaagtgctgggattacaggcatgagccactgcgcctggctttagcagctctcttctaaagccatctggacccacatttgttcagctcccctcccttggccatgatgaaggcatgcaaaacaaaaaaggcacttttcttattgagaaggtggctttttatagagaatggtgtcatactgttaggtttcaggccagcagacctagtcaggcatgtgacacttctgtgccaggtgtggctatgagagtcaacaggaaaaatgatatatgtaaatggacaggtctttaaataaatgcagttttgactataagagtaagaaggtttctgtgagactcaactcagtacctcctgtaccctgtgggcctgagagaggagacaatgggacaagaagacccagtggcttccttggaagcttttgtgctagctggagagagaagacctacttcctatatgcctagcaacagtccacactgactggactgcaaccaggacatttccagattactcagtggggcttatcttgaaataatagttgatgccatttgttaaatatattatatataccatctaagggtcttacatgccttctctcatttgatcttcatggcaaaccctgtgaggtatgaccaccaaccaccattttacctcagaactcaggctcccagagtttaagttgctcacaggagcccagaaagtaagcgacagaggtgggatttggttctaggtgtttgccaccagcactttaaatcaccaaagctttctggaagctccaacttttcttctcaagatactgaaagacaggtatctggatgggttggcagggcgggtgggaggtgggcgagatttccatcaacaacgggtctaaaaccagcgatggtgagctgggtgattttgatggaacccctgccatacagtctattaatatcataattggagctaaaatttaatcatgatggcaatcatgagttctggggcttcttgatttgggccagcagacacagtctcagtcactagttctccgaatcagagaaaggatgccttcaggctgtgtcttcacatggcttttcctctgtgcgtggtggaaagagagagctctgcgggtctcttcttgttgtaaggacactggccccattggattagggccccaccacatgacacatttaatcctaattacctccctcacagccctatttccaaacagggtattagtcacattagggattagggcttcaacataggaattctgggggcacacaattcagtctataacagagggaaaacagatttgagaagaaaaaagtccaaaatatgcacagtggtaatatctgaagatgtgcgtgcgtgcgtgtgtgtgtgtgtgtgtgtgtgtgtgtgtttctattcttgcattttctaactgtccccagtgagtatttgttactttctaactgagaaggttactttaaacagtgtcttgagcagcagcactccatgccctggtgtagccttttcctggcagatgttccccagggctctgctgctctgccaatgacttattctcagcatgaactcctcccctgccccctaagaggatctccaaacccaggtcacactccccctgcaggtaagtacaggcgtttgagaacagctttattcttccaggaacagctggtcccctcagcagggccttacaaggtggttatgtctaaataaggcacctgaggccaggagatgtgacatggtccatctaataccatggagtgagttagacacagagcaggactggaacccatgcttccaattccccatccagttttaaggcaatcttcttttctttctttctttctttttttttttttttttttttttttttgagacagagtctctgtcacccaggctggagtgcagtggtgcgatcttggctcactgcaacctctgcctccggggttcaagcgattctcctgcctcagccttctgagtagctgagatttcaggtgcccgccaccacgcctggctaatttttgtatttttagtagagacgaggttttactatgttggccagggtgatctcgaactcctgacctcaagtgatctgcccacctcagcttcccaaagtgctgggattacaggtgtgagccactgcacctggcaaggcaacctttttttttttttttttttttggtagaaaatctttgaacttcatatagatggtgttaatgtgggtgagttcagagccatgtgtaaagttccaggaggggagtgcttgctggcttctcccttatccctcaaccagatcccagccccagccactttctgtttctcttctctggataaaactatcattcatcttcacctgtttctattttcatggattactgtctcattcatctcaagtagctcaagtgaatggctgtttttccattggatacaggaagactgagggtgacctgaccctcatggtgtgcttgcttatttgaatgtctgatggttttatgggtgtagtcctgctggagcagaaagaatatctgttaggagcctgcctctgggctctggttctaactgtgccacaaactcatcgtagccttagacaattctcttgtctctctgggcctcagtttacccatctggaaaatgatgggtctgaatttaataccttgagtatcatccagctgtgacatactacaactcaggcaagaagcaaattctcctgacactccatactcctatccagtgttctctgacgtccttccccaagagctgtggtaccctaccctgcccacattatgtgaggcattatagcacataggttagaagtgtggtctctgggccgggtgtggtggctcatgcctgtaatcccaacactttgggaggccgaggcaggtggatcacgaggtcaggagatcaagaccatcctggctaacacagtgaaaccccatctctactaaaaatacaaaaaattagctgggtgtggtggcacatgtctgtcgtaccagctacttgggaggctgaggcaggagaatcacttgaacctgggtggcggaggttgcagtgagccaagatcgtgccactgcactccagcctgggcaacagagcgagactccatctcaaaaaaaaaaaaaaaaaagaagtgtggtctctggagctagacctaagaatccaattcagactctcttacttactgactgtgtaatttggacaagttacttagcatttagcatctctatttctttaatcataaaatgaacatattaacacttacttcctagggctgttgtgaagataaactgagttgaggtatgacagtacctagcatgtagtaagcatcattaaatggtgtctgttgttttcacatattgtaaagaagaaagcttcgtgcatctcttggaatttctgaggacggtgaagccacagctgggaaagtctcagggagccaggagttgctggcctcctgctttgcatactcaaaattgctggaaaggggctatagcagggggagacattttttaaaaatcccagttattgctattcctcatgagtatgtatatatcacctggcatcagtactctgcatagaaagaagcatagctaaagaaaagacactttgcttttaatataacagctgttttcaggggaatagggtggatgaggatagggagtactggccctctgtcctcaggcctccctgtcaccagctcagtcacgtctatcttacaaatccccatctagcaggaagcctgctctgcccttggactatagacctgaagggctgttgttaagttacaacgttcccagtggaaggaggacagtacttaaaagttacaagatgtgggttctgttcttagttcttatggcctgtcagccagggaactcctggccagtagtctcatccttgaacttcttctttttttttttttttctcaagacggagtctcgctctgtcgccaggctagagtgcagtggcacgatcttggctcactgcaacctctgcctcctgagttcaagctattcgcctgcctcagccttccaagtagctgggattacaggtgcttgccaccacgcctggctaatttttgtatttttggtagagacagggtttcgccatgttggccaggctggtcttgaactcctgacctcaagtgagcccagccctcatccttgaacttcaaatttccaccccaccttactcccacaggcatataccagttgttcctttttctctgttcttatgcaggaaatggcctgaggtccaggagtccccttggtcccctttttccctcactctcaacattcaattagtcttcacatctacagccgacaattgtaacttcttttctttactccattatttcttaggtgacaacaggagcttctttgtggtcttcttttttctaaaaacactaattcagaactctagcatgtttagatcttccttacttaaaaccctttcctggtccccataacctactgaagaaatcctaagctccctggcttggcctctgtctacatttctctgatctcttccagctctttctctgtatcctagccatactgaactacttgcaattcccaaacagggtacacactgtactagttgttcctgcaagagacaggaacacacatccccccacactagcttaacaaaacaaaaaatgcatttctctctcatgcaaaagaagtccaaaagtagacattccaaacttaatatggtgttccagtgtcagaatccaagttctttctactttgtgggtttgccgttctcagcatatgacttccactttatggtccaaaatgactgctcaagctccagccatcacatccacatttcagccaggaggaagaaggaacaaggaaaggcataaccttgcctctaaggatagttcctggaagccacacttgcttacattccattggccagaattagtcacccagccatatttatctataagagaggctatgaaatttttttatttcagggagtctattttaggttgccatgtgcaaaagtaaaaaccagaggtgttggtggtcaaggaagaaatagcgaatggatgctgggtaacatctggcagtctctgccacacactcacacattcaggggtttgcacgtggttccccgtgtctcagacaccccctctctcatgcttacagtctctgcttggcatcttcttttttgccccctaacacttgctcttttttttttttttttttttcgagatggagtctcactgttgccaggctggagtgcagtggtgcaatcttggctcacggcaacctccgcctcctgggttcaagtgattctcctgcctcagcctcccgagtagctgggactacaggcacccgccaccatgcccggctaatgtttgtattttcagtagagacggggtttcaccatgttggccaggatggtctcaatctcttgaccttgtgatccacccgcctcggcctcccaaagtgctgggattacaggtgtgagccaccgcacccggcccaacactcgctcactttatggccatcctcatactacctctgttgttgcaccatcacagcgtgttaaccattgttcaattgtccacctttcccactaccctgtgacctcctggagggcagggactgtgtctttcctttggctccttagcacccagtatagctgcacaatctccagccaaggtagaccgaccaccaatatttcttgtctcaaagatatattgaggaaatgagagtatattcttcaggcttccaggaacttccttacatctgtaggaaggtatgggcatggggatagctcagtgattgtagaggctcgtggcagattgcttgctattctttgggttgcacacaggccgtctctcttgccatagttttttccagatactgcagtgacattgattaggtctcagccttggcgatgtagactgaggtggagagggattattgtcatgattcttgctttcgtttcagtcagttcttgatttgatttctgccatttattcctctcaatttttacctgggcaacatcatctcccgcctgctttttaaggtgaatgttgacagctgatttcatatattaattctggctttcttaagagggacatggctcccttcattcttaagcctttggggctacttttctttctcattcactcatgatctccatttgatccgcaagacagctcatatttgagagagcagagcaaatgtgttattcccatttcaccgatcagaaaatgagggccggccgggcgcggtggctcatgcctgtaatcccagcactttgggaggctgaggtgggcggatcacgaggtcaggagatcgagaccatcctggctaacaaggtgaaaccccgtctctactaaaaatacaaaaaaacccccaaaaaattagccgggcgtggtggcgggcgtctgtagtcccaactgcttggaggctgaggcaggagaatggcgtgaacccgggaggcggagcctgcagtgagccgagatcacgccactgcactccagcctgggcgacacaggctgtgtcgcctttttttgagactccgcctcaaaaaaaaaaaaaaaaaaagaaaaagaaaatgagggcctagtaagattactcttatttgctcaagatcataggaaagttagtggcaaagccaagagttgatcctggatccttttgtatccaagaccagtatcttttgcaaatacttttctttattttgataaataattaacatttacatgcattattttcccccagaatttgaattttttcttaggatagattcctaaacatggaagtattgagtcaaagagtataaatgtgctttaaaaaaaatgctcttaatacattttgcagaattcttcaagcaaggttgtcacactcatgtttaaggcaggtataactacccatgtgcaggccagcccaggagccagtgtggtggggagaggccataaccagccattgctggttccctcagccagcagaggcacacatgagcttctcaccagcccggtgagggtctcctgttgggaggtgtgcatttttgcatgcactctggcctctgcacacaaactgaatatttcatctggtgctcaaccacaagcacagccatctgttccgtgttggaacagatgtgttggactgtgttggctgtgttggactgtgttggctgtgttggacttcgtgagagagcctatgtcagtctccatcaggatgtgtatgtagtgtactggactctctaggtgattgaaaggattccagagataattttgattatatgagtccctgacttcagactccactcttgtgaccaccacacaagctgtgactccaggaggctgggatgccgtgctattttcactgtacccttgcccccgtaatctcaaagcctgactggatggaaccctttctattctatggctagtggcttgtgataaatgtcctttcaggtcaacacagtgcaggctggtatctttacctttctttcaccgaagttaagtgctgcaccagaacttagaagcctcatggggctctggggcctcaggctgtaccttgtgctatgtcagctattacttcatgtcaaacatttgcatatgaatgttcaagcgacagcttatctctttcttcctgcagttggttaccacagagaagcgcttcctcaaagacagtttgtacaatgaaggaatcctaattgtatgggacccatctgtataccactcagatatcccaaaggtaagtgggtgtccgtgggaaataggggttgagtttcctgtctgtctacagattttcctgatttcctaggtttttaaagtcatggctgacattggctattcctaaaggctgggtatttgagttttagggtaccccatttcatctggactagcagattcagaagtattcctgtcctataccagctactctctttgccgtgccagcactgccaggtattgtctcccagttatagtatttactgggatagtggctggagttcccagcatctggggtagattgttcattaatgcaattattcgtgatgagcatcagcagaactcgagagtagttgccgttactcctgtaaataatattagcacacttttatttcacacttccaatatccagaattcttcccatttcactctcataacaatttaaggagatagatggaagtgtggttgttcccattttacagatggggaaattgaaatgtggagaatgaaagtcccccattccaggacttgatttactaagcagaaggcgcagatctgcaacagcagctctttccggggaaggagacatgagtggcaggcctgctggattctaacctctctggaatagtcctctcactgttaatgcatgtcagttgacctctccctgatgcaggctgctgtggcctcaggagcatggcctgagaagggcagagagcactaatcttgggacacttaactcttaagttggatctaccaatgcctgacaggctctggcgacccctggcaccctcactatctgactttcaacagttttgcactgatctcacttagaactcaaatttgcctaggtcaggacaaggactctgaacccatagatgtcctatgctctagttttctcccctttaaaaatgagagatggggccagatggtacgtggggctcttttcagctctgagagtgttcccggactctgatcctgaagcctgaagctgatcttgggtcgccaagctcaactctcccccaaagcacaggctataggctaggccccaccctgctatccagtgaaacctgcggctggaagagaaacctgtagtctgctgcaagaaaagggctgtgcctcaggagcaacacttgttgatcctttcccctccccatgtccactgatgaagatgactcctggggggagcagctcactggcccatttctcccttgagaggaccacttctttctttttcagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtgagttcatgtcggggaaaagaccttgcatgtttgtttctagaagagatgagctttttttctggggtctcattcagtcattcgtttgttcatttgttcactaaacaattgctaggattctgctctgcttgtagaccatgccaagttctatctaaaatacagagggaaatcagatagaatcctttttcctgagggcatctattggggaggtcaatcagatgtctgaggcaatattcaatttgtgccagaagggagagacaacctggtgtcataggagagaggacaccttctagctggacagttgcttatagcctcatggaggaagtagtgttcggtaggctttggagaggggagaatttggcagaggaagatggagggaagggaagctatgaacaggggagggaggtgggaaaatgaggagcggggctgcacctcagacgaggggagcaaggcacttttctcaggtgtacaatttaagggcgtaccccttaaaaactcagtcatcaagataaataatatttcactacagtatcttcagaaaacacaattaatgtaaaaattatgatgagtgaaatatcaagtatttaaataaagataggatcagtaacagtgctgtgcagagtttattggaacaatgctggccaggggcccccttcttggattttctctacatctcatcattcagactgtggagtgctcctgttccagctgtccctttgcccagctaagggaagaaaagtcttccctccccaacactgtttcatgcaaatgctataaggaaaaatctgctcccaaatagcaccatccaagaggttctgcaggatgtcacagtgctagaaagtgctaactacacatgatgccactgtctcctcaatcagctcagtaatcttgtcctctttctccaaataaattattccatggatacattcattggctgattgatggagtcatttaatctactagcatttagggaggatctattattcaccaggccctggcctaggtgctggggattcaaaggtgtataaccctcacacagccctgcatcctaaggaacactgctgggcttggcttgctgaaacttagattgggaatcacagtcataaatagaaactccagagggaaagctctccaaatttggggtcatgagctgctgaacccactgggcagagctctggggtgctggggtgggttgtcaggcatgactcacctctgctcccctctccaggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaagctgcttctctcttcttatttgctaaatgaacaactgctgattgccaacttttatctccaaagaggacacaactgagatcctgaaccccccagtccttacccactggctcctctagccttagacttactcctcagtactccaggaaaagaaatgtgaactttactggaaggatcacctctttgaaatattcactggtttactgatttttttatttttattttttgttcttgcctggattcacataactaacctgttgcatcaaagaagagatggagtcgggcagaaagcagaacataaggaagatccttccctcggtttccaaaactctaaaatccttaaatgaatgatgtcttaaaaggatttaaaatgtttggacacaaatcttgagaaggagcatgagttaggggagagaggat

SEQ ID NO: 17009 - DNA, 205163 bp, Human
ccttaaatttgagagaaataattttcttctatctttatacctaattttcttttggaaagaatcttgaacacaaaaaaatctgtgctatttttccatgtagaaccaattgaagaaatatttccaggaattgattttatatatttttttgggtcaggacagcagggataaaatcaggtctagagtttccatgtggatgaatttggaagtgaacagatttgaagctgcagtccagggatgtctcacactacaccatactgtttttcttttaaattgaatcattttctctaggctttgaaagttaagaaaacatatttgaagaattgattttgtatgtaaatagaatgcttgggcactactgcatttcatctaaaaagagattcctgtattttcactgtcttactgggatagacatcttatgaaagggcatatagactcttgctactcaaagtgtgaactgtggacaagcagcatcaacttcagctaggaacttcttagaaatgcagaatctcaggccccaccccagacctactggatcataatctgcatttcaataagatcctctggtgatttatattaacattaaaaggtaaaaagaacttgccatcttttttctctgaatctacttcttaaaaacatagaattcattgttactctactatgatatttaaactgatccaaagttagtcatttacggagtaaaaattaatcatattattttgttttaaaattaagacctccagtaaagcacataggtgactaacaaggaatattccacaaaaagtaggttactctcctagcttatggtaggacatgcatttttcattcccccttcccagaagctgctaattatccgcattggactatctacccttcctcttttttattaataataatatttgtaattttgatttgaaatagcagggttactcgtcagacttttgtacagatttatgaacttccactattttcagtccctttagccaatttaggagaatagcatatgcactttattacatgactgttcctagtgattaacatctggaatgggcagatgaactaaactcccagttgcacttttccttgctccatttctaacatggagccctgctctaacctttaaccatggcaagaaaagattgctactgccccctgccggcccattgtctcatttccttttctacaaatctgtgacttgcggatgcccaaggattttgagccactgaagaaagctcagttggaaggggctttccctagtacagaggtagagagatcctttgggactaggcggctaaaatcaaatgaaaacattaaaaaggcgaggaaggcataaaggacttctaaattaaattatcgatcttcatgaaccttcttctgcacgcgggcttctctgtgccaaggaaatgttcccttctcttcggcacaggactcctctttgcctccggcttgcactgacaaagagtgaactgtccacacccttattataatttcagtactctgaatcctgttctctgtttcccccaatttcgttttcccacgattaaaccttattcccttcccttttctgcttcaaattcccgtcccgcccacccaccgacagcctagcatttccaggagctcagaccccacttccctcaccctctccgtctcccgacctctcttctcctcttgctgtcatcgtacccccttcagtatcccctcgctgaacggccagtcactctttgccttcgaacagcaggcacgtcccctcttgaatgcttttccccgacccccgccccaagcaactgaaaaaggaaacatgcgcacttcagagcttggagctgtccgagtgctgaaatttataggctgggtaagatcacgtctccgtctcattctatagccctcattccagcacaggatctcagcaatttttccctcttccccccacccactccagcgcgcagagtcctttcttctctctcatttacaacttctttttaaaagaaaacattttctagaaaaagggctttgctaaacagaaaagatataaaacaaaagccacagctatctagcatggcattgtcaccaactccctttgcatggtgatgcgattaaggtagcagcatttttattattcaggaaaagcagctgggggattcatcagttctgaggctttgtctttctgggttaactgatggtcccaagcctcggtttgacctgaccatgatgcccaggactggcactttttcttttttctcagcaaactgtacaaaaccaaatctctttttgattttcaaggaaactaggttcctgccaaattttgaatctggacaataaacagacactttgtcctagcatctttctggaatcatttcgggatattttccacaagcaacacagaaacaggaatgaaccggcagctagtgaacattttgacagccttgtttgcatttttcttagagacaaaccacttcaggtaggtgaaacgactttgcatgttgatatttaaattgtttaaaagagaatgtgtcatgtaattgtgtatttatctgtgctctggactatattattttaattttatagaggaaagttagatatcttttgttcatttaaaacgcctaataattgtgggagggtggtaaatttttcacaaaagcaagttttatgatgcatagccgcactctatgcaattcaacacacattttcacagccaacgtgatattaaggtagtctgatgagttgcatgctctttacatttctatataagggtaattatttttctgaaagtaatttaaagagattattgggtgcagtgtttttcatataagatgattgtattaatttggcaggagcatgctcattttagataaaatataaaagatccctaattctcagccaacttgggacttctgttatatttcagaaactagaagcatactatgaggactacaattcaggaattttcttgaaatatcaaaaatttctttttactactatattctactattcaatctgtttggaaatggattgcctaccaaaatttagttaatatgacataattgtatttatgtacatatgagaagtggagcatgcataattttaaaaagtgagaaattactattttcatgcttgcattttctacatggtttacgaatagttgccaaatcaattgatacctcaaaatatcaaatcattaccagtaagtgaaatagtcatctaataacagagagtggaagactgagcagagacaggagatgctcttacaacaaagtataggactctaaatttaattttcattaaattttatggcattttttcacagaaccaagataaatggaacacatagtaataatgctatgaatactgggaaaacccactatgttcctttcaggtttacacctcctactatgattaagaaaaaatataggctggtttttattagaatcatcatcatcatcatcatcctcaccaccaccaccatcataatcaaataatacttgattaatcagatgaatctgcatatgagaatgtgagtatttatgcatgctcatatcaatttttaactcctacaaaatatttatatcatctttgcacttattttgaataccccttctttgaaaagctggcaagaatgtggtattttcttagtgatagaattcataagacactatttgttaaactattgaaaacaaagcttataaaatacatactttagggaagaaatttcagttaaccactatgtattgtgaaataattaattttgctacaaaccaaatatgctatgtttaataagctctttattacttttaacaggaaaatgaaaatctgagaaatttttcaccaactttcagtgttttggtgataaaaagtcaaaatgatttagaagtgtgttttcatcaatattttttagagagtcaacaatttaaatgcttatataagcatttaatatataagcatataaataactgataaaataatagaagtcatatacatgctcattgttgacctattttaaaaagaaatgaaatgtccaaatgaaggttctcttttagatatcacattgaaaaatattaatagttgatagttggattagaactagcagatgggaaaaataagcaatgaaataataagtttgttctgcccatcttattatatatttcttataaaaggtagatgacttatatttagggccgaaatgctgaaacaatttttttaagtcagatagaaatgattttaagacaatcacatgaatttaaaaaaatatcatctcatttctctgaatagttttaactatatatacataaaatctacaacctaaaactaaatacattgtctgttctcaaacatcttatggttaaagtttggaaacctgggtgacgcgactcaggatttatagttctcatcatttaaagttaactttagaacatgtacaagttcagaagttggccaaagagtttggatttttctagttttcttcatactaacatatcaaatatctttaccaaaatgtaaagttaaaaatgcagtgagcgttagctctcaagggatgcaaatgaaattgttgctaaaagagttaatgatgtgtttaggacggctttctgcaaagaccatgactccaggtctggaaaacaaccttcacagaccctatctccttcagatttcttggacaagttaatgggaaggacatcaggatatgatgcaagaatcaggccaaattttaaaggtaggttccacttaaacttacgttaagcctttgagaaatcttctagatgtttgaatagttaactgaaaaacattttcagggcttttaattataaaatgaaaatgacaagtatagtgttcattttattttggtattcttttgcgttagttactgatattttcattttacctgtcacttcccacatttgaaaactttccttgtttgtgttctatttcacaaataaaactagtgtcataaattatggccacagtccttattttttcgtaagtgggagtgtggctgaaagtgaatacaagagcaagtgatagacttgacttgcttgaatatctaccaggatgcatgcaagattcagtggttactccaaaatatttggttttgattttaaatacctacatcaaagtagagtttaaatctctataaaatatgccactttacatactttcaggcctctttaatttttagacttcgtaagaagaggttctaattttttgttcctttttgtttaagcattctcattgtttatttgaaattgtttatttgaaatcaacaaagatcacagaattttaaagtgcacatgtcaaagatggtggatactttctttgttcaattagaagcaaaccaatattttttgtttttatttgttgaacattacaaaaatatacttaatagtctgcagaaatgctttttaaatatatttagtttatttttattctgaatcagaaaaaaagaataagaatcaattactaataactgaatcatgttgatgctttaatttttaaatacatagtttaagtgatgttgtctttttcttgtaatgaaatttaacataatgcattgtgaagtgtttataacattttataaaaggagaaacctataatgttctggatattatgtagcaattcatgcattgcttacttttgtttattagcaatttaatggcacacttttcttcagtgttgatttttattattggcaaatataagcatgaaaactaaattttaaattcatttcttctttaaatgttacacctctgaatatacccaggtatgggcatattttataaagaaatatgtcagaattttggtgaaatagtattttttaagtatctccaagagagataactgaactacattcagagataaatttttctgaaaaaaaaaaaaagatggtcatgttcatcccatttcttaattttgtggtcattgctttggaagtcaatatttgaaataaaatcttgtgagtaacaaactgagaaccagctttcaatgggattgctcattcatatatttatccactaagtcattgaacaacttttgagtctggactatctgcaaaatactaactgttgggtgctttgtaaaattgggagatgaaacagtttaggtgcttctatcaaaaattttagtggagggaggagatgttacatgaatacttttactattagatggaaataggaaagtaccattaggaaatacaggtaaatcactacaggattccaagaaatggaaagataatttcctattaagatattaatggaaagctttatagagaaggtccagagatggaaaattgtttcaagtttacaagcatcttctttcatagctgttattcatttctttctagaaatactttttcaaaagggcaggaaagtacaaagagtaataaaacacacccatgttgacattgctactttaagtgaccacacaagaatgagccatcatttccacatccaattttttcctggttcttccggggatatcacctttgggaaatgatatttatcatggttccaaaggataaataaatgaggagaatgtcaggttcagcaaagtgtggccatgtttttttttttttttgatctatctactactttaaagtctaagtacaggatattttaatgacttataaaaaagaaatggggtggatatcacagaagactctaacattagtgggattcattgagttttatctccctctccctttaactctccaattcaatgaacactgctaccttttcataaaatttatttacatagaccatttatatcagatcaattatctgacatctcccaaagttctcttcatttgggggagcttgattattcctggatttaaaacactccccattattttagactacaataattttttcttgatgttcccatggaattttatatgtctaatatgatccttctacatatgtatattttattgatccattctcacaccacatctgagagggcagggaagtaccttattttatatatacatacatacataaaatattggtagtgtagggaaaataagtgatccttttctccaggataaggaaattagaaccaagacagagaggaaaaggtagatcaattaatgaagattagtgcttccaactggttgttgtagtagaatgtgagggtggtaacttttgagagaccagccagtagtcatagtggcaagcaaagatgatcttagctgaggtgaagagaaggaaagaaaagacagagaaaatagggaacttgtaacaaggaggaggcttagataaacactataatacttaccatagttgattagcaatgtaccaatgaggaatttaatatagtcagtagaaatgaagggagattaggaaatgtgaatgcatacagaatagtaacggtctccctgtaaatgtgaaaaagcaattttctgtgataactataaacatgatagtgatgatgatgttgacaattaaaataacggtgactgttaagaagatagaagggcaaaatttgaccaccagaataaaatcaagagccaaatatgggccactgaggtaaacagaatggttattctagaattcttattaaatattagcatatttctctgttttccttgctgccctgcattggcaagggaaaaagaagtgcataagtataatttttcttattggaaagaatttttcctgtatactttcaagtcagtaaaatattgcatgtctattccatattcctgatgggctttgaaagatgtcataatgggcatatatataagaaggaaaaatggatgtaagctagaaaagataaccaccagaaatgattcagacttagactctgtaattgagagacattcttagaaactacagggaaaaaatagcttttctgatgtgttgaagcacaagtgtataaacaaagtcatgagtcagagttgtcaattgaattttatctataagatccatagagacgtgtttcagatcttgtcaaaacatacatttaatgaaaatcctcaattcagataaaaacacaagctatatccattcacaattacctggttctgaaaccatggtaaatgttgattctatatcaagagatgaacctctttccccacttaggtgatttgtctcattttcagttgatttatcatggtgttattccatcatcctatcagatattcttctgtcagtattattgtatcttgaaaatgcactttaaacattaggcttttaatgaaatgttcaaatctgggcaaaatgcattagttccatttctttctttttgaaacaaagcctttatctattttaatgaaattttctttgaaaataaaattaacttagcgttacatcctagttttcatcccaatgtgaataaatacatttcactaaaacattctttttgggatagaatctagagtagataatgccaggagataattattcattccacttctttgtgcctgccatgcacactatttttttcccacatctagagacctaagttagaaagtgtaatgtgtgacattaaaacctacatttgcctgaaatatgtttttctgcaatttccaaagagctagcagttcaagaggtgtttcaagtatcatagatccacttccatgaaaccagaggttttcagattttgcccctggaaaatgatcatgtctgtagtcaagtggagctaaagttcaaatgttgtgaataccaacccctgtagaaggtgcttgagcacaagcgtccaccagggacacttggaaagggtgcttctttaagttagtgacaatgcaaccccagcatcgccatttctttgatcagcctggttggcatcagacattactatggaacctgagaaagaagaccaaaatgcttgcaagtatcagaagcattgtgcctgagtgcagaaagtagcagaagcctacaggcacctgaaaaagtaacttcatggccatgctgacattgtggttttattaggaaatacagacagtaattggttcaattataaatcaccttggaagtgattatggaattatctggattatctgcttgacagttaccttcctcacagaagaattcttattctcccttaattctaggtctcccttaattaatcaagaggcctgaggtaaatcactctttaatggctgagatgaaaaaaagccctaatggcactaagcccacattgaaaaatatgagagtcattattaaaaagtatacagaaaaaaagagttttcaggtgtctacgaatgtcaagtatgagtcagagttgtcaattataaaacttttaaaatgataagaatacagcatatgattttttgagacattatcttttaattatgaaagcagtcattttaaaatggcctagaactaagcccaattccaagacagttgacactcccattagggcaattactcttggctaaatacataggctatagttatcagtgggaaccattcattgaagaaattaaaggacaactaagggagaatagaaagaaggaaaggaagaatagatttattttaggacaaattattataaaattaccttgcaaagtacatatagcatgggggactatgtatatattagtatgtctatatatatgcacaaatgttgtgtttgtatatgcaatagaatgtccctaaaagatacacaaaagagtggaaatatcaggtgcttctgagaaaggtgactggatgccagggagatgggtaggaagaaaagttacttttctctgcatgcttcttgaatgctcatcattatatgtatttccaattcaaaagggtaattaattgttaagcacttctagagaggtaaagctcaaggaagcgcctctcttgggtagtatggtccatggtggcagattagagtcagtgtcactcttactttaagtgcagtaacatgcacgtggcctgatttcaatagtacccaagcccttgaaagaaatcccttgtccaataactattctaacctagcttgctattataatggctaaaattacagcactgttgcttctgttcttggattaaagattttatttcatattaaaactacttgatggaaatgacagtaagcccaattagtattttactccataatttgaatgagagtatttggttgtagtctggcactggggaagaatattgatggtgcaaggcattataaaacaaggcattataaaacattatcaataaggaaataaaatattgtttccttattgaaaggaaaggctgggagtaacaaagggaaacatatatgatagtttcattcagagacaatattgatgaagatttttgaacatcaaaaatcactggctgtgtcacaatttattatacaaatgtgttggttggtgttcatacagcttttgtgtgctgtatgaacaccaaacaacacatttgtatatactaggctcctactatggacccacaaggtttttcagggatttgaagtggcatcaagagggcatctacagcattctaatgcaccctggtaaagcatattgcaataagtttgtcagcatgtctttcattccatggtgacagggtagtatagtggaaagagccctgaacttggatctagaagacctaggttcaagttctggttcagccatttttgagaaaagatgtcttcacctatctgtgcctcaggttttcttctgcctttacctacctcacttgggttgtactgaggatcaaatgatatcatgagcatgaattatttgttttcaactgttactattatacagataatttgagttattattgcaattccaccatttttctttcatagccaacacttactgtgtattgtgaaaacagctgcttgattttctaaatggaaagaaacaagttagagaaattcgggcatcttagattcctaccagagtaaccataatgtagaggtcataagcctcagttggttttccttatattagttcagtggggaaatttccaacctgaaacggctatttcatattcctaaatataaaacaatgagggagccatttgtgggaaggaattatctttacccattcaaatcccatctctgattattttcttggactcattttaaaaaataaaccaaataagagaaatagaacaaatttaacttagtcctataaaggaggaccttaaatttaactgaagataatatgactgccatttctgatgtattttcttgtccagttactatagttgcaaggttcactgcacaatagtactgagatgatttcctattttagaattagtatttaaaagagagcatttggtctcacaacatggcaggttaagcgtaccagaaatggaagcccataatttagtctttgagaaagtactgcattgctccttggttgattctgggcgaccccatatccttaattttcattattgaatgaacttaaatattttatccttagtttatagaccttgctggtcctccacatcctgaaggataattcagtcaattttgctgataatctgagacttaaatggcatcaatattcaggtctcttggtgctcaatgaatggacagtataatgtgttcagttggggcagttaggtttagagtgagaaaaaaaataagtcattagtttgttcttgatggtgttggatatttttcttggtgtgttgctcagacactgtggaacagggtcttaaaaatgtaactatgtttgacgaagcctcaataacaaggtctttggaagcattctgggctccctttggaattaacgcctaggatgctgtcctgactgttgtatgaagcgtttgctcattgatttctttcctgagagagctactctgcacacttatgactgactacagacactttcagccatgcagaagccactaaagggagcatatgagcaaaaggcataggcctcaaatggatattctaatgtgtgcagtacatgtaagaacaaagtcaccaggttactcacttggagtctagtttggccagccaaccaaagtggttatgaggtaaatacaagagagaagctggaccctttctttgactcatgctatggtttgtgtatccaccattccattattaatatgatacaccaaatagtggctctgtatactcatccaaagggcaaaataaattctggattcagtaaaagtatgaaaagtccataggcaattatcatttgagaaaaggcatcttcacctatctgtgaagtatatatatgactggataagtcttgttttctattttttctttttttctgatgatggtggaacatattttcttgtggggaagaaaagccacacttgcctatgcactgtcaaagcaatagaataaatttgtggcaagggagcataaatgtaggcacaaagaattacatgtaatggttttacatctttatagttgagtctaaaaacacagttaatttgttaattattttaataaataattagtgactagtcaccatgtgccaggtaccattgttaggtgctaagtatagagtggtaaatagaaatttaagcttttaaatgtcagttcttactattactatctcacttaaataaaaactggaatataatttgtaggttgaatgcttattatccaggatatttgcaggaaagagaccacacatttcaatggtgtgagagaaaaaaacaacccttaaagggagagtgtagtattctgggactatcaacagaactgaagaagcaagggagggagtgattaccagaacctggtgaaggcagctatacagaagggtcacctaatgaaacctgtggaggaatgtagtcaatttgtgctatcctagcaggaagtaagcctgggaataaatatccagaccttgccctcctcctgttttccattctcctgtggaagcctttcattagccagattcaactaacagtcagagagcaagggagcccattgatacaaaccctgaaggacagtttcctagggtacagagaatagaagagaagagaggggttggggtggggaaatggaagacaaccagcacaaatgtcaacttaagagcaaactcaccccttaccattcaggtggttgagcagacatctccaacactgatgacaaatttagtaagccttctttgatcagtctggagaccatttggatatattatcccaatagataagtgctatccccaaaagcagagaagagagagaaatatagtgtaatgtgattgttctgtctcctaaatagaaaacaggaagaggtgcaataaatggattggagtatacgtgtgtgcgagagaaagagaaagaaggacggaactggggagggtgcaaggtggggaggaaagggagggggcactagaaataaagggagagagacaggaagagacagaggggagagaaagagagaaaggaaaaagagagcaagggatagagagagacgcggagggagaaaaaaaaagagagatcttcctgtggagcttacgaaaataattaatacagtttcctttctgtctgatttaacatatttgctaatattaatgtgcttgtccctacagtaattccctccaggctccccatgctgggatgtgttgtgggtttggatttgagcagaagatttaatgccaagtctctctggggaagcatttttgagataaattctttcccttcatgctcttctgctctgcatagaccttgagaaagggtgttagaagaaaagattgggtaaggggttaaaaaggcatgaagaccaggggcagagtagtgtgcatttccaggaaatggagagttctgggaacagttgctcatttcccactccttggctggtttgattatcacacttgaaatacagctactcatcttggcaattctcctacgttaggaaaagcccaggactactttaccacacaatttttacttcatttttaaaccaaacatacacagaaggtaatacaatgtatcttcttctaatttatttgcatttaaatacttcaagatgttgatttctaataaccacttcatgaccaacaagacagtcaagatttcttttatcaggctttctattagaaaaagcattttgcccatttcccaccacccaaataaatgtattcagaaaacaagggatccgtttatttatatttgaatctcagagtctctgaaaagtgaatgaggcacacatttggcaaaccaaacttaagttagattatgtgattcaggaaaatttataaatataatgtacggtgctgacaatggatttctcatattctactttttcctttgaattaactctggtttattacataagtttgtatatagtatgccaaatcaaaggatttaggatttaatactaaaacaaattaacaaccaaccagatgtgtttctcaagccatgtttttcagaagacctgattcaaagccacctgagagtctggttaaaaaggcaaatcctgggccccacacctctccatctacagaatatatggatgatgggatcttggagtattcattttgtcaacttaaatctataaatttggaaaaggaaaggagactttatttcttgtaaagggttatagtctgcaaagtgaccatcctgcagcctgggaagcatgtctttggacaagaccagagacaggcacttcaaaggaggaacggttggtataggagctttatgttgaacaggttggctaaacatacatattcaacaggttatagaaggctacgaatattcacaaaggtggttctgatgcatgtgtataaagcaaacatgcatgtaacatacaacccatgttcactttgaggtggagacttaacatttaaatgtcttacaattagggcctgtatgtcaaaaggcctttttaggacacagaggcatgcaagagtgatctctttaaaccagccagaatcatcagtccatggttggtggtcttcttattaggagaaagttactgacatcagtctcttgtccggtcaaagctgtagttatggttgatggaacaggggatcagttagcatctgtgaactggatgagttgtaattgttttaatattgcttatcttgagaccagtccttatttaactgctagagaagaaaaaaaaaaaaccctgtggcagttagaacatagtttattctttaagtgtaggggtgcatgatttaccccttgcctagcatggtttcaggtcctgtatataatttcatatctcattgccacaaagagtctgttctgtcagtcttatgatctctactttaacattagtgctggtcagttgttgtgtctaaacgccaaaagagaggaggtataatgagttgtgtctaacctcctgtcccattgtggctgggaactcaattttaagatttttctggagtccccttggctacaagagggcccattcagtcagtaggggcttaggattttaagtttacaactttaacaaagtcattactccctacaggttaagacctacaggactagaataagacatttttgcccttatatcagaaggatgataccttctttatagtatttttcccaagatcctatgtgcctatattgttttacgaaatgaagggggaaaatcccacaagagaaaaaaatatctaaatcgagactcatgaggcctgattttaactccagttttgacaattatgacctggagcatgccacttaacctctttgggagtcactcttgtcatctgcaaaaaaaaaaaaaaaaaaaaaaaaaggacttagaacaagatgtctctctacttcacttctaactttgatggtccctggttctaatagtctaaattaatatctttgggtatatccttttgtaaattgttgactcacccagagaacttggatgcacccaatcttcctagataatgtttcctttcttggaaattattaattctgtccagcatttttaacagttgtctctaccttatttcaagtcccagtatttcattcagaattgttattgcagggaagaccctggaaacttatgaggagattactgaagaaataagctattacaatttttgccttgctcttggtttggaggtagcaaattcatgtacaaaggctgcttctgggaaatgtagctaccaagtttctttaattcagcatctggccaaagatgtttcccaaaactgtagtccatgaaatgttctctaagtttttaaatgtaaaataagtataggaaattctgcaaaacatcctctgagagagacttaatatccattagcatattaaaaagttgtgagaaaatatgtagtaaaaataaatacacaaataaatattttaaaaacttttttttacacaggggtttgcttgatattcacttgatcacagattccttatcatgagtaacatcctggagaaccagtgttttatggaatattttggaaaatgtagttttggtaaaatccagaaacctaaacaaattttgccatgaaaatagatgatggggaacttaaacatacataaaatataataatttgccagaaagagaatattcataagagtgagaagggcccagcattcagtaaatgaggctttcattttgattcatggtcaacattagcattatgatgccacaagagaattactctacaagttagaatattattgcagtctatttttctcctgcttcatctacatgaataaataaacaaacagtggcattttgaaaagcatagagaaaagaaattagtcaatacatcaaaatacttggatctaataatcacctactgttttagtctttatgatttacaaaagctgacaaatatatacatttaaacaagtgacctttaaccttgaattagagatatttcttcagcagtatatgacaaagtttcatacctgtatgaagaattttcttttggattgctatcttctttctcaggcagctttcaaaaaatgggtaaatcttgtagttgtgcaatttccactcatttgctgagaatagtttttccatcacttccttgcaatgaaattttaaaaatttaaatctataccaaaaatctcatttaaaattgaaattatgcaatatttatcttaacttgtgcagatttaagattaacttcctatttattagtattaaatcactctaagtttctctgtttaaaaatgataatgtttcatatacttcaatatataaattccaaggaaaaactattgaaaattgtttgcaatgaagatggatgcagaaaatgaaatgtctttgaaatatcactaaatgtcttggggaaaggatgattatatatagatattcttaaatataatatatacttttaaattactagttcctcctccatgctttctctgagagtgtttgtcaagtaagcaagcatgattttttttcttccttcttctcaatccaagctcttaggaagagataaataacggagtaggggtagggaaatagtgatgccacctcagacttaatcaatggctcctgattcatgtcatttattttacacactaggtgaaaacacattggtgatggagcccctacacattctatatcaaactaatcctttatttgagacaaagtatccacagtgatgacattagcattgctagtattccactgtacagcccacagataatgggataccaattgtcttagtgcattttgtgttgctatgacagaataccatagactgggtaattttgaagattcgagatttatttcttacagttctggaggcttgggagtccaaggctgaggagtctgcatctggcgagggtcttcttgctgcatcatcccacggtagaaagcagaagggcaagagggcataaggaagaaggggaaggggactgaattcatccttttatcaggaagccattccagtgagaactaacccactcctatgacaatgacattaatccattcatgagggcacagccctcatgacctaatcatctcttagaggcatcacctctcaacattattgaattggggattaaattttcaacacatgagctttgggggacacattaaaaccacagcactgattaagtttgtcttttgattgaggttggcagtcttagatacactgcatcttgaagaagaactgaataaaggttaactataaagaagttatttgggcatgcacacatttgcttactttgagttcaaattttgttttatataatctgagtgcctgacttagatcctttgctatcatttgcttccagggtcacagcttctccatttccaagggacagacggtgtcattagatattggggtatgagaaggtggctttgctgaattattagttatagatgtcaaggaatatgaacaagaggataagattttctttggaatcctgagatttgctttccaaaggaagtatatacagtgtgttcccaaaatataaaaatttaagacatcatccctgtttgaaaggaaatgttacatatgcccagggtcatgccttgtgaataggaagccctggcactgaaaatttcacttttttcagaggcctttttaaatagatgaatgccaggctacctgttctctccaaaatctaaggtcacagtttgttaataaggttgccatactattcagtatttattttatctgaaatattaccatttcatttcctagaatccgtgcccactctgtaaccagtggcatgcttaacctgatctttatcaaactaatcctatattatcagatgtatttctctagctctcccaacataaaaggaattatccacagtctggaatatgtgttccttttatttcccccaagtttctgactcacgtttgtttatcatgcacatatgcctcatttaagtgcatcctttaatcaaatattctgagcaaatattcccacttaaaacccagcaggcggcttcctgttccatagatctcctgaatgccaacaaagtttataacatgcagggctttccgcagagtgtatgaatttgtgacttggggcaaatatcctaaaccctattaaaaaaaagatttccttggcaaaagaatacacttatctcaaggagaaaactccacgattctacttgtcaaccagctctgcaaataggataattacacacgtgggatttttttttttttctgcctacagttgaaactgggtttgcaaatggctcctgggtaaaaagtattctatagcacctccatctcccagaatgagttcatttaagaggtgccaatgtatagttaacagcactgtagtttggctgaaggaatctttgtgatgctcagtaagagtggattgacatgtgaagctttcatgattgagttattccttcatcatggggcctctctcattcccccacatattgaaaagaatataattattacataaaaatttggagccatgtgctaacaatatgtgccataataaaccatgcatacataaagtctcaaataagcaggtaccctctcagtgtctaacttttcatataaatgccagaataaattatctgcttcagtgatagagcaaagcacttgagggtattaacaaaaagtatccatcagtgacatcatgtaatatgctatatacatcacagaatgacacctttaaaaaatattattgactttagatgggtgatgtggcaggtgcaaagaaggcaaagaaataaagatgacataataaatagatcctaaaggaaagctaagatcaaaaataaactcctgtactttttttagaaaatccatagtgcagctgctctggggtgcctgattgcctatatctttatctgaatgcacagaaaaaggaagctgagctgtcacccaagggagtgcagagctcaaaatactagtatccttgatattctaggtctctcatgacccttgaaactctcctaggccttctcatcatttttggataaagtgcttgcacttgtacatgtctcacaaagatctctgtgtttaggttctttactacatctgtctgaggttgagtttccaagaagcagaccctgtgcaaaagagatttattaagaataagcaatcaggggagacatataagagagtgaggaaatgagacaaagaagtgggaaagccaagcatctatattgtcaatttcaacatcttcattccacatctcaagccacaccttcccactctatgttccagcctcgatgccccatttgccattcctcaaaccttttatttctggtgcttggcacttgcatttctctctaccatccctgcctttccaacagcttactctctactctgacttcaggttaatgtcatttcctctagaaagcctctcttaaactacaaatcccaacctttcctacgtgctcagtctagagtctatcttgtgattagttgcttctctatttctttccatcctagactagttcaagaaggttaggattgagcttatctcattctacattgtatctccaacacgtgacagtaggtaggttgtcaatagacatttatcaagtaaatttaaaaattgataacactaatccttaatctcagaatctgtaccaatgcaaacttgaatattaagaactgaactaagttattattatctgctaattattgtgattcacttaaaattcatgaagtccctccatatgtatcatctcatttgactcctcactgcattttcttgaatagaaaacagccagaattttatcattcttgttatttaggggaagaaaaagttatcctgctgccaaataggacttggacaaacactacctttccttatatataacctaggatggaggggagtataagtcattagaaaatgacaacagggacactcattccccatctgcaatactttattgaatatatttgtaacacagctgctgccctttctattacaggttgaattgaatttatctttgaagccccaggtttttgtgcactttctgtttatctaggagcttaataaatatttaatgttgagtaagtggatttatttacatgtagacatgtatcacgcatttattatgcataggacactgcgctaagtacaaagtagagggtgattcaaaggagaattgttaacttatcagcattctaacctgcaactttactatcccaccttcttctactttaccactatttcagtaccaatatcccatttataaaaagttttcttttccatgcctaataccgaacatggatggatagtgacatctaacttatccaaatagaatccctggcctaaggcactctcctactcagtgtctgcagtgttcagtaaataaaaccaaaggcgcataaatcatacatgttgataatattggatatacctgaattgccagggagttctgactgctaaagtaatttcaggttcacttcatggttatggcccatacttccttccaaccagtgagtctgtggttgggcatcttctgaaattctcctcttgagcttcatcttccagctttacaaaaaaattgagtagttctcaagtacaggattctcccagattatgaggcagtgaaccaaaaatctttacaaaagactaggggggctaactaaggtatccactaatagtgatgacctttatttttctctagagggcccgtggtacaggagaactcagttcactgaggaggaaaaagaagtagctctaggctttataaaagaggaggtacttgaatttggtattgagagcaaataggtgttcaatgaatgaaaaggggaatttcagatagagaactgtccatgtctggaaagaacattgctagtttgggggataataaaagatgagtatctctagaggaagtgaaagggataaatcatagaagataagcctacagaataaagttagttaaggccagaatgtaaagaagattattgaagcatagatttaaccacaggtaacaggaaggcaatcaaggtttttaagcagaagaggagcataattacataagatttctaagaagataactcaagatacctttcaaaggatatacgaaaaaggtaagggaccagggttccaggacaatcatccacaaaagagagatgatgaaggtttgggcttagggagtggcaatgggttagaaaacgggcaagattcacaagataaacttaaggtaaaattgcatcagacaagatgtagcgggtacaatagaaagagtaatgtttgactcaaggttccattttgagcaactgagcagacagtgattttgtttattcatgtcagggacacacgaggatatctaatctacagttgaaaattttaatctggagccaagaacagataccagagctataaatgtaggaatagtagtcatcatataatgacagtattgctaagatcacccagtgagaatgtgtagaataaatatagaagatgaataagaataggatttccatgagcatgaacattgaaagaataagaggaagagaaggactcaacaagggatacagagaaagagtggttagaaaatctggaggagaaccagaaagagatgcagtcattgatattaagggaagagggagttttgcagatgaggaaagcaaccacgacaagtgcagcaggaatgttgagtagaaagaacaagagaggtcattggatttgaccactgggacatttttgaccttagcaaggccaatttccctagagtggtgatacaaaagcccatactgagttggtagagtaaatgagatttgagaaagtggggaaaagtaagtctgtagatttatcgtttaaaagattggtgccaaagagaaagagagggattgaatactagattacagaatttgagggaaaggaggtttttttttttttaaaattaagatgagaagggtacatttgtagaataaaggaaagggagactgaaagtacgagtgagatagaggataattgatggaggagagttctggaaggagcaggaggaatcaatctcataaggaagatgaagagattacctttgcactgaaggaggaataccatttccttactctgataataagttttacaggtggaggggaaggtagtcagataagttcacatccaatgatctgtattttcttggtgaagtagtattctgtcatctgccacagaagggctgctgccacaagcatgggctggtcctgggcacagtcaccatgaagctaaaaaagagcatcaggcccttgatgctttgatacctgccatctttgccgccaggacagaccacaaagattcaaaaagcatttaaaaattttaaacacatcatgaaaacagacttttctaaaaaaaatttatacttctcagttggcttattgagtaggaagatattttatgtatttcaaacatatgtcccagaagatcaagccagaaggtattatgcacaattctcagacaaaagatgaacagaagtaaagggacttagtgtccaagttatccatcagctcacttcttagccagtgctttattcctcactgcacccatgcgtatatttcacaccattttcattgtaggaactcagaaattgttaataataacattgttggtttatattaatgagtccttactatgtgtcaagcatttaagcactttgcatattaactcatttaatccttccaataaccttacagagaaggttattatcatccctatttcacagattacaaaatagaacagaaattgtatttggttgcttatggtcatacagctagtaagagtgcagaaatggcttttgattccaggcagtctagcatgagtctgccctcagtgctattagtgggatagtaaaaaccttaaagatttgtgttgttatacaccaagcctataatcatttcttaattacagccatgctaggggcttgtgaatctggaggcatgcctaaggatgtgtttattatttaactttacatcctcagatttgagcacattaataatcctccataaatatttgatgaataatcaaatgaatgagcaaagatgatttctctccaatcacccaacagctttctgcttgggatgtattggaactagattgtagatcgtggggtggaggtatggtaaagaacagttggtggctaaggaaaacagaagagatacagggactacttcctccatgggctacacattacatgactttgtctctgactaacggcattttgtaaacttttttttacatctttgagtgcaaatttgtgatgtacttaaacatatttcaagaaaatgctatgatataccaaaaacatgccctttcatatgagattttatctagtcctatagtttgcttctaaatagagtttttctccggaccctaggaatgttttcatttaacaatctcaaatcatttgggcatagtgagagaaaactgtaagtctgagacatgaagtctataatttattctcttattactttccaacacacatgaagagcccaagcttgctcagggaataggaaagggaaaagtctgggggctgcttgctgggatgatgttccttcagaactaaggagaatgctctctgaaataatttacttgttcttttcttaagcagaggaagtacttgctgcttatgtacaaattcaagttaactttgtagtaaggtacaaattaattacaaagtatttatgagggacatttatgatgtgcctaacgtatagcaactttgagaacttacagaagcagtgacaggcaacttttgtcctttagcaatgcatcatcttcctcagcaaatgaaataacagacataaaacaagtctgagcaacagaagccaactcctctctatataattgtacagctatatatggaattatgtcatggagattagaagttctgaataaggggaattgataatggccgaagtgtaaggaagaggtggaaaatgacgtgaagacttggagtatgggtggggtatgcaaaggcaatgtgttcctcatgatgtgcccaacaacatgttaagtgtgtcatatgcatgctctcatttgttctctacaaaattgataagtactactgttaacgatatcctttttccaaatccagaagctaatgttcagaatccttagagctggcaagctgtgagagacagagaagctggtcaaatctaggcagtctggtgctgaggcccacatactcagcaactgtactacaccttatggtggcctaggcaggctaatcgtgtctgcgtttgcaaatatacaggtcatatgactggagatgaatgttttgagaggtatgcatcaacccaagccaataccccaaaagactcttagtaggattcttcccctttgacctggcagaccttctacctccattgcctgagggtaggagaatgaggccatttctcatcagagggcttgcttttctatagtactgctctattgtgtctggtacaacacacaaaattagagactctttaaagcctcaacaaaccttgtctctagcatgaaaagatcatgggtaaaaaccctattctgtttcattagcaactctcatgtcctcaaattataaccctctcaaggtcccaaggtgatgtcactgtctattatcatgagcacacaggcaatgatggtgtctagtgggagaatgacctcctcaatttcaagtgtgaactcaactatgatgaatgagaggaggccgtgtggcttcttcaatcttggagggacaaccgtattcggcttattatcagagattgtctcacattgagatggaggtagaaatatgtaatatcaaaatccggacatagaacagtttctccatcacctcaagactgtctaacaatacaaaatgtggtggccttcaaatcagagaaaggatatgcaataaagagcaattatgcagattcagccttcaattgctgattatactttggctagtgatatatactcactatgaaatagagccatatcttccccctcctctgcacatgaagagatacatcaatcccttgcaaagaacctctgctctcctttccctttctctttttctcatgcacaatttgttgcctcctctgccatgttcccttaaacactattgttattatcacatgacattgtaattagtctaatccatgtctttctgccttgatagatgatggcttttttttaatgcaaagattcagtacattttggtattcccaggagcttacaaggcatcagtgtctgtgtctttcccatatccccggtcccttaccacatcaacctgacttctacatggtagcagctgcatttcttcgttgagggcattctctgatccaagccattttgcccacccttgtggcagaccagaattaaaggtgaattagtgtctcctgagagtactctcatccaatgactggtggaaatcaatttaacatacaccagctccttctccccttgggcagaatagctctgaggagtccttctatactggcttccagagttgctcatgggacaaggcttcatttgccatcagaaaataatggacttattaacacaccttttattgtttgcctaacctgtcttacttcccgacgtctcatccagcatattacttacatccctaacaaatgactttcacctaaatccttgactcgaggagaacacaaactacgtaagcacccaatatacagaaggacttcaataaatgtccttttaataaaattgaattacaaagatgcatagtgtagcatgagataaaacgtggaagtgctatgctacgtaagtgctgggagcctatcagtcaaatttgagcacttgtaaacacaacaagcaccatgatttcaggatttccctttgcagtgggaaggcggctgtcctagttgttagtagagaagagtacattatcggaagctctggcttctatttttagacctcttgctgacatagaaaacctgtttcctaacagtactgtagtgaccttcccaccctcagagaaatggtgcagaatgcctaaggaagaaacaagtccccatttgtggaagccacagaggaacagaggagggaaatgagagcttaggtactattcgttggcagacatggtgctttaagatctcttttgacagctaaatagaaagtgctgggttgcctggcagtgcagtggccttgaacaggatttaggtctccaagctgctaaagcttggctctgagcccaagatgtccaaagagcaataatctctttcttttttaaaaacctcacatgaaaaaataattttccaaaataaggtaaaatcatgactcttacacagttatataattaatacatgttaaagattttatttaactcattagtcaatgagggaaccaggcagatggtataatcagttcaaaaaaaacctcaaagaacagacacatctatagataaaaatattgaaataaatgtgcaaatggaggcaaaattagcctcttccacagtgggggaaggaagtcacttgaacctctacaggacagaatttccatacctataagcaagggatattttgtattactattagttatataatttgcagagttttaaaatagctcccatagaatcagagtctgataacactgaaaggtatgctgtatggacaatgtatagttttttactgaagcataatttttccctacactcacgatcgtttgatttaataatgcaatatttctccaataagggggaattagactttttactagagcttacttatacttttaaaatccagctcattttcttaacactgtgtatagggatgagagtaatcaaatgcagggcagagatactatgcttgagaaaagtacatctgattgttaagaaaaagatctcaaggtttaggaggaagatccttccttgataggggaaggaaagagatggtaacagaaaagaagtagctgatatttcacatttacattatctcattcagttctcccaatgaacttgagagttaggtgaagatatttctccttttataagatgaggaaatgggagcccagagtaattaagtagcctacatagggtcatacaaatagtatatagtagagccaggatttaaacccagtctttttagccctgaagtttatgattttcttccattatgccatactgtactggtaaaggatgatgttaggatggagggcaacggttaagactttcctgatccccacctcaaacagggcagttcagcagtggtatcgaagaagcatgtagcagtgtttctcattggtgattgtcatatttttgtcataattttctcattctgttgagtgctctggagagataaacagaattggcttctgatctcataggtttagcttaaacatttgatttaaatgaattactttttgaatgaattactttttgaagctgaagaaatgaaggccgattaactgggttaaaatgccttaaaagttgttctgaatcagatttcctgggatgccactaaaagttccttacataaaaatggcttatattcttattaatagcatttattgaacatttactgaatgcctactatgtgctcagtactatattaagtgccaagggaacactacagtgaatcgggtaaaatccatgccctgtccagagcaaactagaaaagattagacacatataaaagtcgaccataatacaataagataagggttatagggttataggaatgctaggaaagatgatattcatatagggagaatcatgcaaaatttcatcaattaggtatcatttggctttggaggataagtttttaacttggaaacaaatgtgtatatgtgtgtgtatcctatcagccaattccattatcataactccaaacatagtatagtttcttcttaaaaattattaatgcaaaaaattctatttccaatttgtcagggcctaacaagttggtgaacttgttattcatagtagaggattcaattaacatgagagaaagtcatctttaattctatttttgttacttcctaaaaggaaaggatatgtcatttaggttcatgaaaaattctcaggtctttatatttcaaaactaattccaaatggcattcaaaatcattttcttctaaggctaaatggctctttatttattattcaccccaatcccaaatagcaagaatcccatgttttccagcaattctttgatgacattttattatagcataaatagaaatatatgtaaattattcttacaaattgttctcaacctgaaggttccatttagcctctgagatctttaaaataggaaatgaagcttgttaccacaagcaaagtgttctgaatctcccaaaacataaactgttcactttaaggtcactatgatcccgcaatgaacaaaaaagcagcagttcacttgtattagaaaaggcttagtaaaaatgccctctctgtgatgcttggttgggcagacacgttttgtttcatctgacatttcttgcagagtgactcaagagctattcagcaaattgtttctgacttgtccttaatgcctgattttcttttatttagcaccacaatttaccatctacttgtaggtcataagtagtagaagaccaagtatatactagacacataatgggtactcaataaatatttgttgatttaataagcgactgaggatttgtaacatgaaaatacacagaattcagcaaatgtctgcaaattcagttttctgattaacaaactcaacaaacgagtataagttctattatactgccatgtcttcacctaaagtatttccttttttttttttttttttttttttttttttgagacggagtctcgctctgtcgcccaggctggagtgcagtggcgcgatctcggctcactgtaagctccgcctcctgggttcacgccattctcctgcctcagcctcccgagtagctgggactacaggcgcccaccaccacgcccggctaattttttgtatttttagtagagatggggtttcaccatgttagccagggtggtcttgatctcctgacctcgtgatccgcccgcctcggcctcccaaagtgctgggattacaggcataagccactgtgcccggcccacctaaagtatttctaaatattttttaaaatccacactctttgctgaaacatgtgagactttttcataagaaagccatatgaccaagaaatattttaatatgatactagcatttgtttggtgaagcagaagagtaaactgaagctcatttcattattacataaaatgtgatctttgttaaataaacttcctactcatcctgcaattttaccttctttttataatttagtggttatcaactggggagattttgtctcacagaggacatttggcaatgtttagacacatttctgattgtcacaacagggggtgtgggagaagtggtgctactggcatctagtgggtagaggagggggatgctgctacacaccctgcaacgcacagaacaactcctaacaaaagagaatgatttagtccaaaatgccaatagtcccaaggtagagaaagcctattttaaaaaaagaagctggctgcaataatctcaaattcatgatggctacatgggttttccagacatgaagaatgtttatgcataattcccagaaacaagaaaggtataaaaggtggttgggtcctgccaagaagtcctgtaaagctaagaagaaaaaacaaaacaaaacaaagtttacagagaaaagagaatggaaataggataagatgggcattatttcagtaaagattggcatagaggatattggaagatctaagttgtagtctccaagatttcagtttatattaaaatgggtttgacaatgtatttcctacacaggcatatttttacaatccaatgaacgcacaataatgatagtaatactactaccattactataaataacagtaactacgatctattaaggaaccattacatgccttccatacattattactaattatcacaattatcatcaaagtaagcatcattatttctattctgcagaattaacaggctcagagaatttttggcagctgtttaaagttgacaggtggtaataatcagagttagtgttaaagataaaacagactagtagccaccatacttcaaatatatctttaagtagtatgacccaaattccaggttttctcaggactgccctggtttctgcctgattttcctgtataattattaatagcactcactttctcttaaaagtgatcactctttatgagatgatggattctctcttttctctttaaactggagaaatccacatcaggcaaatatagaaacttgctggcattctcaaagccctttgacatgtatctgagccatgtgtttatttgtccatttacttatccttgtgtgggagcagttgacaactggtggccatttgtgggaaggactcacagaagatgctatttggttcttgatatttaagctaccttaggtgttaattaattgctttgtctagaatttttttttttttttctgagacagagtctcactctgttgtccaggttggagtgcagtggcatgatctcagctcactgcaaactccacctcccaagctcaagtgattctcctgcctcagcttcccaagtagctgggattacaggtgcccaccaccatgccaggctaatttttgtatttttagtagagacggggtttcgccatgttgaccaggctggtctcgaactcctgacttcaggtgatctgcccacctctgcctctcaaagtgctgggattacaggcgtgagccaccacaacccatctgtatggcaattttctaatttctatcaacatggcttgtccaaagcaaatggtttttgatgagtccaaagctgtctcatcaggctgtgggaatctgtaaacatccagcatgtttacttctctgaatgttttaccctttgcacaaacctggaatgtcagcaaacaagctgaatgcagtaagactggtaaaaccatttgcgtatgagttgagcagaagaatcgatacataatttacggtgaattttcaaggagattaaaacagcacagtggcagtgggttagattgtggggccatttcttttttttttttttttttttttttttttttgagatggagtcttgctctgtcaccaggctggagtgcagtggctgcaacctccaccccactgggttcaagcgattctcctgcctcagcctcccgagtagctgggactacaggcgcccgccaccacgcctggctaatgtttgtatttttttagtagagacggagttttgccatgttgaccaggctggtctcaaactcctgtcctcaggtgatccacccaccttggcctcccaaagtgctgggattatagacatgagccaccgcacccagctttttttgtttgtttgtttttgtttgagatggagtttcactcttgttgcccaggctggattgcaatggcacgatctcgactcacagcaacctccgcctcgattgtggggccatttctaattacaatcatgacatttaaaaaatttctctattctttcagattaaatgacttaaattctctctcataaagggagtgccatgaagaaaagtcattccctctcccttgtgatcctcctatcctccaaggctctctctttcatgggcatcaaagcaccatgcaacgcaggaagccataataagaaacagtgcttactcatgttcagatatcaaggctctgacccttaactctacatcttcctgcttcttctgtgtgctttattttccccctttgtctattgagctaatggcaagaatctttatgctagacaaaatctttttattctaaaggaaatttaatttctgtatatgtcaagcccatatatttcatattctattcccatccaagggccacacattaaaacaattgtggtacttgaagacacattaagttatttatgtgaaattgcaaagtgaaaatgccacttttttctatttgtgacaagagagaaaaataatatcatttccatcttggaactcaaagatttccctctgttctcaagtaggcttttaccttaaaaggacgctgggaaataactaaggagaactaacaaatagtgactaattgtcttggtgttacacaggataccctattatttcccaatgtttatttttaaatagaatccatcacaatgcttttcaaaaaataatatttggccaggtgtggtggttcatgcctataatcccagcacttcaggaggctgaggtgggaggactgcttgagcccaggagttcaagaccagcctgggcaacacggtgagacccccgtctctacaaacaatacaaatttaaaaattagctgggcgtggtggtgcatacctgtggtcctagctacttgggagcctgaggtaaaagagcaaggctgcagtgagctgtgatagtgccactgcactctagcctgggggacagagagagaccctgtctcaaaaaaaaaaaaaaaaaaaaaaaaagaataatagtaacatttattgtgaacttagaaatctgtggtaaatacaaacatatatatatatacatacacacacataacattaacaagtgttttaaaatatagtcattatgaataatagaaaacatttttgttatctaggttttgaatatgcaaaatacagaagtctcatgtatgtttatgagcgatgtaagtcattataataactgagtcgtatatattaagtatttgttgtccatattatctggcttagccctgtttcacttccatactacctcctaacgcttgtgataaatagtgttctgattcaggcttgatggtttttcacctgagcccactccagtgcatctggctccgaggccatcatttcccatccattctttctgctatgactttgttcatgctacagagcacaatatcaaactcattgtagatagtcctacaggcagtccctatgctcttccatgtccatggtcagtcctcatttcatctatggaaagaccatggaatttataataattcctgttgttctctagcctcctagtctgattaggagcagggccaggcaaagttggcttacagaccgaatctggcctaccacctgttttgtaaataaagttttactggaacacagccacactcatttatttacatattgtctacagctattttcactacaaaagcagaattgagtagttatgacagaggccttgtggcccacaaaggctaaactatttaatatctggccccttaaaaaaatgatgttgactagggcactgagtttttaagacagctcagccaggaattaataactttgtcaaatccagttacaaatagagcttttcaatcacatccataagttatatctgcagactagagaatcataaatttagtcttaaacttatagataactgggaaaagttaagctgactttactgattttcctcttctattgcctctctatcctaggtacctactctgcagcccaaatagaacatttcttccttggcaggagcacagagttttataatagccctttgattgcctttagtcctttgaatagttctattgttatcatctaacatatatattgttcaataagaatgttttaattgaattaataaatgaaaaaatgtggatcagcattttcaaagctatgttttgcagaatgcttgctatctttgaaatgtgttccacgaaaaggatggtctatctaaaaaacaaaaaaatctatagtcaaataagtttgggaaataatgacacacactatttattttcaggaacaccatagttcacataggtgtattaaagttttggagaaagggagggtgacatcaacaaaacggcacagtagacagctcaagctctcaaaaagagtagaaactgtcagaaccaattttgtcagaactctggaaaacagtcaaaagtttacagcaaccaaatgtccacaaaatcaagaaaaaggtaacttcgaaatggtaggaaagttttgtggtattcccacttgcccttgtcccattccctccctagtatggcagtagttttggtttaaaattggtagcagcctacactcctagtatggggccctggtcccttgatctggaaggagtagaccaaaccttattcacaaattattttgtgtgtctgttctaacctttctataggctaccagaaggacaaatgcaaggagtttatatttgttttctagggctaccataacaaaataccacagactgagtggtttaaacaacagaaatgtactttctcacagttctgaaggccagaagtccaaaatccagatgttgacaggtttgctttcttttgagacttctctccctggcttgtagatatctgccttctcactgcattttcacatggtcgttcctctgtgtaaacacatccctggtgtctcttttctccttttctcataaggacaccagtcatatcagattaggggccaaccctcacttaaacttaactaaccctttatagaccttatctccaaatatggttacattttgaggtactgagggttaaggcatatgaatgtgggggggacacaattcagcctatgacaatgctcatctctgtttttacctaactcaggatggaaaggcagtgagtattaattaaaaaaatactgcaagtcaaactaaaaatcttaaagggcaaaatattacaattgaaatatacaatagaccatctaaaagcttggaagtgaaacttagagtttcttagggaaattaggacattcaaaatcgaccatgcatatggcaaatttagaaagccactgcattttcagggaaatatgtgtgctcagaaaagacccgagcaaacccttagctttcaccttgggctgatccctagattcagttcaagcccagctagttgttgaagggctctggcatagagccaatctgcaaagactgggagagttatgttttgtttgcttggttggttggttggttgattggttgctttgtattttggccccagatactcaagaaaatctctcataaaattctagttgaacacaggctgagaaacaaagactatagtgaccacacatgagaaggaatattacagtcttcgcagaaatagttttggaaagtcactaagcaaatggcctactatacccttcaacagtcaaaacattcagcaaattctagagaaggtagataattttcagttactacagtatgataaatatacagttttcaacaaaaatcacaatgcataaaaagtaacaagaaagtattggccaattcaaaggaacaaaataaattgatagaaattatccctgaggaagttcagacactgggcttactaaacaaggactttaaaacaactgtcttaaatatgctcaaagatctaaaggaaaacaaagacaaagaatgaaaggaaatcaggaatattatgtaggaataaaatgagaatatcaataaagaaatataaattgtaaaaaaaattctgtatctgaaaggtaaaacagaaattgaaaattcactagggtagtttaacagtaggtttgagcaggcagaagaaagaatcagttaatgaagataggaaaactgaaattgtcaattctgaggagcagaaagaaaaaagaataagtgaaagtaaacagagcctaggataccaatgggaacccatcaaatagaccaatatacacattctagaagttccagaagaataaagagtggaaagaatatatgaataaaaaaattttgagaaataacagttcccacattttatgaaatatgtaaatctacaaatccaagaagcacaataagttccaagtagggtaaacccaaagagatccacactgagacatattataatcaaactgtcgaaagccaaaaacaatgaggacactgtaataacagcaagagaaaaacaactcattacatacatgggatccctagtaagactatcaactggtttctcagtggaaaccataagggccagaagacaatgggatgatatatttaaagtgctgagagaaaaaaaaaaactgtaactgaaagtttatatccagcaaaactgtcctcaacaaatgagggagaaattaagacattactagaccagcaaaagctgagggagttcattaccacttggcctacgagaaatgataaagggagtccttcaagctgaaataaaaggatgctaaacagtaagtagaagtcttatgaataaataaagatctccagtaaaggtaaatgtatgggcaaatgtaaaaacactattattgtatttggagtttataactgcacttttatgtcctacaggacttggaaagacaaatgcataaaaaattattagttgattttattgtgcattcaataaaaagatataatctgcaacaacaaaaacataaaggagagagaatggtgttgtataagagtggagctatcgtatgttattgaagttaagttggtatcagagagaatggtgttgtataagagtggagctatcatatgttattgaagttaagttggtatcatttctgactaggttgttataaatctaggttgttaaatgtaattcccatggtaatcacaaagaaaatatgtgaaaagttaacacaaaaggaaatgaaaagaaaatccaaatggttcactacaaaaaaaatcaactaaacataaaagaggtcataatagaggaaatgaaagaaaatccaaatggttcactacaaaaaaaatcaactaaacataaaagaggtcataatagaggaaatgtaggacataaaaagctatgagatattcaaaaaacaaaatgatagaagtaagtccttgcttatcagtaattactttaaatgtaaatggattaaacaccctaatcaaaagacatatactggcagaatggataaaacaaaccatgattcaactatatgctatctacaagagactcactttagtttcaaagtcacaagtaggctaacagcagaagaattgaaaaagatattccatgaaatagtaaccaaaagaaagctgaggtggtatactaatgttagacaaaatagattttaagtcaaaaattgttaaaagagacaaagaatgacattatatatggagagagatctctaaagatgttctatttattattaaaaatggtatgttgaagtctccaactattactgtagaaatgtttatttctctcatcattttggtcaatatctgctttatatattttggagctctgtttggtgcatatgtgtttagaattattatatcttaatgagttgaccattttatcaatatataatataattgttttcaggccactaaacaagcctcagtaagttttaaagtattaaaataataaaatgtatcttttcccactatagtggaatgaagctaaaatcaataacagaagaaaaactggaaaattcagaaatatttggaaataataccgtcttaataaatcaaagaagaaatcacaagggacataagaggtgaatgaaaacaaaaacacaacgtaccaaaacttatgggatacagtgaaggcagtgcttagaggaaaatgtataatataaatgcctacacttaaaagaagaacaatctcaaatcaacataaatttacaccttgaagaactagaataagaagagcaaactaaacccaaagttatcagagaaagtaaataataaagattagaggggaggaagacagagaatagaaaaagagttgcagaataaacgaaaccagaagtttgttctttcaaatatcagccaaattgataaacatttacctagactgacgaagaaaaaaagaggactcaaccaaaatcagaaatgaaaatggagtcattgctattgaccttacagaaataaaaagaactttaagagaagattacgaataatttagataacctagatgaaatgaacaaataagtaaaaacacacaatttacctacactgattgaagatgaaattaaaaatctcaacaaacatataacaagtaaagagattgaatcagcaatcagaaacctcacaacaaagaaaagttcaagaccagatggcttcactggtgaattctagcacacattttaaagaaaaattaacatgaatcttcaaactcttctaagaagtaggcaaggaggaaacacttgttaactcattctatgagtccagcattactctaataccaaagtcagataaaatcgccacaagaaaagaaaatcacagaccaatatccctttgtagtgagtgcttgtaattgtatgttgtcttggcatccattttatatgtaagtttaactctctcatgccagaaacagggctcagtcacccttgacatagtctcatattcttcttcccacctgaatggtagccagaggtaaaacttagaggcatctctcctgcctagcagggaggactccctgctttcctgctacgtcctttaaagagaccattcagacatttgcctgcaaacttaaagtgatcacctctcagttacaaaatgaccacttgaaacgattgcctgctcactttaaaaccaccaattaaagccccccagtgggaagcctgtttagataacaccctagactgaataaaagcattggcccatgggtcccttctctctctctctgcctgtgcaccctgacctctacatgtgtgcagtctctgggcatgctgtgtaccctccagggtacataagtagtaaaaactcttaaactttcacgttgtggttgcgtcattaaagctgttcttgcaatctgacccctgacagtgaggcagccccaaagcgtacagatgtggattgcctctgctggtgctcttttgtccaagtctcttagctgctgggggacagtagttaacagctaggttgatagagtttcattcaaaacacccttatgaagatgtatttaaaaatccttgacaaaatattagcaaaccatatccaacagcacagtaaaaggattacacatcatgaccaattgagatttattccagaaatgcaaagatggttcaatataaggaaacaaattaaagtaatataccacattaatagaatgaaggagaaaaacacacgatcacctcaactgatgcagaaaaggcatttggcaaaattccaacatcctttaatgatttttaaaaacactcagaaaactagaaatagaagaacacttcctcaatatgataaagggaatttattaaaactcacaattaacaacatgatccaactataggccatctacaacaggcatactgaagggtgaaagattgaaagcttttccttctaagaagatcagaaataagacaatacctgccttcaccactgctatttggcattgtattggaagttttatccagagcaattagacaagaaaaataaatgaaaggcatccaaacttgaaaggaggaagtatatctttactcacaaatgacacagtcctacgtatagaaaaccccaaagaatccaaaagaaaattactagagctaataaattcagtgaagttgtagcatacaaaatgaacacacaaaaatcagttgtttctgtacacctgcaataaacaatttgacaagaaagttagaaaaaaagcacctccatttataatagtatgtaaaagaataaaatacctaaaaataagttaaccaaacatgtgaaagttttgtacactgaaaactacaaaacattgctgaaaaaatcaaagaagacctaaataaatggaaaaacatcccttattaagtcatgagtaggaagacaatatatttaaggtgtcaatactacccaaagttatctacagattcaatgcaatccctatcaaaattccaacagccttttttggcagaagtggaaaactcaatcctcaacttcatattaaattgcaaggggccctgaatagtcaaaataaccttgaaaatgaagaacaaagcggaaggactcacaattcctaacttcaaaacttaatacaaaaccacattatcaaaacagtgtcatactggcataaggataaatatgttgaccaatagaataaaattgatagttcagaaataaacccacacacctatggccagttgattttgacagggttggcaagtccatttaatgaggaaaaaccagtctcctcaagaaatagtgctgggactcagccgggcatggtggctcatgcctgtaatcccagcactttgggaggccgagttgggcagattacctgaagtcaggagttcgagaccaacctgaccaacatggtgaaaccccatctttactaaaaatacaaaaattagccgggcgtggtggcacatgcctgtaatcccagctactcggggggctgagggaagataattgcttgtgcctgggaggcggaggttgcagtgagccgagattgtgccactgcactccagcctggccaacagagcaagactctgtctcaaaaaaaaaaaaaaaaagaaaagaaaaaaaagaaatagtgctggcacaactgaatttccacatgcaaaacaatgaagttggacctctctcataccatatacaaaaattatctcaaaatgaatcaattacctaaatgtaagcgttaaaaccaaaaagctgctttttaaaatataggggtaaacgttcattaccttggatttggcaattgatccttggatatgaaaccaaagcataagaaacaaaagaaaaaataggtaaattaaactttatcaaaactaaaggccaagtgtggtggctcatgcctgtaatcccagcactttgggaggctgaggcaggcagatcccttgaggtcaggagtttcagaccagcctggccaacatggtaaaaccctgcccctactaaaaatacaaaaattagccaggcatgatggtgggtgcctgtaatcccagctactcaggaggctgaggtaggagaatcacttgaacctgggaggcagaggttgcagtgagccaagactgtgccactgcactccagcttgggtgaaagagtaagaccccatctcaaaaaagaaaaaaacaaacaaacaaaaaaagccacaaccctaaaaacttttatgcatcaaaggacattatgaagaaagtgaaaaaacaataaagaaaatatttgtaaatcatgtctgaggagggtttaatatccagaacatgtaaagaactacaattcaataaaatgacaaaatacccaattcaaaaatgggtaaagggcttgaagagatatttatccaaagaaaatatacaaatagccagtaagtacatgaaaagatgctcaatgtcattactcattaggggaatgtaaatcaaaaccacaatgatataccatttcacacctcctaagatggcaataattttaaaaatggaaaataagtgttgacacagatgtggagaaattggaactctcacacattgcttgtgacaaaatggtgcagatgctatggtaaacagtttggcagttcttcaaaatgctaaacgtgaaattatcttatgacccagcaattccacttcttagtatatatccaaaagaattaaaagcagggactcaaacctacttgtgtgtaaatattcattgcagcattattcataatagtcaaaaagatgagaacaatctgaagtgttcattaacagatgaataatgttttatacatacatacaatggaatatttttccaccatgaaaaggaaagaaattctgatacatgctacaacatggatgaaccttgaaaatattatgctataaaagaaatcagtcacaaaggacaaatattatacggttccacttacattaaatatcctaaatagagaaattcatagggacataaagtagattagaggttaccagaagtggcagggaggggaaaggaaaagttatctcttaatggttacagagttgttatttggtgtgattgaaaagttttggaaacagactggtaatggttgcacaatattgtgaatgcagttaatgccactgaatatagtttaaatatatatttatataaaacaaataacatgtgttataatacataatacacacacatatgtatataaaacaccacgatttaaaaacaataaaatgctttgggaaaatctacattaaagaaactacataactattcaacagtgctttccaaacttgtttgaccttggaagttttaaaaatggactacagttaacatttccaaggacatttatgaaagatagaaacaaagtacaagtgatcataattttgaaagggagaaagatggtctgcagtaacaagtcccccttgttaaagtgcagactgcttcagcagggctcagatggggcctgagatttggcatttccaacaaactcctaggtgatgctgatgctgctggtcctcagcccacagtttgagtagcaggggatataatagtactatatatgaagaatagcactattcttcatgatcctgttccctaccatagccaatttgatcaactgatctgaaagcaaagatgttaatggataataatcaataatttattatgtctccaatgtagcatagttataattttacatgggtttctaagacaaataccttattccaaagaagatactctgagaaagtgatatatagcaacaaagaagatcaatatgggatggggattgtcatacttggtgctgggggcagatgaggtggaattattttttcaaatacatttaaagtatgccagatctatatcttacttccatttatatttggattgcatacttgaattatggccaggccactctttctcataagaataagagaaaaaggaaaaatgagagcaagagagaaagggaaggggggagcaggaagaagagggaagaagggaaataggagacaaggaaggaacgaaggataggaatgatagtgccatgaaaaactagatgtttacataattcttttcaacagtcagattctcattcaactcatttttgaatatcatcactttgctgataaatcaattagatggggttaactagtgtaaaatatttccttctgtagtttacagagcacattcattcactggtgatcacatctaagaacatgtccctgtcaatcagaacacctgagcagactattgtgctaaatgcagatgaaaggttgtgctgacacatgctaggataactcctaaaagtggggaaaaaaacagttatctacaattcaacccaaagaacttgcaggtcaacttccatatttaggtagcttatatcactaggataattgtattggcctcaggcattttacccctgcagttaagaaaaatatccttaaagttaggcaatttctgcctcttataaactctgcgaccttgagaaaattaatgatctttatgcctcaatttttcttatctgagaaatggaggtgatgataattattgaagaatgaaataatacattcactggcacacagcaaggttcaaatatatgtcagttcttagtatatgcgtgtgctaatccctcatcaaaaaactttttttctttctaaggttttatatagaaatgcaaatgaaccttgaaccaaaaaaaagtgcccaaaattgaaaaagtcagatgtaaaggattaagaaaggtacaaaccaatgtaaaataccatggttagcaggccaggagggcaacaggatattatgaaatgagggaagtgcaacaaaaaggttgaaagtttaggtttttggaatcagaatgatgagacactgactctcagcttttctaattactgtgatgggacttcaagcaatttaacctctctaacaccatgttttctcatctgtaaacatttactagagcaataaacagattcgtcttttgtgaggattacactagataatttttacatgcacttagcacagtgcagcaatatatggtaacttaaaaattattttgacttccagcaacatactcataatgccacttatcaggaaagataaaaacgaatatataatggtatgacccagctttctaaatgcttccaagccagttgggtaggctagagaagcagaaaatgtacaagacaaccaatgtttaaattttcaaatttatgcttttaaatgacatttctctttttcctgtttatttttcccatcattcatttttctatctatcttgcatataagaattcaggaaagttttccaccttgaactggatgatctcgaaggaaatatttcattgtggagagaaagggaaaaagcaaacatatataatttcttgtgacttgcctctgccttgtctaatttatttctcattagcagaaaaatctttgttacaaaatagaattctatagccaagaaagagaaagtatctattttgctttgttttgagtaatcaaaaaagaaaaacaaaatccagcagagtagaaagtgaccatggagaagaattcatcatggcagatgctgacataagaggggccgggacaaattaaaaatagttggagcatttcaaagatgtctactgaaaattgttttggtaatatggtggtgcctgttattctgtgcctacaaatatattttttaaaatcacaatcacatttcaaaaggtagacttaaggagggctacaaggggccctctcaaatgaatgagttaaagaggtgaaagaagagaaaaacacattgatagtcctggtttgcatctatcaaaattcattagtaataagtatccaaactattttaaatataaatcctgttatacaaaagtgtgcataagaacacacttgtactttcattaggaaaagagagttctgaggggtataaggtgtttttcaagggtcacagaactcagtacatttcttttcacatccccactgcagaagattacacagatatgagcaaacacatgaaaaacaatcacaattactgtttcattaaaaatagaaaaattagttatgtttcaaagaataacaacacatctcttttaccacaactccttgctccttcttttaccaaaagattttgcctggggagttaaattagccattgtgccccaaatttcctcatttctagaaccccacacggacttctgaagaggtttaaaaatgcagtgtttaagtgctgccataacttgtgttttcactgccttcgagggaggcctcaagccaaattcctcttctttcagatcctacagatttgttgggtactgagccaactagggtgtttcttgcactgggctgctgatcctttgttgcatgaagacatacacatttctacaggagaaggcagcaagtaaatagatagttcatggcaatattagctcagaaagcattaggagaaaattccacaaaggcaataaatatcttccccagcaaaatgtgaagcagagaatcatcagacagtgatttacctactgacaaaaggtaagagaaaaagagaactgcagtcaggctagtcactggatctctggagataacaatggactcttattgtgtccaaagcacatctaggatgcaataatccttgctttacaccatatttactaaggtaacaatatggacgtaaattgacattactgtatgtgtttatgtcttaagttaattttgtttgttatatttctgtacatcatttctcattggtggtcagaggatataaagaaggagtggggtaaattcagaggtgtcaagaaaatcaaagtaacctgctgatttaaagaatgtcatacaaaaggaggtgggtgtttctgactcatccataactcaaaatgcagctccattttgacctcatgaccaggctatttcatcactacgagggaaccgctgttgatgtctacaatgttgatgatcctaaggtcaaaaataaaaaagccaccacccaaaaggctattttaatagaaacttatgacagtgaatccagttcaatagttttcagcttatattttccaaatccaaaactcttcagggtaagttgccattgcttaacagccattatccaaaatacaagtgggaatgttatcattatgcacctcagggtaaaactttttttttggcaatctcaccatcattttaattgtattcaaatctctagccaattgcacagatgttaatggagctgtatttttgcttcaatgtctattgcaatattctcattgcattctgcaggtcctccagtaaacgttacttgcaatatttttatcaacagttttggatcagtcacagaaacgaccatggtaagtgctgcaatgccactggcaagagaaagacacaactcaattatgctgtgaacacaaactgtcaaattttctattgttcaacttgcagggcctcctgtaaatgttacctgcaacatatttatcaacagctttgggtcaatagcagaaactacaatggtgagtgggactgagcattgaagccatcgtgtgaaggaatgggatgtgggattgaagtgcactgtggcatatttgtgagacatttactgagtgccaatttccaactttgctcgcctctgaaaagcaataatttatactactttattttgtaaagtcatttgtcaagtgttcattacttaatattcagtgatcttatatctatcgtgccagagaaatttttaaaacatttgatgttttaatggttttctgtagaattatccacaataaacatgatgcatagttatggatatttaaataggtgcatctccaatgcttcagaagtacaaatttcaaagtttgagagatgtaacagtatagccagttttttacatgtaatggaatttttaagatagttgagcctcccttcgatgccacattcaagatatattccaaagggctgaaattagaaaaatacacacacacacacaattttgttgacaagagaaagtagtcccaagtccataacaattataccatatgaatgccttttccaaaaaaaaaaacccctaaacttaaagctaattagaagctcattatacagtatgagtaaacatgtttcatatatctgaaaaagatttcagatactataaaatctaccagtgcattttttttttttttttgagatggagtctctctctgtcacccgggctggagtgcagtggcacgatctcggcttactgcaacctctggctcccaggttcaagcgattcttccacctcagcctcctgagtagctgggattacaggtgcacgccaccatgcccagctaacttttgtatttttgtagagacagggtttcactatcttggccaggctggtcttgaactcttgacctcaggtgatccacctgcctcggcctaccaaagtgctgggattacaggcgtgagccaccacaggatctcactcttctgcccaggttggagtgcagatcatggcacactgaaacttcaaactcctgggctcaaacgatattcctgcctcagcctcccaagtagctaggactacaggtgcacaccaccacatctggttaattaaaaaaaaattgtggagacaggatctcactatattgcccaggctggtctcaaattcctggcctcgagcaatcctcctgcctcagcctcccaaagcaccagcattaaaggcattaactactacacccaggcttctaccaacactcttcataaatgtcatggtcatgttacctgtgacatagcctattggatcattagtcttacccccacagggttctcggctacagcatggaggttgcattttgggtgagatattttcttggtccccatattatttactttaagtcctaaatcaattggctgggtctaatttgcattactatgtaaagtttacaaccattcatttgataaaaccaaaatcaagtgtaattgagtttgactaagtattatggtgcctgatgtcctaaaaataataagcataatgccattgagaagtaaaaaaaaaaaaaaaaggtttccttgtttatatgaattttctctttttggcaactaacatcatgtttaataaattactgttctttgtggtgtccttcatgttaggaagaattaatttacctttaccactttttttccactggcaaaattagacataattcaactccattacccattttgatattattctgaaacattattacccagaaatgagacttgtgaggctttgacaggatgtggtgcatttaaaaatttacctaaataggatagttttgatagggctattaaatgactcataataaaagctaaacacagaaagagtatatcaactcccaggttgacattcagtttctgtctctcccctcttggctttatcgtaataagagagggggcaaagcttccagtagcccaaatcactgtcaccagctttacacgatggcattcaatgacaatatttgcacgacctaatgctgattgcattaattagattcccatgttgctttgattaaatctcctcattgcatcgtattctcaatcaaaaatgtaaatgtgcaccttttcgatgttcattaatgcaaaaaaaagctaaacatttaaagagattaaaatggaagctatggatatccttgttttctgctatctttaacagctactgaaagtttaataaatgggctgctcaggtacttcctggccacttatttagtgacctttgtcatgcttcctgccagaaaatttggaaactgttgctcaagggtaacatacacagcctgtctattctgctgtataacacagattgaattgcatggttagaagactgatgtatattgtgcttcttttgttttacttcttagctttgatataatgacaaactccatttgctttaaaaatatattttgttttattcaattttggctttggtgcaaaactacagaaaatattttttggaactctatcatgcttgtcaaagaagaaatcctcaggccaccgagggtagggattggcaaactttttctgtaaaaggccagacagtatacctaagactttgagagccagatagtctctgtcacaactatgtgattctgcccttttggcatgaaagcagccataaacaatagtaagcaaataattgtggtggtgcaccaataaagctttacttacaaaaacaggccaaggcccaagttagcaaataggtgtggttgtgtaccaataaagttttatttacaaaaacaggctgaggccaaatttgggccacaggccataggttgccagccccagatttagggcatcaatatttaagtggatgcataataagaatgtgagaattgctccaacaagaaagggcctcatcttccaagataattgaggccctgcctgggactccacctggtacaccagtcttaattagctcaggctgtgataacaaaggattgattggttggcttataaacaacacaaatttatttctaacagttctggaggctggaagtgtgagatcagggtactagcatggtcaggttctgatgagaactctatttgggttacagactgctgacttcctctggtattctcgcatggtagaaagaaaattatctggggcagtaatccccttcatgagtgctctacccttacgacctcatcaccacccaaaggccccgcttctaccctccaatactatcacattggaggttagaatttcaacatatgaattttgagaggacacaaacattcagtccattgcacacccaaagtgtcatcacagcccaagctttctttaccataccgctaagattttaccatccatgaatttactgatagtttcacaaaatttgactcagaaaaattggtcaaaaaaattaaacagaaacagattcttccctgaactgtctttagttgtagtcagaatccttagctttatgcacagtgatgaggtcattgaggacattgattggtgctattttctggggtaatagttttgatttctctacattttctggaataaattatgtcaaagaatgcctcagaattttgagtttctaaacctgttgactttcctctcttcccttacacttcactctcaccccattatccaaatagcattattaaaagttttagtttggggtatttgttcccagatcaaaggcaatgattatatatttcaagaagtcaagatggctttctttgttgctatccagtctgcccttcctatggttaatgaagtcccactaatttattgtaggtgttgcctgcccacaaagtagaggcctgcttacagacccaataccaattctcactctgatatgttagtgtcagagatgtgtactcacaggacaacacatttgtgttactctaaggagtatttttatgtatcattatttttatggatatattattcaaaaatgcatttttgttcattaagacacacagaaatctgttagtgttcattgctagttgccccagcattaagagtattcagtggaacaaattttgtgtggtcccaaagacttagatgactaataaggagaaaatgataagataggttatattctgtttttgaaatgtgagtttaccgttttcttttatttttctcttttctttagtttctgacggcaagtgaatttacaggatggggagtatatttgcaacccctatttcctgatataaaggcatggtttgagaattttagtaatgtcagtaagggtcaagggtgctttcataccatctgtatatagctttcccataagtttgggccatcagaaaatagagaaaagatgctctcttcccagcttccaaatgactgcctggaaggatgtaggtagatagtgtgtgatttggacatatggatgctggaacactatccatgctacagcagtggatcctagtctgctccttatttaacagataggagggtgaactcaaagtgtacaaaatgtgtctgctcagagaacatctccagaatataattctagctccctcaaatccttccccacaacagacatttcacatgctttgctggttacttctgcagaatgaagagttgttttatctccaatctgaaatcacattcctgaagaactcagattaagaagatagacagccccttattagaatgcatgttgtgctgtaactgctgaaatgagactgtgggtcccctttcattctatagctgcgtaaacaagttataagaagatgctgacttatcagggatagcaggtagctacatttcttatttttgacttcttaaggaagaatcaagaatctattacaagcctgacttttttttttttttaatggagtctccctctgttgcccaggctggagtgcagtggtgcaatctccactcaccgcaacctgcgcctcctgggttcaagcaattctcccacttcagcctcctgagtagctgggtctacaggcatgcaccagcacacctggctaatttttgtatttttagtagagacggtgtttcaccatgctggccaggctggtctcgaacacctgacctcaggtgatgcacccacttcagcctcccaaagtgctgggattacaggcatgagccacagcacctgggccaagtctgacattttttaaacaaacatataaggtgaccttggtctctaaattagcagtgcaatggtaaagcctcaatttatcataaagtaactgccccctataacttcaaactcaaggttagctttcccatattaaagctcgcacagacttgagattaggcctactttgggcactcttcccaagagctactgcctccaaaatgctctatgaacttgatcatcaggatgaatgtatttgaaaataagtcatgggaatttgtatagtttagtaaataggtaaaaaagaaaaacaaaaacaaaaaccgtattgaagcttttttccatacaccctaatctttacaacttaattatttttttcccttttgatcctgggggaattcacccaaacttgccatcctgaaatggtctccagagtagagtgactcccagtagagtgaccaactatcccaatttgcctaaactgaggaagttccctggatgtgagagttttggggccaaaattgggaagttctcaggcaaaccaggacaagttagtcaccattagagtaacgtaaacaatgaccaaaaatccagttgccaaatatgtggagatggagcaagtaagggtaaaaaatgtaaaggaaagagagtaataatgaattagtatatatcacacttgtggtcacacgtagcaatagtggataactactagctctgaaaccacagactggcttggttagggaatactgttgaagcctcaatcggagtccagattatcaagtgaagtagtactttcaatgaacctaaggtctttgagtagaagtccccagaagagcagtcactgcccccaagctattcattaacagaagaaaattcccagaccaaatgggaatgccaggggtgtacctaagtctcccacagtgttctgattgagaacgtgaaacatctctggataaagcatcaagttggctagtgtagatacaacacattcagacaaaatgataagaatttcaaaagtaagtagctgcaaggaaaatattttgtcaacatgaaagatcttaatgtttacgttgataaattttaaaatattgccccatcatgtcatagttttataagattttcactactcaaattacgcagtgggtttccttctgcccagagcatctcagcagaaagggatcagagatcatgtgatttctgatttggaaaataaatcagttttatttgacaatctgccatgacagactgatttctgtgttcattgtttacctttttctgtagcaaaatcagctttagtattatttcatcccaaaatgaataatttaaacactaaaaaattcaaccaagtcaacccgttttattggtgttctggtttggttgaatcttcctttttctttctcccttttgtcccctctcctaatagaactaaatggtttattttgaccaaggtatacacagtttggtttactcggacaccaaagctgtatcaaatcagggagaagaatgagagagaaatgcaaatagaactcctgtgccagggtaatcagtaacacttgtccacggcatttctgtaggactaccgagtgaatatttttctgagacaacagtggaatgattcacggctggcgtacagtgagtacccagatgactccctggacttggacccatccatgctagactccatttggaaaccagatttgttctttgccaatgagaagggtgccaacttccacgatgtcaccactgacaacaaattgctacggatttcgaaaaatggcaaagtgctctacagtatcaggtaagcctccattggctgcacatgttcgcatctccatttctccactaatgtagagctgcctgattctgcagggtaggatgtatatgaatatttgacttttgtggtttcttgtttatcatttgaatcttaaagttggtggagagtgtcagaagtccctttggtctcataaatgtgattctccataacaagaatgtatttggtaggatggtacatggttaatggtattgtgtaatcacctgcacaaatgtgttcctgattgcttcagtaaaggaagtacaggctattccgttcaattgccattaagcataatatacaaaatctcatttcaataattctgccattctgtaacattcaagcatgcacacacacacacacacacacacacacacacacacacacaaattcaatagctcagcatagtcattaacaacatacttatagctggatacatggaaacctggttccaatgtcagctttgcttctaagtaaacacgtgaccttgatctcttaacttttcttggacttgggcctgggacagacaattgctgagatccatttttgcttttatattcaaatatgatcttctccagaagtgttatcactctaggctcaaaataatctcccccttttctgaactcatatagcagtttctttttttttttccatatttttttattatactttaagttttagggtacatgtgcacaacgtgcaggttagttacatatgtatacatgtgccatgctggtgcactgcacccactaactcgtcatctagtattaggtatatctcccaatgctatcccctcccccctccccacccccacaacagtccccagagtgtgatgttccccttcctgtgtccatgtgttctcgttgtttaattcccacctatgagtgagaatatgcggtgtttggttttttcttcttgcgatagtttactgagaatgatgatttccaatttcatccatgtccctacagaggacgtgaactcatcattttttatggctgcatagtattccatggtgtatatgtgccacattttcttaatccagtctatcattgttggacatttgggttggttccaagtctttgctatctaatagcagtttatctgtgactctgtaaggctcttattttttcctgccttattattttggttattgctgttcatgagtatagcataaaaacatggatttctggaattagacaaatctagaatcaaatcgaagctttgccacttactaagttatgtaatctatgaccctcagttaccttaattttaaaacgggaaactccatgtttatctctgtatattcttgtgtgaatgagtaatgtagtggtcagcaaatattttctgtaaagggccagatattatcttaaatgttgcagaccagattgcctctgttgcaactactcaactctatcattatagctcaaaagcagccataggtaatatgcaaacaattggacacggctgtgtctcaataaaatattatttacaaaaatagatggtggactggatttggccctttggctgtagtttgccaacccttgatataagatatattaaaaatacttgctgcagtgcctgacacagagtaaatgtttgataaataaaataatggctatctgtattttaaaatcagttctttttttttaatgctcaacatctctaatcattagaaaaatgcaaataaaaaccacaatgagacaccatctcacaccagtcagaatggctattattaaaaagtcaaaaaataacacatgctggtgaggtcacagagaaaacggaacacttatacactgctggtgggaatgtaaattagttcagccattgtggaaagcagtttggcaatttctcaaacaaagcagaattaccatttgaacaggcaatcccattattggatatatacccaaaggaatataaatcattctaccataaagacacatgcacgtgtatgtatgctcattgcagcactattcacaatagcaaagacacagaatcaacctaaatgtccatcagtggtagactagataaagaaaatgtggcggctgggcgccgtgggtcacgcctgtaatcccagcactttgggaggccgaaatgggtggatcacgaggtcaggagttcaagaccagcctggccaatatggtgaaaccccgtctctactaaaaaatataaaaaattagccgggcatggtggtacgtgcctgtagtcccaactactcaggaggctaaggcaggagaatcgcttgaacctgggaggcggaggttgcagtgagccgagatagtgccactgcactccagcctgggtgacagagtgagactctgtgtcaacaaacaaaaacaaaaacaaaaaaccaaacaaaacaaaaactggcactgtacaccatggaatactacacagacataaaaaagaatgagatcatatcctttgcagcaacatggttggaactggagggcattatcctaagtgaactaacacaggaacagaagaatactgttcagtgaatagtatagaatagtacagtactgttcaactgaacatgcagtacaaacgctgcatgttcttacttataagtgggaactaagcattgaatatatatggacacaaagaagggaacaacagacactgggacctacttgagggtggagggaaagaggaggacgagaatcaaaaaactgccttatagggtactacgcttattgcctgggtggtgaaataatctgtacaccaaaccccgatgacatgcaatttacctatacaagaaacctgcacatgtatccctgaacctaaaatcagcgtttagaaaaattaatgttccttttcagtagtaagctcttagctctttcaattcaagatatttggtttttgtcttttttgtaacatctaccaaatgtctaggacaatgtactgtatatgagagacagtacattgaataaagtattggcatttaaaggtccttaacagaatgccccctttcgctatataaatttattaccaaaaaagtaaacagctagtctccttgcaaataatttttccaagtctgcagactcaccatcatcacctcatttgacaactctgtatatgatttggttctgtattgtaaattccattcttatacctagtaatttcacagcatgctgatggctgacagccccaatgtcttgtggaataaaagaagctgctcatttgtaaaaagcggcaaagtcactgcttgcacagaaaaccaggaaacttcccccagtgaccattcatttttaaggaaacacaaaacattctccatggtgatgtgtttggttggtgtaaaatgcagtactgagcacaacataaattgatcggacctgagaaaatgggacatatgtggagtgtggtgctaggaaggagagttataaaaagcagcacagagcatcagctgccccagctaatcctccaggccttgggtggcatttgctctaatgaataccaggcatcacacactgctgaaataaaatcagattgtagttgctgttgttgctttcttgctgttttgtgaaggtctttacattctagaatcatgaagagtatgatgctcccaagcctagacccagaggcaattcttgtgtctctggttcccaagcatagcacattacaggccctgaaatgccctgacaactgttttggattaggtggggattgtcctgtgcaggctattttatacttttctttcattgtgagtattttctgaaatcaaaataaaaaaccttggtaaaggagaattggggatatcattttaagaaaatacaagctgttcggagatttgaactgcaagaatctaattatttgcctagaagggcttttgatgaaccagatactgtactgggtctagagatccagaactaagtaagatgtggtctttcccctggaatgacttcagtctaacaaggcaggtggatgcatgataaattaagtaataggaataaataggaaacaaggaaaacaaaagtggctctaattttgcaaatgaagtatgtgatcaaaatattgtcagaatttggcagttggcatccacagtcctgtttgtcagtgggctcaatttaactagaggtcaaggagtaactaatgctaatatatgcccagctgcaggtttgactcaaatttaaggccaaggggggtacagttgtgtccatgtcttaaaggtgctgaaaagttcctgctgacgttccattagaaagtaatttccctgcatactcaggtttacaacacaaatactcccaggagaggaaatccactggcttaaatccatactaaactctaaagagctgatataaaatttatttctgaggatgaacatactggattcctaagaggagaaatgggatagaatgaagaaaggttgggaaagatacaaggaaggggctagaagtaccaaataaaaaccctaaaactgtctccacatacacagtaaatacttaagcaattatttaattatgtaagcatgtggtccacattttaaaaagtaatgttctgtcttgatactctgtatttgcattttcctgaaacctaaagcaaatatcaattgcatttaatctgggaaaaattccatgcttttcttggctttgtaggtgtaggggtagaattaactctatatgggcaccaaagcccaaggttttgattgtcaaacaaaacaaatatagaaatatacagtccactgatttcataacaagcacgatcacctttcctaatacttcatatatctgtattccaaaaggtaggggtctaaaaaaaaagagaaggcagtagaccagaactccgtaagtgtcatccttatgaacacttggggtaccttgactaaaattcaaacaaatcttttaaataggaaggaaaggccttatctcagtgttaataaaccttttatccagtgatgtaggacacaatctttgttgatgaaaaagtaccaaatccatttctgtccatttttctttaatattcattctctaatgttttatcttactctctgttttttcctaagttgtttgttgacctgccccattaattattgatcatctctgacaagagtatacattttgatttgtaaaccttcttcagagaaagtcaataatccagagaatagagatcaagtactgagtaacatgtggtccttcatctgggatggggaaagagtcaaattctaaattcagagagagtcaaattctaaattcacattacttacaatgaatccatacttgaatccatactgaaatagtgaggtgagtcttgaaggttgtacatattattgtttaaacaatatttgttgaatttaatattgtgagttggaataaaggtcaggacatcatgggatatggtggacaacatgaaagaaaaaaggagaaggtgagcatttttgaagaacagctcatctcacatgcccacagtatctttgctgatattgtcttctttttaaaaatcccattgcttctgagaatttagtcagaaatatgacttttatagaaggattttttttaaatttgaagttaccttgtaaaatatctaatccaacacccttgttttgttgataaggacgtcacaatggagctagtaagtaggaaagctaggacaagaatcagggctcttaacttctgtttcagtgctgtcatttcctacccccacattaattcctcatttacttcaacccaagtccaaagacacaaacacacacaattcatgttgcagcaaagggcatcatttcatgcttttttatggctgcgtagtattctatggtatatatgtatcacattttctttaatctaccattgatgggcagctaggctggttccatgtctgctattgtggatagtgctgtgatgaacatacaatttcatgtgtcttttgtagaacaatttattttctttggggtacacacccaggaatgggattgctggttcgaatagtatctctgttgtaagttatttgagacgtctccaaactactttccacagtgcctgaactgatttacattcccaccaacagtttgtgtttgcttttctctgcagccttgcagtatctgttgctttttgactttttgataatagccattctgactggtgtgagatggtatctcattgtggttttgatttgcatttctctaatgaccagtgatgatgaacattttctcctatgtttgttgaccatgtgtatgtcttcttttgagaagtgtctgttcatgtcctttgcccatttttaatggggctatttgttttttgcttattgattggcttaagttccctatagattctggatattaggcttttatcagatgcatagtttgtgaacattttcttctattctgtaacttgtctgtttactctattgataatttcttttgctgtgaagaagctctttggtttaattaagtcccatttggcaacttttgtttttgttataattgcttttggggacttgtctaaaaataattttccaaggccagtgtcaagaatggtgtttcctagcttctgtctaggatttttttttttttttcttttgagacaacatctcactctgtcacccaggctggagtgcagtggtgtgatcttggctcactgacaactccattcctgggttcaagtgattttcttgcctcagcctgccaagtagcttggattatatgtgcatgccaccatgcccaactaatttttgtagttttagtagagacagggtttctccatgttggccaggctggtctcgaactcccgacaagtgatctgcccacctcagcctcccaaagtgttgggattacaggcatgagccactatgctcagccctgtctaggatttttatagtttgaggccatacacttaaatctttaatccatctagatttaatttttgtatatagtaaaaggtggtagtccagtttcattcttctgcatatggctagctagtcattccagcaccattttttgggaaaaggagtcctttccccagcttgttttgtcaaagatcagctggttgtgtgtggctttatttctgggttctctattctgttccattggtctatgtgtctgtttttgtaccagtaccatgttgtttttattactgtagccttatagtacagtttgaacttgggtagtgtgatgcctccagctttcttctttttgcttaggattgctttggttatctgggctgttttttggttctgtatgaattttagaatagtttttttttctaattgtgtgaaaaatgacattgttagtttgataggaatagcattgaatctgtaaattgctttgggcagtatgactattttaatgatattcttcaaatgtatgagcatgggttgtttttccatttagttgtgtcgtctctgatttccttcagcagtgttttgtagttcttgtagagatctttctcctccttggttagctgtattcctaagtatttcattttttttgtagttattgcaaatggtattgtgttcttaattttactctcagctggaatgttattggtgtatagaaatgctactgatttttgtacattgattttgtgtcctaaaattgtactaaagtcatttatcaatttaggagccttttggctgagtctttagggttttctaggtatagaatcatatcattagctaagagaaatagtttcagttcctctcttcctatttagatgccttttatttctttctcttgcctgattgctctggctaggacttccagtattatgtttaataggagtggtgacagaggacatccttgtcttgttccagttctcaaggggaatgcttccagcttttgccatccagtataacgttgactgtgggtttgtcatagattgctcttattattttgagcgatgttcctttgattcctagtctgttgatggttgttaccatgaaaggattttgaattttatcaaaagatttttctgtgtctattgggatgatcatatggttttgcttgaaccttcctcaaaatatatgcatattttggcagggcgcggtggctcatgcctgtaatcccagcactttgggaggccgagatgggtggatcatgaggtcaggagatcgagaccatcctggccaaaatggtgaaaccccatctgtactaaaaaaaaaaaaaaaaagtacaaaaattagccgggcatggtgtcgggtgcctgtagtcccagctactcaggaggctgagacaggagaatcactggaactcaggaggcggaggctgcagtgagcagagattgtgccactgcactccagcctgggcaacagagcgagactctatctcaaaaaaatatatatatatatatgtatagtgtatatatatacacacatatatgtgtgtgtatatatatgtgtatatatatgtgtgtatatatgtatatatatgtatatatatatgcatattttgtgcattaggttatttaagctattttttgtttgtttgtttagaggaaaaggtccttatctttattaaagaagctatgaccctccaactgttaagagcttgagctttgtttccagatttactgcatgcctccagaatgggtatgcctaaaggtgaagtgattaaggaaatattgtttgctttcagtgtgttattaaactgaccagttatctgggggcctcatactaccatctaataacccataaataattataaaattgcccctcaacaatagcaccccatatcaccaaagcatctgtttacctcatcatcaacctttatctgacctaaaacttattggcacctaaaactttatggcattggaggtgatttgcttgttaatcccttttgattctatttgcaattctgggtgttgataattcagtattctgccttcccagtagtacttgagttgtaatagagaactcttggggattgacacgcttttccctctgatgatagattacaggcaccactgagagtaggtatagtgcagatttctagacagacatccaacgatgttcctccaaacaatcttgtctaatgaccaactctacccacatacataaaaggctagcttttctcacatggcctcccatccttgactcatcctatagtctgatgcaagaacttcaaaagattctaactttagttatatatttttttatggcatagggaataaggacattctctatttagatgtcagagccaaaaataaaatgtacaatgaactgagacctgccttaaatgttgccagtggtgttgctttgattaccttactctcaattttgatgagacacataagcccgtattttctattagaaggcagctatgaaaaactatgatttcttttcgctgtgcatatttggaccattatttatctttatgttctataatccaggcaaaattacattctcattttctaactctgtgtccaaatcctcattagtattgtgacttaagtaattaatgtctgtaacataagcgtccacatcagaattaagcagtcttcagagaagtgctgggaaatgccatggaaaccacaatgattccattcttcctagaggcgagcaaggtcgggagggtgggaagcactggcatgcacatatgctagtggattcagcaggagctgtggtgtggaggggctgtttttggagaggggctctttaaaaaggtacagctgagggtagaaatatgaaggtccagaaagtgcgttgtatgtatgacagactctcataaagtatggaaagctttgttgagctcctgctcaggttagaaatacgcaaacactatgggacctaatattggttcagacacaacagagtaaggatcttgtattagtcagggttccctagagggacagaactacaagttacatattacatatatttatgaaagggagtttattaaggagaactgactgactcacaccatcacaagatagagtcccatgataggctgtctgcaagttgaggaacaaggaagccagtggtggatcagtctgagtcccaaaacctcaaaagtacggaagccgacagtgcagcctttagcctgtggccaaaggcccaagagcccctggcaaaccactggtgtgagcccaagagtccagaagctgaagacttggagtctgatgttcgaaggcaggaaacatctagcacaggagaaagatgaagaccggaagactcagcaagttggctcttccatcttctcctgcctgctttattctagccgtgctggcagctgattagatgatgtgcctagccagattgagggtgggtctgcctctcccagtccactgactcaaatgttaatctcttttggcaacaccctcatagacatacccaggaacaatactttgcatccttcaatccaatcaagttgacactcaatattaaccattacagatcttatgcttgtttggaggaaaggagagacttgatcaatgaaatacatggcagctagcatgaccacttgtccttaactgtttacgtgactggactagcaatagcaaccagtaggttttcttccatttagaggtaaccttacatttcattaacattcatcagtttgctcttcaggcaatggtacaaagaacagaatattgagaagatggctcagggcattgtgatctccacacttcctttcatcatttactgtatctcccaggatcatagaacagcctttccagctccataagtttatcattctgggtctcagtttcctctataaaatgagactgaaccagacacttagaccaagtatgaggctccttctagcactattataagtctgtaactcaaaataacgtccctctccttcccaaaccacaaaacactttcctgatgagtaaataagagtgcattcttcatgtcccttagggcttgagtcagcagaggagattcagaatttcaaggtgcctgtcttaaactacttggatctttgaacccttttctcctgaattaaatatacaactcctgagaagaggaacctgattttggagtaggttagggaggtttggactacctgtaatttaagaggcagcgttaaaacattcaacatggccgggcagagtggctcacacctgcaatcttagcacttgggaggctgaggagggtgtatcactttagctcaggagttcaagacaagcctgagcaacatggcaaaaccccatccctacaaaaaatacaaaaaaactagctgggcttggtggcgtgtgtttgtagtcccagctacttagggggctgaggcaggaggatagcttgagcccaggaagtcgaggctgtagtgagccaagatcatgccactgcactccggccttgatgacaaagtgagactctgtctcaaaaaaagaaaaattcaacatatagtttacacaatgacaaatactcagtatcaagtgccctgagaaacttcccagtcgtaaactagatcatttgtaccctctgattcaatcaccaggaatatctgtgaactattattttagaatatgttcatgaaacataggtttatatacttttagacaattacacaaagatggttggctgggaaaataattgactgaatatgtagactaaaggaatcatgtggtagatttgagccagcagagttgaagagctagtctgctattattactcatcacctgaactttctcatggcagaaagccaaaggaaaaccagaggttctggtgagggtgctcaacttacattaatgtgggcttctacctggtccacactgctgctttgaaaggctccctggatgacattaataccaaaataaacatgcataatgtcaccatggctcttatgaaacatatgaattactttagttcattctcacagcacataatccaaaggaaaaggtactttattttaaaatggaaaaaaaaatgtgtccatctgcgtatctcagcagtctctccaacaagtttcttctcgcttgtggtgtttaaaattacaaaccaacatctgtatcaaagaggatacgatatttatcattggacagtcattaaaagattattaagtacgtatattaatacaattatgtgaagttccacatgagatatactctcagagcaaagccatctcatttctgattgattggttatttcaaatgacaataaaataaaggttttatttgatgtttcattttagtatggatattttgctaaacttgagcagtcagatgaaggatagaaagcaaaaagtatgctaggggattaaagacagaattctattggggtgggacaaatgtcagttctgagggtcaggaatacttggattcaaatccaattttactaaatgaccataaaaagtcatttaacctttctttgacctgcagtttttctcagttccagattcacaataaatgttcaatgaatgtcttaattatccctgagttggctgtaggataaaagggaggaagtaagggcgacaacgccccttaccttccttaacacatacgtatggacatacttgtaccattcaggctccactcactttccacacttagtccaaagcagatggatactctccttgccttgagtttcctctttttgggagacatgtagctcataacagaggtgacagttgcatctactttcagataatagtttagctgatgctgttcctcccctttagctgcttgttaaaagtaaactgaggaattatgcttggtttcaaagtgttatccagtcaaggatggaccatcctatcaactgaccagaactccattctctctccaaactttgccaccagaaacagtggtcagtaagtctccatcagttaccacagtggaagtctttttaacgcagcaaaatatcagccaggtaacacaattttgccctcagttgtcaacaggtacaaggttactttggttttctcaaaacggtatctgcagttcataagcatgcttacacgtgttctcttcccccttttttttaaagtaaaatgaactcaaaacattttaaaaattgctacactgtacagtaactttctccctttcttcacctcagtgccacgattaaatagctgtaatactagacgcatagtaacaatgaaaaaggcagttctcattatttcaatgtgcaggctacattttaccttcaccaatgttttgatatataaatactagatgtgaaatgactttgaaatgtaaaatgtaactaagatgtgggggagtattgattatttaaatctttggtaatttgagttccttcctctgatggtgttcaatttatccctcttctattcaacaccttcaaaacattttcatccaggaaatatcaaagcatttgggaaaattttagctgcagatttatcagttgctctccaagttgaatccaatccacatttggacttaattaacatgggccaaccatatgtgtgcacactttctgaaaggaccacacacagatgggaacagatattgtatttttgtccttcccagctactattgctcagtgcatatgggtattttttatgatgcctttataatatttggtaaacatggaccttcctactcagccactgggattttagtcaggggagaggagaatagctaatgagccaagcagtgttgccatttatctcctctacatcccaaggtcaacaggaaaaaaaaaaaaaaaaaaaacagcaaaagtgcttatttggaattaatagagaggaaagagtctaaccatacagcttagaaacaacctgggatttaggtccagccttagacaatattgaaaaaatgatgtgtctctggtgcccagccacactgttctgagccctgtttttcatctagtttcatctttccctttgattttcttagtatgacagtctgcccttggagatatcaatagggaatctgggaatctatcaatttatttacacaaagaaggaaatgagtaacagtacttgaaacacatttctcttcctagctttgcatcttaatagtcaaagaagcctttagctaaatgtgtatttatttattatatatagcagctaagagttggaaggtgtttgagcaaggatatattgggacctttgtggaactcccaacaatttatacaccattaatttttcaaactttgattaggtggaaagtcttcccaggtgccaagctcagggctggagtaggcaggactctctctatgcattacatgatgtaagttcaaagtagccatttaatcacagagctttcagaaatggtaagttaaaaaatttcattccttgcctgcctaaccagacttggaccaattccttttgttttctgtgaataaagatcctcatgtgggtacctcaggttcaattcaggagcatcaagtcatgcttctctgatagaccaaaagggccctctaaggatccaggtatgtaagaatagataacctgctctacccgatcactgtgagtgcttatctgggccccaagggagtaattaaaggtcctttacttgattctgttcacgtgtgtctgattcacatcatcaaaagtattgtctaagtgggagagttggaaacaacttcgaaaagttcaataataaattgaaactattaggatacatatctgcaattctgatattaagttgtgatctccttcaagagacacactgtcttattttaagtgtctggtgcctggtgcccaataaatatttgccaaaatattgctgaatggatgtataatactaagttacagcccagatgcagtcctgcttaacaccaatccctccacaataggacctagagctagtcttcccatgtactctgttctttatgaccagtaccatgagatttcctaaaatttttgttgtggttcattcaatgcaggttgcagccacctccctaacttcttttgaaatttcttggtggcctattttccagacatcagagacagtaatctgatatgctgccatcgccctgagtagagttcactgcctacttttggcctttgcacactggcatgtgttaaaaggcatgatggtcttggcttcttctctatcttacctagaaactgtcctcctaaccctcttagcagctctcccagtttcctagccacatctaccatattcttggttgccagtggactgattttggcttcactgccctgacttaaccagtatacctctccaatgtgactgaatcccatgattaacacccccaacttgtatcattacccctagtccaatcacttagcagcctacttgaggctaactgtcctaccctaatgtcgagaggctgagggaggagaatcgcttgaactcgggaggtggaggttgctgtgagccgagatcatgccactgcactccagcctgggtgacagagcgagactctgtctcaaaaagaaaataataataatatttcccaaaggagtgctactgttactgaaaaattatagacctctttcttaaaaccttctcctttttgtctatcacattgacagaaatcaaagtcatccctcgggatatgctgaagtagtactccttaaagtgtgctccaggaaaccagcattggtgtaacctgggctgctttatcaagagggcctgataatctgcattctaaccaagcccataagacaatgcttatgcccaccagagactgaaacccactatactaaaagatggttgatcagacaaccagcctagcggtgttttttatcccagtgatttcctaatcttccctccctctctccatgtgtgggctgtattaatgatgcacttttaacttgacttctaacttgcccccaggctaatttcacttaaggtctaggtgggttaagatgacactcttgtttgatacttgatgcatcctgtcaaatctccctgacactagaatgtcacatggttcagaaatttcaaggtacaactgggaggaaagattcaacggatcaacatggtacaggaaggccttccttatgttctcagtgaaagagtgaatagtgttctaggatgttggatgacaaagccctatggaagcaataaatgtctcacctatctgcccagattgccaagaagttcctattttaagaagtgttacttgcacttaaagttttcatcatattcaagagggtaaatttacctataagaggaaatccttcaagctggttgccttcacttatagtttataatcacagagatgttgagcaggatggggatgtttgctgggggaggcccagagatttagtcaagatcaaatagctctttatgggtaagccaggtctatcacccaggtttctgggttgccgggagaggctggaggagtttttaaaacaacaagccatgaggattctgggtgtctgaggaaaaatgaaaggggtatccctgagcaggtacaaggcaactaaggtgtctatgaccaactctgctggcttcatagacaaaagaggataataaattggtaacagattattttcctaaggaggaaatgtgaaatgtgatagagtgggaaataataaagggaatttgatgtcggttaaagctgtattcaaatctaacttcggttgcttagtggttttatgactttgggaacaaagcttaaactctgtgagtttcaatttgcttatctcacaaatggaggtaacactgtctgccttgtgtgataatactcagtgattataaaataataagaatgcttgacccacagcaggtgttctgagaattatgattattaatactattatcaccatcactttaatttttagtttgcctaagtattttcatcctaaaggagcaccataggttccagcccccagatgtgtccatgtgccactgaaagtttgtggtgtgctgcataaagagagataaatgtggtcccaacagaggaacagcaatacccccaagactctcttgttcgtcctgaaagacacagaaacatcctcttgtccttcctctctgaacaagagaaactattgtaatcattagaattaactctccaaaaatagcatgttgtcaatccttgctttagggaagcagatcactcattaaaatttgtatttgtacctgaaaattcatcttctcttcaaatggtatttttccctcaagagtttcattgggaatgaactccgagttctaattctaagttccttatgaaccagtagttgctttatgagtcaagcagccttctgtctgccataacattgtaatgttaaatgattaatttacattcttctagcaatgtgaaaatagccccagccatggccctaactagttgaccaaggttccaggacaagtcagccaggcttcctggcattcctttaacttgatttgttttatttctagtgagaatctgccagcaacttagcggaggcaccaggcaagctttgacagtcctgtaatttagcagcatcctgtggactctgatgactggcctcgtcccttctaaatcctttaacctttcccatttccacagaataaaagcctgaaattctcacacaaattttaggatactgattcattaatttgttcaataaatatttcttggatacctactctggtctaagcagagacaggggttcagccttcataaatcttgcattgtagtagggaagaaaaataaataaaaaatataaaaattacaatatttgatttaacaactgtaaaggtaactgaaatagtttacagtgtctgcatctatcagtcatttaaattttaagtgaggtataaacccaagagatggttttatgagcaaggtgaactcaataggaaagtagtaagaaagggaaagggcaggaaaggtgagattttgggagacggactttctttgctttgttctattctttgcctttaaaataggaatgcttgctcagccttcttactttcagtaaagaagcagggcctctgtgaaggaactttacttcttcccttgtgcaaacaggagcaggggtgccctgaatgcacagtggaggaacggacaataatgcttcaggaaatgagttatttaacaaaaatcaaaaggaagaggggcagcctcagctcaatgccttcatgtgcaatggccttaatatttcagattatcggggaagaggacaaatctgacatgctggtcaatgtctgccagtgagaagtctgagtgtccaggcaagttcggaagactactggcttcccgactaaaatagttaattctgtgagacccacccaaagtgggtgaaaagccagagcaaaggagataaaaattgttcacattttagtatattggtgtatagacatatcagccttatttggtgcaatttctgcatgtctgtacaaaataatatcaagttctttttttcccccaaactcatatttaaaaaatcataaaatagcctttttaaatagcaaatggggtggcacttttgtagattcttgtctgggagcataatgaaatattctagggtgatgggaatgctctaaatctggatctgaaagcttgttaaataggtgaatacagatgtaaaaagtaattgcactgtatcttaagatttgtgtttttttactgtatttaatgtacacttcagtagaaaaaatgaaaaaggaaaaaataagtagcgggaaaaacctagatcttaggcctttagatgcacggtagactggatgtcataaatgatgagctctgaggctcaggcagggacttattagatctttacaatatctttctatttgctcatgatttaacaaactgcggaactgttaactctcctccttattattggcacccactgggttccagtacaaaacctatctagaaaggaaattagaaaaacaaagaagaaaaaaaaacccactgagttctcagctgagacaagattcagggatagggtcatgcttgttaggtatttctctcagtggggtctcccatgctgttaatagttttggctcccaaaatgctgagcccctctaggatagttagatctgccacaaaggcagcaataattgtgtgtgagatctctgcttcctgaagaaatgtgaaaaggtcattttgcaaaacagtcaaattcagcaagcctatgattaggaatattaaagttgggttgtttccagtaacaaaccaatatatagttgaattctgtgacattcttaaaagaacatgttcttttaagctgtgttcatcttcattattattatttttaatttctttaaacttttcaaaactataatgaaatttccagattttttggttttgattcactgaaaccaattatccatatgccatctaattattttcatataatgaacatttttttaatttaaattttaattttttgaattgtaaatggacaaattatagttgtttatgtttatggggcacaaagtgatgttatgatttaagaatagaatgtggagttattaaatcaagcaaattagcatatccattccctcaaatacttattatttttttatggtaagaacacttgaaatttactctcttagcaattctgaaatatacaatgcattattatttactattttcaccaagctatgcaatatatctccatgaaagaaaaatttattccttctgtctaattgaggctttgtttccttttgcagcactattcataatagacaagttatgaatgaacatatttttgtatgatgaaaatatttatttcttctttgaaaaatagaaaaaaaatagattctcattatggtaataataattttaagctcatggatccttttgaatttttttcacctttaataaggtgtcagctttgttgttgttttttttgtttgtttgtttgtttacttttttttggttcttatattctgtccttatttcaaagagttcatggcattaatctacacaaaattgtgttttcaaaaaaacaaagtctttatgctgggaaccaaaaactaaatatctgtatatctatagctatatctgtaaatgaactccataattgacaacaatttttcctgcctaaaatgttatttttaagtcagttgtttagaactataagccacattttttcctttagagacatgtttgggttctcagaatagcccacggaaggtagctaatttatttagcaatgaatgtgaaatgctgtaggtttgtggcaaatttttaataatcatgatatgattgtaatagcaaaaaattactgaacgaaatggaattttgtaattttacctttcagttattgtttgaagaaaggcacagctaattacacaaagatgggaaagctgttatatgaatagtttttatggacattttcaaataatttatactgctcaattcagataatgcaagataaagaataaaaacaaaatatgaatcatcccactaaccaaaaatataatggtgtgcttatttccaagatttaaaacatgtttttacattgcactgttttatatctttctttttccagtcattatattttaataattttgatgattgtcagcgtggattctttgtctaatctgacttcaaatcgcaaccctttcctttctttaaaatacatgtgctaaattttgttttgtttgcttttacttgaatagattgtaaaaatgaagcagagaaaggaaaaataaaggaagcaggaaggcagagcaagaatgagcatgacagcaagggagagtttaggcaacagtgtgagaattcgaggggtctttggatataaaaggtgtttgagatacgatgaacagaatttgaagcagtcaactttagaaaaatacggattgtagtattaggatcaaatgagaataagcatcatcttacctacctcatcatttggttgatgacaaaacaaatgtttagcaagtttaaggtcttgtttgggggaagagatagtttgaggcagtactaggaagggaaccaagacttactaattctcaatcctaatttccttccttgaatcttggagatacagaaaaatgggagagcaagaggtgtgcatcattcccttaaggattaaaaagggaaatggtggaaatgagatggtagctcaacgaatatcctgatataaggatcagccagagctgactggagttcaaaaaagttaaggaaagaggaaagtggagcagagtaaccccttctgggtgcagagagctgaagactatgtacaaaccgttgtttgtttgtttgtttgtttgtttgtttgtttgttttgtaagataatgagtagtttgtttttcctttttttttcaatttttttatttccataggtttttgggaaaaaggtcccatttggttacatgacttaagttctttagtggtgatttgtgagattttggtgcacccagcacctgagcagtatacactgaacccaatttgtaatcttttatccctcacctccttcccaccctttccccttgagtccccgaagtccactgtgtcattcttatgcctttgcatcctcatagcttagctcccacttatgagtgagaacatgtgatatttggttttccattcctgagttacctcacttagaataatggtctccagtcccatccaggttgctgtgaatgccattaattcattcctttttatggctgagtagtattctatcacatatatgtaccacagtttcgttatccacttgttgattaatgggcatttgggttggttccacatttttgcaactgtgaattgtactgctataaacgtgtgtgcaagtatctttttcatataataacttctttttctctgggtagatacccagtagtgggatcgctggaacaaataatagttctacttttctttctttaagggatctccacattgttttccatagtggttgtactagtttacattccctgtagaaaggttcccttttcaccacatccatgccaacatctattttttttttttttgacttttttgattacggtcattattgcaggagtaaggtggtatcgcattgtggttttgatttgcattaccctgatcattagtgatgttgagcattttttcacatcttttttggccatttgtatatcttcttttgagaattgtctattcatgtccatagcccactttttgatgggattgtttggttttttcttgctaatttgtttgagtttattgtagattctggacattagtcctttgtcagatgtgtagattgtgaagattttctcccactctgtgggttgtctgtttactctgctgactgttccttttgccatgcaaaataaacaaaaacataaagtaggggaaggacaccctattcaacaaatggtgctgggataattggcaagccacatgtaggagaatgaaactggatcctcatctctcgccttatacaaaaatcaattcaagatggatcaaggacttaaatctaagacctaaaactataaaaattctagaagataacattggaaaaaacccttctagacactggcttaggcaaggatttcatgaccaagaacccaaaaacaaatgcaataaaaacaaagataatatgtgggacttaatgaaataaaccatgatctttaaatgggtttttctagctcaagaactacatgctccagaattatcaaaattctagaataaatgctacaatatattgttaacccatacatgcagtaaatgagaagactgtggagttaagcatttgcccatttgatgtaagaagaactagcacttaccatgatcagttatacttattacatcatttctgtccttgaagcaaagtccaaggtgtaattctaaaatagtataaactttatatcttttggacattggcgtgggtaagagcctattgtttttgttatgttatatctcagtggtcttgtttattctagtacaaagctgagaacagcaccattttgggggaaggagggagaatcagaggctggaagatgaaaaatagagagtaagaggttatggtgaaatactacaatatttaaaaaatttatcagtgactgttcttcattttaaaaacaaaaagcactgccctgagttggagcttagatttcattatttgaatcaatgtcactttgcttaatgccaagtgtattttgtttgtttctcaacaactggacttcatagatttaaaaatggtttttaattttttttttgtttgctaagactcaccttgaccttatcctgtcccatggacttgaagaactttccgatggatgtccagacctgtacaatgcagctggagagttgtaagtcaccactgttgaaatgactccctgcttgttttaaccaatgacctggttcttttagtatgtcattaaagagaaaggacccttacaactcattccctatatactgaccaacccccaacatcctaatggaaagacaaaccaaagtgtgtgtgtgtgtgtgtgtgtgtgtgtgtgtgtgtgtgtgtcatacaaaatctcattatcaatacagcataggcaacctttcaaagtaaaatgccaaataacttgcctttctccccccgcccaaaaaatagcctgatttggtaagcttttcattgaaatgaaaatgtctcctgagaaaattaaaattattagtcattaaatctttatagtgaatcactctttaatcagaaaattgaatttctttccatcttatgcccatgtagaccatcaccccaaaaggaattctggcaggaagggataattgctttgagaacaagacataaggaccttggccagaggaggatgtaagaatgaggggcatgagatgagatggaataagacagaataagaggcatttctcttagataagcagtggatacacaaaagcatggtgaagcaagtagaaaaaggccatctactttgtcccctttatgacctaaccctgatgccactaaagtctttgatatgtgtcaccataagttgctgatgcctccaaagtaacaggattttcagttaagagatatgaatttctttctggcttggtctatcagtttctctgtttgtaaaatgcagagaataataagtgccactgacctacatggacgttaggagatttaatgaggcatgggcaaggaaatacttttaacttcttggtttagaaaaagaatatatgtaaaaagacttatctattatttaaaaagaggtagtgacagggttgatttcattctgatcatctaaaatcactatggatttcccttgaaacatcccagagaaataaacaaaatgatgaaacctctttatcttaagaagttgtcatagataaaatgaaaatttctgatttaaaataggccttatgtattcatttttttccttattgctccttctcttgagaaaaaagctgagaaaaacattttcttacatgattccttctttctgttttctctactgctccaaaatctcccctgactcaacccaacacttttattttttctgtaaaacagtagccgtagctgtcaactgatgttcatccaaggcttagaaaatttgaattagtaaataagctcagtcctggcatgaataatgaaatcaaagaaacatcatgtttaccactaactttggatgtgaagggtgggaattattatttttttccttttctatcccaatattactttcttcatccccacctctttacctctgctgtcttccccatgctggggcttcagggtgactgacaagaacttttattgtggtggccaacgagaagctcaccagacaagaacgtggggtattttgtgagcttagagtagtatttgctggaggtttccaaggtgtactcacacagatagggtttgccattctccttgtggaccaccaatgcttgtatagggcctctttgtatctccttgctttccatgttcttattatttttttttttttggctttatgttgaaaaggtagtccaaagaaacaggaaagtagattacaattaaacttgccattgatttctgggtagctctggcgagtcactatcttgcagtaaataagaataagaatccataaacttaaaaaaaaaaaaaaaaaaacatgctgaggattttggccagccaagacctcacataatatcctctgtcctcatcactcttatctgaaaagttcaaatattacaaacaaagggaaaaggtagagaaatggtgcatgaaagaagagtaggcttcatttctagggtagagaaagatccagaaaaaattgacagatgatgacctagcttggagactaagagctaactttggattaccaaactgataacaattttactttggatggttcaagtcatataaaaatatgatctttcataataggtaatctgttttactttgtattaataattgtgatgagtgggcccatttagcaagacactagcacaaatgaatattcttaatttgcatattccataatttcctcttagattacctgccaatagtcttccccatttgctaaagtagaaggactttaacataagctttctgaatgcaaagctaatagaccctaggaggagggccaagtctgtaatgggaatgttttaggcaggcccgtgattaattcattctcatttaaaaaaagaatggttttcatttaaagtactgactggcactgtggattggattgtcttattggattgctaaagcctcagctcttgcaagtaaagacaatcttcaaaggatttttatgtttgttcacttgtttgttcttcagaaagagttagtgaataaaaaggcagaaatcaatagactttttagattccattctttcattacacagaaaaaaaatccatccataagtagctttctgtcttaaatttctttggctccaatgacacagagttgtagtgatgattgcagctcttttattaagaatgctcttgaattgactgagcgtatgtctgctttagacagtttctttgtttgtttctttacatgggtagactttcaagctttcttggaaagccatattcaattttcactatgatttctttacctcagttgggtacacgatgaatgacctgatatttgagtggttaagtgatggtccagtgcaagttgctgaaggattgaccctgccccagtttattttgaaagaagagaaggaacttggctactgtacaaagcactacaacactggtaagtttcttttttttttttttttcagctgttaaacacaagtgagcgccatttgcagtttggagtatacatctcattactctaattgctgcatatttaccaggcaaatagacctatgtcgcacggacctgatttggctcaaaactccctcaacagataagattcctatactctctggaataggtcagcaaacacaagaggtaatttctccagaacatagagagaaggagagaggatttaggatcttttgctgttcctagctgaccatctgttgtcgaatgagtctgaggaaagatgtagaaaacctcattagtggtgcagaaaacataaattctggctcctttctggcatccgctcttgccattggatgcttaggtcaatttgcacccactgtcttactgccttagtgccttagtggaaaagagggacaataacacaggtctttgtaaacccagaaatagagctgttgtgttcttcagtcctggatagcaatagaagtttggatgaaagtcagctggcaggaattcagctggctctaaagtcatgtgttatcagtagtgctgacagacacatggggttggggggcaggtggtgaaggaagaacttgaggtggtagcaacaaataggcatccgttgttttctggaagattttacctgtccagaaaagttgatggtttttcttaagaaaaaccatggtgttcattcaatactatgcaagctgatcatggagagacaatcaagacatgatggtttgtccagtaactggtctaggtcccttgctgaggaaaacagtttatgcacacttgttccaacagccaacagtgatacttatgaagtaaccaaaacctgattccaaggatgttttttttctgaccaagaagaattcaaccctatatcttgtaatctgtatggactaagcaaaattaccttctggagttctaactccaagtcaattaaggagaaaaaaagtgggaaggggtaggaatatctgtctcttaaatgttagaagttttaatacctttatatgaactcctttttacaggtaaagaaacactgtacgtagttcctaggcatatgctaaatgtcctgaagcaattacccagaaggctaggaaatttttacaatgactagactatacactggcttatacaaatgtacatttttctcttgccattaataacacaatgataaatacacagttctttaaatactttgtagttttatgtaaactgtactactttggaggaaatggcttcaactattacacagtgtatgtcatgtgttacatattatatgctatatagtatatgctattaatatataatatactatatataacatattataaccccccaaaatttgaatattttatttccactggttattttctgtcagtcttgtaaattctgaagctctgtctaaaacaatcaagctgcagcaagcacagattttaaaaattaaatatgctttatggttttggtccagtgactctttagatcacacattctcacactattattatcactattattccacagtaattatttctattactggttcagttggagaagagttgaattggttacgtagggtgaacattttgtgcaatcttccaaatccatctgcagtagtctttttttttttttttttaaacaacgtgggataatggaattggaaatataaattcaggctggactttaaatgatcatttcctccttctaggaaagtttacctgcattgaggtcaagtttcatctggaacgccaaatgggatattatttgatccagatgtacatcccaagcctgcttatagtaattttgtcctgggtttccttttggataaatatggatgcagcccctgccagggtcgcactgggcatcaccacagtcttaacgatgaccacccagagttcaggctccagggcatctctgccaaaggtaagaaatcttgcttgataacagatgacatgaaagcttcccaaaggtcttgtgggctggagagttctgtgaggacagaaatgttggccaccctatgacactgtcatagatatgaatgcaataagaggacaagaagctgagtttgagagaatcagggatctgggaacatggggaaccctcaaaatcatatcatttagaggaaagggaaattagtattgagagggaagagaaatgagtagaggcagaaacatggcttagagactctaggaagcccttgagtgcttttgatctcggttgtttataagacatgaagcttgcaagaattggagtaagactgatgcaatttatgccatattttcaagtatttattggtgaaactattgcaattcatatgtttagtgaagtcatttatagtaataaaaatttgaattaggctcctggaaatcacagaagagccatatcaataaatatatgtaagaaattaatgtacaatattagggtacagcaatctgatatatgaaacattgctatgccttaatttcctttaatggctgatatgctactatttttgagtgacacagttacccagagaaggaacagtagagtcatctaaaatggtgaaaattcctagaaatgtggcatggtgacagaggagtgtgggatcgatatcagggacatatagacagtttatagcacctcaaataataatccataagtggctgtgtaatctatttttataaaaagaaggccatctgcatttgtaaatattgcttaagcaagtaatgatgaatgtcccacttttgaaatgctctagcaccccagaagtgtgcctttgtgtgcttccccatttcactgagcacactgagccattggcttcaattttccagaatatgagtttaatttaggattcagtgtacattgtctcatactggttgagcagtctctccaaaatgcatttccggaaaataatgaagatgtaattccatatttttgctggcttgagtttatgtttggttgtgctgaatttgacataatgagaaatgttagatcatgttccacattatctcccatgtccagaagataagatgacatatggaggaggtctgtggttataatagaggtgggctgaatactggagaaatatttacacaacttattaagtcccatgcctccaaagataaacattaggttttatatggtcatagagaaaggaatagaggtatctctaatacttttttatcttctagaataacaaatagtataatgtacctgtattatttttctactggaatacagatgtcagaaatactaacagcttttttaacctgtataatcaaaaatcaattttacctaatagcacttttaatccactctgtgcccctcccaaacaggttcatttgcttatttattattagtcattagctattgccatcactgcatgccatggcattaaacctcaggatgtacaaacatatattttacaatttaatagacagctaaagtactggtgacaaactgtaagcatataatgtcaaaatataagacatttagcctccaactgctcattgctgtgaaaagagtagtcatttatcttcaaaatgggagtttgagtttttataaatttgttattcattttataaagctgttatgattctgcatcaatggtcaaaactattgctaaataaatgttcactgatcagggatctttgtatgtaaaggcaatgaggaactcagataaaccaaaagagagtaaaatcaaaaatcattttacacttggctctgaactcatggtggttatccttttgccaccattaggtttatcttcctctgtgtacttttcttatgctgttattaaacatggttggctttcaactgaccatgaggaaatgtaacttatgtggatgatggtgtgaaacacatgggataaaaagtgagtcatggaaaatgaagaattggtcatacagttacttatacatgcacatgcatgtaaatactcattttaatttataaacactgcaatccctgaccagatgctccactgtggtgattgtacatttacttcagggcctcctacaatgccccgtacagagtacacatgcacattacactttaaaagtaagatgtttgttatagaaaagacagaaaacacagaaaacatgattaatgttaaccaaccattaaataactgttgttaagactttggtgtattttctttcagtcttttttccatgtgcatttatgggcaagcccatgcacatgcacacacagaaaattgaggtcaaacttttacaccatcttagatatttagagttttcttttttgcttttgtaagtatgataattataaatacatttgcataggagtgtttgtagcccactgtgttctagataacatatatatagtttttaatttttaaaaactttcaatgagaaaaaagaaggtactgagcatgtttagagtgaatgagggaagatctatgagaagatatttgatgggatatatgttctatgcaggcaacaactttgtcttgttcattctgttaacttcaacacctagaacagtatgtggcttagactagatgaccaataaattctcatcgaatggataaattaatgatcagccatgttctcccatgtgaggccatgttgaagatattaggttggtgcaaaagtaattctggcttttgtcattaacagtaatggcaaatatcgcaattacttttgtaccaacctagtagatcagacttgaagcagaatccatgggtgaaagttacacagaaaagtatttgagttttaatgtacagaagaatctcataataatattacatgtactataaaggactggaatttctctagagtatgtctccctttccaaaaattctcaagcagactttgcaaagttaagaatatatgaacaaatttacaagaaaacaaacaaccccatcaaaaaatgggcaaaggacagaacagacacttctcaaaagaagagatttatgcaaccaacagacatatgaaaaaatgcccatcatcactggtcattagagaaatgcaaatcaaaaccacaatgagataccatctcatgccagttagaatggcgatcattaaaaagtcaggaaacaacagatgctagagaggttgtggaaaaataggaatgcttttacactgttggtgggagagtaaattagttcaaccattgtggaagacagtgtgacaattcctcaaggatctagaactggaaatatcatttgacccagcgaactcattactgggcatataaccaaaggattataaatcattctatgataaagacacatgcacaggtatgtttattgcggcactattcacaataccaaagacttggaaccaacccaaatgtccgtcaatgatagactggattaagaaaatgtggtacatatacaccatggaatactatgcagccatgaaaaaggatgagttcatatcctttgcagggacatggatgaagctggaaaccatcattctcagcaaactaacacaagaatggaaaaccaaacactgcatgttctcactcacaagtgggggttgaacaatgagaatacatggacacggggaggggaacatcacacactggggcctgtcggagggtgggggggctaggggagtgatagcattaggagaaatacctagtgtagatgatgggttgatgggtgcagcaaaccaccatggcatgtgtatatctatgtaacacaactgcacgttctgcacaggtaacccagaacttaaagtataataataataaaaatatgaacaaagacatattttgaaacataggccttgatctaaatcttagagcctttacttcactcaacctctctaagtttgtttcatcatttataaaatgagaacattattatctaccccttaaaaaaattaaatgaggatgagatgaagcagtacttatataaattgtttagcccagtttttctacatcgtcggtattcatctcatcctggttatttttattcttactgttccctgtccataatgtagtagaaaagactgctccatggcatgagaggttatattagaaaatgcataaagggccttatgaatagaagatgtcctgttctttggatggctcactattcacttatagttgtactgtcaatgagattaaccaaagtttgtcatatgtatgtgtgtacaagatacaattagtcctccatatctgcaggctctgcatctgcagattcaacaaaccatggatcaaaaatatttttaaaaaacaaagaaagcaaaacaacaataaaaaaaataaccaatacagcataacaactatacaatatttgcattgtattgggtattataagtaatctagagatgatttaaagtatatgggaggatgtgcataggttatatgcaaatattactccatttcatataagggacttgagcatccacagattttcgtatttgcaaagatcctggaaccaatcccctgtggataccaagggggcaactatgtacatatgcacaaatacacgtgtgtgttttttttacagatagttgattaaatgggttcagttccagagggtctgaataagatatgagtcaatttttccccactcactaccattaaataccctcacttggctatgtcttctctgcccctggaggattctatagattctcagtactatatgctatgctattagacctggaatgtacaaacgtgtatttttcaatttaatagacagctaaagtatcagtgacaaacagatattttaggatagtctattatcagacttttaaaaaattatctagtctgaaacaaaacttcagtctcatgtacaattcaatgctcttttcttcccttgccgcatgctcaggcctgacttgtgccttgaaaatgtacagcgatgtggagcactttgtctgttccttcacagttcctcccctgtatttccaacttttttcctcactcatgttgctgacttcaccattgttgagggctgagagtaatgggaaagatggaggaaagtctcatgtgaccgaagctgtggtatactattagtgccttctctaatggcaagcccccaaatgctggatttcttgtgaggtgaacttgagttctttggagttcccagggcatccaacatactacaccatttccagatgaataatgtattctctgggtgatgtcttaccatctcctcttagctatcacctcctagcagtatatcccatacaacttcttactcctcaggtccccttccttaataagatagcccttctggttgatgtattttccagatgactcacctttggctatcttccacaccatttattaggctcactaagaacttgtgcattattgccttgctaaatgatagaaatgcaacttaaccaactgctaatctttctgctttcaccctactatcatgggtattccagctaacctactgccttcaaaattcactcaggtaagaaagatattggtgttcacattttcatataaaacccaaatactaaagacaaatgagagattctcttaagaactctgatccaggggcaacttgttggaatttcagcagcttaccaaatatatggcatatggaagagataccagtctcttttcttacaggggtgggtataaaccaccttctatccatctttaggagaacagggagaatgccacagcactgtcaacgtccacaaattccattacttcaattaatgttttcgaatgtctggttttctgtaataatacagggtgttgggtataagagtctctagacagcattttctgtcttctagaaagtactgtatctggcatgtatatgtgcagcgtctccctttagtgtaaggctttagtaaaaatgctgaggcaataagaatatcctgttcccatactgttacacatataaatatacactcttaattttagacttttatccctatgagggcaaggacttcattgctcttggaaatgttcgtgtacccacccctcagcacaacacctggttcacagtaggtgctcagtaaagagtaaatcagtgaataaatgaacagtgttgaaaatacttgtaatcaaggggtattcccagtataattcaattgatgattcatccatccatttatttattcaactaacacttattgaatgttttatctgtgccatgcattcttctaggggtcaaagataaaacacagcccctaccctcaggggcttgtaatctgctaggccagagataggcatttggaatggtgattatttaacaatgtaggataaaaagatatatgaagtaagatgcctaacctattaagtggaggagggaagaatgggtgggtgaagaagggagagaagagagggggaaggagcaaaggaagtagagagagcaggagcagatctaggaaaatgtcctgaaggaggaagcctgagctgaatctacgaggcatattaagtaggtgaagtaggaggaggtaaagggcattccaggcaatgaggaccttctactcataatatttgggctacacttttaaaataaggctttctagaaaaaaatctgggtacatttcaaacatgcttcacacattttaaacacgtttcaagtaagaaacttgtgtttattgattccaagttaatttcctatcttcctgccaaccaatactttttgtgtttttgttcttgattttttgtttttcagaagttcaatcccttctctaaatacaggaaaatcaaataccagcatgatatgtgtttcatcggtatctttccctttgaagctataaaattggtttttaaacatacatctctgccaacccccaagaagctattgtgctggcaatacttcttttaaccgtttagagcataaagcctctagtggcagactaaaggctgcatgttgtctttcccaccctcagaaaagtatgaggatgaattgaatggaagatggaagactgagacatcaggcaggctttgcacatggcaaaataagattaaacgattattttcctttactccatgtttgttatcacagctagatgatttatagccactcctaagtgtgtcttgagtcctcatttgtggctgaagcccagagactatagaagtgaaagcaaacactgggatagctagaatgacctaggtgtgcagacgactctgacaggtccagaactgtctctttgaagcaaggatccagaggcattgtctttcgccattattaactgggatggcctatttcctatataaggaaatttctccttacttttcagccatctggtcaactaagaccagctggaccatttcaagcagctgacaaacccaggacatgcttggaatttaaaacgaaagaggccatacatagttttgccacatttggtcttgctttattccccctaccagaatgcttctaactagagattgcagtaagagaactacgaaaacagtaagactgatacctgtaggagtttttaaagatttgtttggatatctgttttagctctaaaaaataaagatgattgctccttgaatcaggtatatccccagctaatttaaacgactttcccagtatttctgaaagaagttggaaacaattattttttgtacataatcaggatcttatgaagttcttggataaagattaaaaagtaagaaagccaagcaaattgatctgcaggcctgcttgctttagccagatgtctgcatatgtaggagacttcataaactttccctcccgacatttcccaagccacagcaaattgaagagtcgttgatgtagtgagtgtgtgaaaaaaatatgcaaagagatgacacgtgagaattctctggggagagagctgaagcaccattggtactttagtttaagaatgttgttggcagcctttgcagggaagctgacagtgagagaagctatccaagctaggcttttgctcaagtcctggtgaggctcgtaagcctttggggatggcatatggaaattcaggattattttgaactctttctctttccatttcactaaaatgggtaactatgggtccaaatggcttgggttcttataaacaccacacagtgaggaaaaaaatgaactattgtggagcatgcaacacagtgtcaggcactatgttataatacatgatcacattacagacaagaagaaacagaacttctgtccttaagaagacataaacataaaatagaagattataattcagtgcagtaaaggcagatttttttacaaaatggctataataatttccctccctgtgtctacacccttgggtaatagcttcctcttacattgactgtaaacttgaccatgtgacttgtcctggtcaatgggacaatggcaaatgcagcaaaactagaggcttaaaaactgcttgcatattgaagctagctctctcctgctactcttgggatgctgtgaccactactatgtgactaagaccaggctaacctattgagtgataagagacacatggcccagttatctcaaccaccaggtgaggccatgcaaacacatgagggtgtccagccactgccatgtggaacagagacgatccatcccagatgagcccagaccaaatagttgaaccaaagaatcgtgaacaaataaatagctgtcattttaagctactacatcttggggtagtttgttacacagcaaaagttatggctgctaagaaggatccttgatctagtctggaacttcctggaagaagggacatgaggaagcagcacctgaactaaatttttttgaaaatagatgaagtttttatttggacacaaattcttaccaccaccatgttttaaataaaatgactgatattaactttagtgtccttggaacaagtctataataagaatataggataagaatataagaatatcgccatttagtctggtgatgttctttctaattttgaaaccactcttaaaatttaccatttcttccaggaagctttctcaaattctttggaaaagtttcctcatagctttccataagaagaagcctcaattaggcaattgttatgtgcctacctctctttataaaatatctctcatggcccaggaaggagcaggatgctgatgataaacacaccaatttgagcactcactaacaattgggcaagtttccatttttgtacatatccttatactaaatatgctcatttcatgagacagaattatgtgtttgtatacatgcatgataatgtagtcatttatgtaaagggtattatgtttatgaattaaacatagatatagtatggtaatgtttatgtaaacggcattatgtttatgaattaaaataaacatatatatagcataataaggaatattagaaagctttcagctgatgcagtaattttctgttgctgtataataaactttgctacttaaaatacccatttattagcttgtaattctgtaagtcaaaagcctggcttagcatgactgggttctctgcccagggtcttataaggctgaaatcaaagtgtcagctgggatgaggttttctttggaggttctgaagaaaaatatgtttccaagttcatttttgttgctggcagaattcagctccttgcagcagtagagatgaggcccccgttccttgctgctggctgttagccaggggctgctcttagtttctagaggctgtacacatttctttacacgactgtacacatttcattacacgtggtgccttccattttcaagtcagaaacagcacattagttccttcgtatatttcaaatctttgacttcctctatacccagatttaaagggcttgttaattagatcggacacacctaataatctctgtgttttaaggtcaactaatttgggatcttaattatatctgtaaaacccctccataacagtctctagatcagtgtttgatggaataactagcaggattatgcacagccaggactggaactcttggggtcttgggatttagaattctccctaccacacctttgtactggaatattctttggatagtctccctgattccattttgccttctatattgtattttcaacacaacagccagaaaagtcctatttagcacctccctgttgaacatcttcccgtagctccctgttgaacatcttcccatagctccctgttgaacatcttcccatagctccccatcccactcagagcaaaagccagtgtcctcactatggtgaacaattcataatctatcccctatttcctcttgatctcatatcccactaacctaccccctagctcactgcttcaggcacactgaccttcttgctgtttcccaaatatagagggcatgtgctctgggcccctgcaatgattgttttctgtgactggaatgttctgccctcagatagccacttgactaccttctctaccttctctaaatccttattcaaatcttatcttctcagcaaagcctggtcattaccactctgacctaggctctcatcaataccctgacctgattcaactttctaattttttttttgtttccccgcagtactttattaccttatagcaacactatcatttatatcaaactctattatggattatgtttattgtatattatctgtttcccttagcttgattataagctccatgaaggcagggttctttatctggcttgctcccttcaatagcatctagctcacagtatattctcaataaatatttgttgattgaataatgaatgaacatctacatctctagagttgggtcactgagaactatccatctaacctttatctaagatatgaaaagaataaaagggaacctacctagccaggcgcccccccgtttttttttttactggttattctttaccacagagaatccggctgcatatagtatgttattctaatataataacattttataagtttcacttctctgatagtatcaagtagtgttacatttctttttctttgatatatatttcttacagagtaatctaatcaaagatataataataaaataaaatagtggtttagataagagggcatcaagacagactatttttacctcagctttgcttcctcagcactgtcacaactaatttgggggtttctcggtgtgctgacgcaagcctccattgtcccttctcgcttctccagttttttaggatgcaggcttattctctgaattctgataaaggtgtctaaagatcttctcatctggactctatacagcagctctggaccaaaggtacagccccacactcttccacaggagcccaaatgccagaaaattagcacctttttctttatctagcaagaactgagtaaggttttattttccttgatcttaaggtgtcattaaagactatctgtgcatttgaatctaaggattgctttgaacttcatctaggacttaagaggccatgaactccaatctgaaacaaactacaaactaaagcaaaccattttccatcctttatcacaaaatggggactgggactgcagtttgctttccaaaaatgactataacttaaagaaactggaatatcaaatatattccagattacacatggattggtctcataaaatcttagagttctgcgttagtagagcatggggcctcagcaatcttgttagagatgagaaaactgatgttgatgaagattaatccacttttcaagagccacttgaagtagatgtcacttcttacatgaaccccttatggtttgccattaggtgtaaatggcctctcttccttacttccacgacgctttcttgcttccatgccactttcaatcattgcattctgacatggggcttagtgatcagggcccatgtgtacttgctctaacaaactgtactataaattccttttggagaaggccatatgtttttcaactttgcatgacccgtatgacttaaacagaagagcccgtaagtagttattgtggaagtactgtaaagagacagtgttcagtggctcctgattctctgtgatcaaggtaagaattagtgttggagtttgtcttaataaggaagggtctctaaagcagggacctcaaactttgctacacattagaatcagttgaggagatttcacaggtttcccagaccctaccacaaattaaaccaaactatctgggcatagggtccagacatcagcattttttttttaaaactaaaagtttgttctgattatttgttcttttttttttaacactttaagttctagggtgcatatgcacaatgtgcaggtttgttacacatttatacatgtgccatgttggtgtgctgcacccattaactcgtcatttacattaggtatttctccgaatgctatccctccccctgtcccccagcccccgacaggccccggtgtgtgatgttccccatcctgtgtccaagtgttctcattgttcaattcccacctatgagtgagaacatgtggtgtttggttttctttccttatgatactttgctcagaatgatggtttccagcttcatccatgtccctacaaaggaaatgaactcatccttttttatggctgcatagtattccatggtgtatatgtgccacattttcttaatccaatctatcataggtagacatttgggttggttgcaagtctttgctattgtgaatagtgctgcaataaacatgtgtgcatgtgtctttatagcagcatgatttataatcctttgggtatatacccagtaatgggatggctgggtcaaatggtatttctagttctagatccttgaggaatcaccacactgtcttccacaatggctgtactagtttacagtcccaacaacagtgtaaaagtgttcctatttctccacattctctccagcacctgttgtttcctgactttttaatggtcaccattctaactggtgtgagatgtatctcattgtgcttttgatttgcatttctctgatggccagtgatgatgagcattttttcatgtgtcttttggctgcataaatgtcttcttttgagaagtgtctgttcatatccttcgcccacttgttgatggggttgtttgatttttttcttgtaaatttgtttaagttttttgtagattctgtatattagaacttagtcagatgggtagactgcaaaaattttctcccattctgtaggtttcctgttcactctgatggtagtttcttttgctgtgcagaagctctttagtttaattagatcccatttgtcaattttggcttttgttgccattgcttttggtgttttagtcatgaagaccttgcccatgcctatgtcctgaatggtattgcctaggttttcttctggggttttaggtctaacatttaagtctttaatccatcttgaattgatttttgtataaggtgtaaggaagggatccagtttcagctttctacatatggctagcaagttttctcagcaccatttattaaatagggaatcctttccccatttcttgttctcgttaggtttgtcaaagatcagatggttatagatgtgtggtattatttctgagggctctgttctgttccattggtctatatatctgttttagtaccagtaccatgctgttttggttactgtagccttgtagtatagtttgaagtcaggtagcgtgatgcctccagctttactctttttgcttaggattgtcttagcaatgcaggctcttttttggttccatatgaactttagttgtttccaattctgtgaagaaagtcattggtagcttgaaggggatggcattgaatctataaattaccttgggcagtatggccattttcacaatatcgattcttcctatccatgagcatggaatgttcttctatttgtttgtgtcctcttttatttcgttgagcagtggtttgtagttctccttgaacaggtccctcgcatccctggtaagttggattcctaggcatttcattctctttgaagcaattgtgaattggagttcactcacgattttgctctctatttgtctgttattggtgtataggaaagcttgtgatttttgcacgttgattttgtatcctgagactttgctgaagttgcttatcagcttaaggagattttgggctgagacaatggggttttctatatatacaatcatgtcatctgcaaacagggacaatttgatttcctcttttcctaattgaataccctttatttctttctcctgcctgattgccctagccagaacttccaacactatgttgaataggagtggtgagagagggcatccctgtcttgtgccagttttcaaagggaatgcttccagtttttgcccattcagtatgatattggctgtgggtttgtcataaatagctcttattattttgaaatacgtcccatcaatacctactttattgagagtttttagcatgaagggccattgaattttgtcaaaggccttttctgcatctattgagataatcatgtgtttttgtcattggttctgtttatatgctggattacatttatcgatttgcgtatgttgaaccagccttgcatcccagggatgaagcccacttgatcatggtggataagctttttgatgtgctgctggattcagtttgccagtattttattgaggatttttgcatcgatgttcatcagggatattggtctaaaattttctttttttgttgtgtctctgccaggctttggtatcaggatgatgctcgcctcataaaatgagttagagaggattccctctttttctattgattggaagagtttcagaaggaatggtaccatctcctctttgtacctctggtagaattcggctgtgaatccatctggtcctggactttttttggttagtaggctatcattgcctcgatttcagagcctgtcattggtctattcagggattcaacttcttcctggttttgtcttgggagggtgtatgtatgtgttgagtaatttatccatttcttctagattttctagtttatttgtgtagaggtgtttatagtattctctgatggtagtttgtatttctgtgggatcagtggtgatatcccctttatcattttttattgcatctatttgattcttctttcttttcttctttattattcttgctagtggtctatctgttttgttgatcttttcaaaaaaccagctcctggattcactggttttttgaaggggtattttgtgtctctatctccttcagttctgctctgatcttaagttatttcttgccttctgctagcttttgaatgtgtttgctcttgcttctctagttcttttaatggtgatgttaggttgtcaattttagatctttcctgctttctcttggggcatttagtgctataaatttccctccacacactgctttaaatgtgtcccagagattctggtacgttgtgtctttgttctcattggtttcaaaggacatctttatttctgccttcatttcattatttacccagtagtcattcagaagcaggttgctcagtttccatgtagttgtgtggttctgagtgagtttctttatcctgagttctaatttgattgcactgtggtctgagagatagtttgtaatgatttctcttcttttacatttgctgaggagtgcttacttccaactatgtggtgaattttggaataagtgtgatgtggtgctaagaagaatgtatattctgctgatttggggtggagagttctgtagatgtctattaggtctgcttggtgcagagctgagttcaagtcctggatatccttgttaactttctttctcgttgatctgtctaatgttgacagaggggtgttaaagtctcccattattgttgtatgggagtctaagtctctttgtaggtctctaaagacttgctttatgaatctttgtgctcctgtattggctgcatgtatcattaggatagttagctcttgttgaattgatccctttaccattatgtaatggccttctttgtctcttttaatatttgttggttgaaattttgttttatcagagactaggattgcaacccctgcttttttttgttttccatttgcttggtagatcttcctctatccctttattttgagcctatgtgtgtctctgcatgtgagatgggtctcctgaatacagcacactgatgggtcttgactctttatccaatttgccagtctgtgtcttttaattggcgcatttagcctatttacatttaaggttaatattgttatgtgtgaatttgatcctgtcattatgatgctagctggttattttgctcgttagttgatgcagtttcttcctagcatcgatggtctttataatttggcgtgtttttgcagtggctggtactggttgttcctttccatgtttagtgcttccttcaggagctcttgtaaggcaggcctggtggtgacaaaatctctcagcatttgcttgtctgtaaagtagattttatttctccttcacttatgaagcttagtttggctggatatgaaattctgggttgaaaattcttttctttaagaatgttgaatattgtcccccactctcttctggcttgtagagtttctgctgagagaactgccagacatcaacattttttaaagctgctcaagtgattctaatgtgtagccagggctgtgaactgtaactctaaattttactgttatgtggggaagtgttttcactatgtttactatgtgtcatttaaagttcacatcaacccaacgaagtaggtactattattatccctactttatagatgaggatactaaggcacagaagggttaaataccttgctcaaggtcatacagagctagaccttaaactagagctagatctcgaacccaggcagtctggctccaagttggtgtgtttaatcattatgccataccacttttcatagtgaacaattattgagctccttttagatgcctttcattgtgctaaacgctttacatagattatctcatgacatccatatgaggtaagtagtattttgcatcaccaatttatatgtagggaaactaaaacataaatagcttaagcagtttgtggacagttacatttgtagcaagtgaagaacccagatttaaatcagtagtcaattcaaatcctctaaaaggaagaactaagaattttaagtcccatcacattgtccatactatgctaattataggcggtagcccttatttgtgaaataagttattttctagactgtgaaatccctgtcttttggctatgcatactgaattcactgtatattacatgcagttcacatattgtttatcattttattgaagaggcaatgcttgcctgattgccctttctctttcatattaggaatactttataatggttcctgaggcttccagtatgcaccctggatttgttgacaagcacattcctcctcagcacactttctcagtttaactcagttgctgtttattgcctctatcagctgtagccattttaaccatcattttcatcaattcacagcatgtgagattatgttaagagcccaaccaggtataagacattaactgtcattcagtggcaactaaaaggttgaaggaaagcacattggatgatcattgacaataaaatggttaaaaagattgtagcctattcattcaataaaataatagatgtaaataaaaatgaaggaactgcagtcacacataacaagagatgaatctctcaaatctaatgttggggaaaagttaccaagaacaaaagaatatttgctgcataattttatgcttattcagttgaaaaagagcagggaaagttaatctatggtactcaaaccagaattatgattggatttggaaattagggaaagtagcgattgagagggaccatgaagagctaggttttcaggagcaagtaatgttctatctcttgacctgggtagtggttacatggttatgttcgttttgtggtgattcattaaactatacacttgtgatctgggtacttctcaatatttaaaaaaataagttaaaaacggattgcaacaataatgaatccaaatagagaacactcacataatttaggaagtttcctctttttccttttccagaataaaaataatacaagctgatatttattcactctatgtgccagacctgcttctaagtgctttttattcatatattatttaatcttctcaaccctataagatagatattattggtcttagataagtaaattgagtctaaactttacaactaataagtgccaaagccagaatccaaacttcactggaccctaaaccctattcctttttcactatgctgctctccttcccattttatagtgactaatatcccttcaacctttaaaatgtatgtcctccatgccagttacagcttgtacgcttaagggttgattgatgggactggagggttttggcagcctagagattctttccatatttaagttcacaattttgagtaatcacagtaaatcctccatctagttctgaattctcactggaacagtcccaccttttatctttagcttcccattgctgtttcctactcacttcctgaacaactctttcgtatggaaagggttattaagagctttctgtcattggagagaatctgaaggtaggtacaagatattaaacagaaattggcacctaataatgtttcttgccctatgtaaccctaagtaaaagagttcttaaaaaatgaattaatattttgtaattggctcatatggaagaccgtttcgttttacaatgaactttgttagttccaaaccgtatgtgtagatttctctttttgtgggactctgtagaaagtatgctggacaaatacggaaatagcattgattataggattagtctaatataatttcaacaggcaagaattaggtaatggtcatagacacagcagtccagactttcaagtatagtgagggtatcgtggtttgacagcaccaagacgtaaattcattttggggtatactaatgtccaggcatattggggattgcttgttgggccaggcataatggggattacatgaggacaaagatgattcttttactcatttatttagtttttaaaatatttacaatatattctgaattctaagacatactttttcaccttttcacatttctgagtttgggttgcgtcttaaaattgaaggcaaaatagaatttaattagagatgtttgccttagtggcatataaaataatggtgcatcttatgattgctggcatcttagatttaatgaactactatcctaagcttctagagccagccacagtgcttggcactgggcatacagaagtgagtaagacagacatgttctcagccctcagagagctcacatcccactgtagagacaaatattaagcacaaattaatagataatgcttattaagaagtaactctgtgtgtcatgagaacatgtaagaaggaaactggtgcttttccagttttcccaaggaagtgaaggctaagtgggattttaaggcttaataataggtacctatataaaggtggcagaggacaaccccagaaagggaaactggtctgtaggatttgaagttggaatgagccagtaaacttcagagaattagaaagaaagactgtgtggctggaatgtagaggacaaaaggggaaatggcaaacagggaggcacataggtcacacaggacctcatgggccctagcaggaagtttgagtttcctcattatggggatgtaacataatccaattaatttgtttaaaagggctgcactgattactgtgtagagtaagatttgagaggggatagggtggatgtagggaaactagttggggagctacagctataacaagggagaggtagcttaggcgagatactggctgtcggaatgaagataaatgaatggattcaagataaatattgaaggtagaattaatgggacatagcaattgattatatataaggaattggtggagacagaaatggggccaaagccaactactgaagacacatcataagggatgaaaaaatgaagacccataggcttgaccgaaggacaacacatcagggttggaaggaattggggctttgagtacagcctggtgtcttgtaactcaggcatgaataatagagaaggaaggctgtgaggaacagtgaaaagccttccccataaagcactgggagcacaagaagcactgatttgtagcttacttaccaattagtgtcattaggtaccgaagcatacttccccatttagggctattgttggagcacagtgtgattcagtagtgcccatctgaaccagaaaagtagtgggagagttcattgcctgtggttttcatcaacaggaaacagtaactgcagccctacctctgtgacaccaccataggttcatgaccatcagcctttggcagaaaacaccactcaggggtttttaaattgagatgtttagaccatttcgatttcctatgactgttgatatgtttaggtttaaacctaccattttgctatttgtctttcatttgtcccatttgttctttgtaaacttttcctaccttcttttggatatcgtattttttaatgcatgtagcctttgttagcctattgtccataactctttttgtgttttttaaatgctttagggtttatagtacatatattttacttatcacagtctaccttcaactaatattatatcccttctcatatagtataagagccctacaaggcaaacttctatttcttctcctccagcttttgtacaattgttgtcatatattttatttctttatatatcataaaccccacagttcatttttattatttttgtctaaacagccaattatcttttaaattattccactaatttgaaaaaatcttctgtattcaccttggtagttaccatttccaatgtacttcatttcttgggtagatacataattccatctggtatcatttttcttttacccatgggaattattttaacattttttatagtacaagtttgctggctgtaaattatttcagcttttatacgtctgaaaagtcttttatttcatgtttgttttaaaaagatatttttattggttataaaatattagatggaccttttttccccctaataagtagcttaaagatgtttctctaattgtcttcacacttgcactgtttccaatttaaaaatctgctgtcatcttatatttcttcctgtgtacataatttgtcttttttcctctggtaattttaactattttcatttttatctggttttgagcaatttaattatgatgtggctcagtgtaattttcttaatgtttcttgtgcttggagttcatcaagcttcttagatttgcagatttatagttttcatcaaatttggaaaaaatgtatccattagtttctcaaataatttttctgtacccttttctgtatcctctccttcaaagacttaaattacatgtacatcaggctatttgacattgttatacagcttactaagcatctgttctctttttggtcctttatttttcctcttagtccatttgtgctgctataacaaaataccacagactgggtaatttacacagaacagaaatgtattgctcacagttatgaaggctgcaaagttcaagatcatggcattggcaggtttgtcgtctggtgaaggtttggtctctgcttttttttttttttttttaataccttaagttctagggtacatgtgcacaacgtgtgggcggtctctgcttttaagatagtgctttgcacactgtgtcctctggaagggaggaacactgtgccctcacatggcagaatgcagaatggcaaaagaggatgaactccttccatcaagcccctttataagggcacctaattccattcatgagggtggagtcctcattactcaatcacttcccaatactgttgcactgggaattaagtttcaacataaattttggagaggacaaaacattcaaatcatagcactctgtttcattttagtttttactgtcttattttcaaattcattaaccttttcttttgcaatgtctaatttgctgttaatctcaattcagtatattttccatctcagacacagtactcatctctagaaatttgatttgggtcttttttatgtcttccatgtctcttgttaacctagtcattcttttatctagctttttgaacatatagaatgtagttatagtaggatttgatgtccttgtctgctaattctaatatctgtgtcaattctgggttggctgcaattggtttctttttctcttaatcatgtgtgttaatttcttgcttctttgtatgcctggtaactttttattagattccagacattgtggtttttatcttgttgggtggtggatatacatataattgaaactttctgggacagttacttggaacaatttgatttttttttgtcttgctcttaggattttttagataggcaagacccctttgagcactctatttaataccttatgaatgatcaacttttccagtctggcttatggaaacaagaactgagaactgcaagttctgttttctctaattcttttgaagattcttcccctagcctcagttactcttctcacatgcatgcacttatcagtactttgctgagtgctccagaggaatcctctgcagacctctggagttcacacatacatatacaccctatagacagagggagagagtgtatgtgtgtgtatatattgtcttgtgtgtgtagacatatatagacatacatatgtatatgtatatatatagacatacatatgtatatgtatatatatagacatacatatgtacgtatgtctatatagacatacatatacgtatgtctatatagacatacatatatgtatgtctatatagacatatatatctatatatacacatatacgtatatatagacatatacgtatatgtgtatatatagacatatatgtatatgtgtatatatagacatatacgtatatgtgtatatatagacatatatatgtatatgtgtatatatgtatatgtatatatgtatatacaatgtatatgaagacaatatatacaagtgtcttcattctggtactcttctctgtgaacttcagcttctgtggactcaacagaccctcagatccatcttttcaattctgggaattggttgggctctgcttagattcctcctccttgcatcatgacctagaaactttctctagacagtaaactggaacaatagtaggcctaacctcatttgtttcctacctttcagggatcactgcccttttttacttgatgtcttttgccttaaaaaccattttccaaatatattttaaccaaattttttagttgattcaggatggagggtaaatgtggtccctgttactccatcttgacgttaagtggcaatcactgccatggttttgaatccttgatttctttttaaaatttgacatggaatgtgaataaattgaatgtgacaatgtagataattgaaataattatcacaactagcattagcttgtaaatgcttagttcagttgttctaatcaatgaagactatttattaaatatatcatccatgaactctaagactgagaacaaatttttgtaaaggaattaataattggtatgtacagtaataaatattaatattctaatagaaatcagttttgttctacaaaatgtttcatcaaaaggtttgtttcaaggtaatatcgttcaacatatttaggcttataattgctgattcttaactctttttaaataatacactgtagactgctttggggggtaggggaccttattcccatccagcaacctctttctacatgtcaacgaaccatttttcttaatggttcatacttaacgccatggatgctgccactaaatcacatattcactttaatttggtttaaatcaatttaataaatattcaaggtacacatactgtattaggtattaaataggtcaaaaagataataagatagtttcttccccatgaggaatttatgatctagtacaagagtcagcaaacatcatctgcaaaggaccacatagtaaatattttaggcttgcaagccataaggtctctgtcacaattattcaactctgcagttgttacacaaagacagccatagacaacatgaaaacaaatgagcatggttatgttccaataaaaccctgatccaatggaaaaaagcagagaaacacaacatagaacaatagatatatcacaaagatgaccagaaacaagtgtcatgggatgtcaaagaagggagattcatatcttaatacttgatttgtaaatacaatgaattggctaggtgcagcacctcacgcctataatcccagcactttgggaggctgagttgggaggactgcttgaggccaagagtttgagaccagcctgagcaacatgatgagaccctgactccacaaaaaataaaaaattaactgggtgtggtggtgaacacctgtagtctcagctacttgaaaggctgaggcaggaggatagcttgagcctagttgttcaaggttatagtaagctatgcttgcaccactgcactgcagcctgagtgacagagtgagactgtatctctaaaacaacaacaacaacaacaacaaatgaatgatttaagagaggcagcaatatctaagctgatgtatttagacagaattacgaaaagcaggaatgacagggtgtattagtccattttcacactgctataataaaatacccgagactgggtaatttataaagcaaagagtttaattgactcatagttctgcgtggctggggaggcctcaggagacttaaaatcatgatggaaggggaagcaaacacatccttcttcacaaggaagcaggagagagaagtacagagcaaaaggggaacaaccccttataaaaccatatagtgcatgaaaactcacttactatcatgagaacagcatgggggaactgcccccatgatctaattaccttccacaaggtccatcacccaacacatggggattacaattcagattacaattcaagatgatattttatttttatttatttaattttttgagatggagtctcactctgtcgcccaggctggagtgcaatagtacgatcttggctcactgcaacctccgcctcactggttcaagcgattctcatgcctcagcctcccaagtagctgggattacaggcacccaccaccatgcccgactaatttttgtatttttagtagagacagggtttcaccatgttggccaggctggtctcaaacacctgacctcaagtgatccacctgcctcggcctcccaaattgctgggattacaggcgtgagccaccacacctggcctcaagatgagatttgagtgaggatatagagccagatcatatcacaggagaaaacctgaaataactaacagtgatgagtaagcactgaagattttgggaagaagtacatagttctgtttggctggtatgttgattatactaaggagtgtaatagaaaaataaggaaaatgtaaggtctttggataaaccaaggcagaaataatgtcttcctcttgtagacctgcgaagctcctgtctttggtcttttattttattctgccttatattatggttatttttgcacttctgtttgttcctctactagacaatcttcacatttagggcagtgattatatcccattcaactttgaattctcattgtttctagcacagagatagaacccagcagcagagcaaaaatattgcatggttagtaatgaaaacatccacttcaagcccaaaccatttggacttatcaaatagacattgaggtcctacagaaatggtttaaagactagcctactgacaaggaatgaaaatgttcattccttatattagcacctttatttttcaacaagggctttggttagagatctttcaactttatgtgcgttaattccctcataatgtagatttgaccatattagcagccacttgaaatacaacttctaagttgcaattctccacaatctgtttcgaggagagaatccagatggataagtactggggttttagtttttaatcaaaaggttaattaagtgaattaatctttatgtttgaatacattttgcatggaatttggagtaaataaatgggttaaaatcaaatcagtataatattaaaatgaatactaaagcttaggaaatgagttaaaagcttatgcgttctattatgtagcagcagacaaaattgtctatgtcaagtttaacctgagaagagaggaaagctgctaataaagtattctcaaatcctcctggaatcactagtatcgtcatagaaatcattttttaaaatgtataatgtttcacagacatagtttccaagcaattctttaaagaaaaacaccaagcagttagcatttaaataaatcttttgaattgcaatgagagtaaataactgcagaattataaatgagctgtcatgtccactgagaaaatgaagacagcaaaaatggaatctgaccacacacatgtggctgagggaagaagaggccgaggataatttaatgaagattttctagaagcaaatagtgccaccatccgtcatgaggatctgtttctataacgcttgtgtgtctttgagactacgtaggtggtagcttatgagtagtaatgttcttttgttagtaaatgtcaccaaataagcaaataagagaaacatgaaggccaaaaactgtgttactattcaggagaaaatggacggtttagcaacaatacaatgtagacttcaaaatatgaaaaatcaaggaaatttctgtcattgtctttaagggcctccagagaagtattaatttgttctttatgtgaatttaatgagatcatgtgaaatgtatgtctcatgttatgtctattgaaaacaattcctagggagaaattttgggtactgtatatttcctatccccaaatcatggggatcaaacattgcagtttgaattgagagcaaagagatgcttccccttgtgccctaatagaatcactgctcctggtatttcctggaccaactgagattgggtcaaatgaatatgatagggtatgtccaagaaacacaggagccaactgaatgagttcccagtgaccaaagctggaactatttaagcaacaaaataagtaaagtagtattgaattattacccacatcgtaaaacaaatatccataaggtcatactgatataaataaatgattgcataaaaataattgaggtagaaaaaacaaatctcccatgcagaattccaaataactcatatagatatattctgccctcaaggaggtagagcataactccctattacttaaatgtgggctgcccataatgacttcctcccatagggtacagtatggaaagtagaaaaaagagtaactttacagtagagaaacctgacaaatacgaccttagtcaggtgatcaaggtcagtatcaacaataagtcatattgattgtatataacctcggtatgatgtgatgagaagggcactttatctctgtggtcttccttccaaaaacatataatcccagtctaatcatgaggaacacatcagacagttcccaatggagggacatgttacaaaatacctgagtggtattcagcactgttaagttcatcaaaattaaagaaagtctgataaagtgtcacagctaaagggatcctaaggagagaatgataactaaatgtaacatggtatcctggatggaatccttgaacaacagtaagaaaaaaagttagataaaaactaagatatcagtattgatctattaggtgtgataaatgtaccacgccatagtaagatgttaacactaggggaaactaggtgtgcggtttatgaaaactgtattatctttacaactttctataaatctaaaactattctaaagtttttaaagtttattttaaaaagtgataaatatttgaaagcaactgaaatgtctcagaatctaagaatggatgtgtgcttaggcattcaaaatggactggaaggctggaaaaatctggaggaatcctctttctctgtctctgaataagagacctaatttgttctattctctctctcattcttccttgtcccttatccacaaaaggtagaaagcctggctatggacagtgccaagatattcatgttaaaaaaaatactagacacctggagaggaactgctctttcttttgacccaattccacattctcagaggaaaggatcattcactttgaggcaggagttcacttctgattcctatcatctgtgatgggggtagggtcagggaagggactctgattagcctagcttaggtcccctgatcaccctggacaaatgaattgccatcaagtgagtagagttacatgtatgtacctgacttcccagtgtatcacccctgtggatggtggggaactatgggggaggtggaatgagaaagaaaaggcgcttctcccaggatgaaaagtggtggaaaggacagaacaggttccacccaataaagctaaaggaataaaaataaagtatctaagtgagagagggagtagacttaatatgaaacataaatatttagcacttctgaaaatatgcaggtctaaaatcttctatccacacttatgaaatctcctaagctctgaaaaccaaaaggtttcccacagctcatttggcagcaaaacctgttctgaactgatgggaggctaattataggctttgcatatcccatttagtgtgaatattcatactgttttccaaagaaatattaatgtgtttgattacagggtcttccccaagccccactgggagtaaggggcatgtaatacattgtatacgtcacagtattaccttaataaaatctgaataactctgagttacagtgcataattgctcccacaggtttcatataagggatacatttataatactacacataatcacataaataaatgtccatttttatgtagctctgaaaacaagaaccacaaaaataaaaaccatacaagaaaacaaacatgctctttttttaaaccatctgaagaagtcctggatataagcaaggctaatactagtattacattttagaaataaaagaggggtacttagagaagattttactagagacagggtagggtctgagtaccaggtctcctaaccagtaatccaatgtctttgaactgccaccctgcatttcagatgaaaaagggttattgaaatggcattgttagcatgtaggtaaaagggtaacaaaacaacttaataggtggcttctttgatatttggagaagtatgaaaaggaaggtttgccaaggatttttggggagggtggtggtgggaggatggagtagagttgactatataggaatctgcacaatgtactttcaaaacctataattataacttttgccatatcttcaaaaaaacctattttcatggtatttttccttgcttttgcaactaacagctttcatgatcttctttattatttatatgaaggccaagtttcaaatattgtttctcattcaaataaacatgtggccatttactaatgaggaattttattttgttatttttacattaatggtaataatgaaatattatttttatccttccataaaccaatgatttccattacttttgggtttgaggaccttccttttaatatcaaaatatgccatgtctcctagatgaaagtaattttatgtttggtatcaacttcctgaaaatataattgcaaacacaaaaagctactatgaattcaggtacattcacaccagcacctatatgcatttgataattaggagcatataaatagaaagtataatatttattctactcacaatgtgttgtggaaatatgaattcctagaaatgtctaaatctccttgtattatagtccattcctgttttgactaatttaataaaatttactaatattaaaagccaaacagagtaaatggaatttaaaatatatatttgatatataattcaaataccataatgtgcttagaataatgcctctcacaaaagtaggcactcaataaacacttgttgagtgaatacctaaatactcaaattcttggtgaggcagtcttctacagtagataaaacatccagggttcatacttccttggatctgaatcctttgttgctggtaaatacccttgatcaagccaattattacacttgctacctcttaaggctgctgtaaggtcttacatgatatattccgtaagtaaagtctaatgtggaatattcaataaaaggtaattatctttctctctcttccttcaaattcctgctaatcttcctcaaggagtcactcaaacttccttcccaggagactcaatgggaaccacttcccagtgctgagaaatatgacactgtagaccttatccctcatgagggcagagaaccattgtgtacccagcacagcagacatcttggtatgaagcaggtgttcaatatgtatttgttgaatgaataactagaggaaaattaagaatttcccaatggaggaaatcctgtatcagacaaggaaatccttaacatttaaatagttaaattaggcaacttaacagtcttagaggaaaattccctcctgcactgcaattacttatgtttttctctattcagtgacaatgcttccctattttagtgccagtgtgggaaccccagggacaactgtcaaaaccagctcttcagttctgtgccctgtgctttctacccctcaaacactgcacatcattagcaatgctgagacttgtgttgcctttgtaaaatttctaaattctaacaaatgcctggagaccctaccaaaacaactgaaactggtgtaaacttgaggaaagtttactctcatttaaataaatccctgtttgttcacttgctttatttgttctttttactgtgaatgttttcatatagatatttaaaaactttattacttggcagaatatttgtaatgatacaaagaactgctacacagatgttaaaaatattcatagtaaaaagtttttaaatgatatatagaacaagtatatttcatatgtgaatttcacatatttggtgatccaagtagtattcccaattggaagaataccttgcaactctgttcctatgccattgcatggtttctccttctttgcattgtcacagtatagtaatgcccaacccaaaccatggcatgtggatacacattttaaattgatataatttttaatgtttgctttccttaaggatttgtgtttattttttttttaaagcaagtcttaaacttcccactactttgccaagagataggcaatatacaacaggcacttttaagaaaggaaacgtgcaatgcctcaccatgtttgcttggaagatccctaacattacgtggtaaactcatcacaaaaaaacgtaatcactcagcaaatatattgcttgtaccatgagcaaaggaatatcatgcaaatgaaaagaaaataaaaaagagctaaaatgtcctgttctatcgcaagtaaaacatttgtcagacacaaagtcttcttttcctttttctcagagtaaaacatatacattaaaatgcataaaatgcccatgtacattaaaatgccataaaatgttaagggtacaattcataaatttttatatatgtatacatttcagatcaagatatggaatatttctagtgtcctaggggtaactactgttctgacttgtttaactattgttacttttgcctcttactgaacttcatataaatggaattttgcagttcgtattctttcataactggcttctttcacaaaactcaatccctgtgggatgtatctgtgttgtttgtataactgtaattttttcccttttgttgtccgttctcctgttggtgggcatcacttccaggttttagattattatgtattaaatcttctatgaaaatttggtacatacttttgatggacatatgcacacgtttatcttgacaatatatatatatataggagtagagttgctgggctataaggtattgacatgcttgactccagtgtgtattgacagttttcccaagtggttgacacaatttacagtcccctagcaaaatatgagagttccaattgctccacatccatgtcaacactcattattgtcaggttgctacttttttcaatgtagccattcagatgacgtttagtggtagctcattgtggttttaactggcatgttcctaactactaatgataccaagaaaacaccttatcacatgctcagtagccatttagttgtcttcttttgtgaagtgcttgatccaactttttgctcattattttcttacccaagcacaagtctggatttgaactctttatccaagtactctatgttgagttctacatgattttaataaaacagtctaattaagtttttcataggtaataatttttgccttttttgaaattctctgtggtgttttcaaaagcagtggttttaaaaggaccattttttcaagagcagcattctatatggcaggaattctgtcttgcatatattatcagaagtaagataaaatcccacagtttggtggttcagatgagatatttgggttcaagccatatgaagttagttttatttgcatacctctgatacctcatctataaaatgaggataataataggacctgcctcatagtgttgaggagatcatcggaatagacctacatgaagctctttgggtgatgcctagtacattgaaagccctcattaagtttggctattggtaacattcttggggtgtcatattaggccctcattgtgtccgttaaggttagaacattatccaacacactggggaaacattcacgtgttgatctggaccactcagacataaactgggtggattgggtctgaatctccaggtctagctgtgtgaaatgaccactgaaatgattactgaagcctgttgtaaatgtactttctggtccatctggcttttcagacccaccatatgcctaatggctctgttggtatatgagttaggagggcccatgccaaattatacatattcgtgactggtaaattgttcagtctggctctgggtagaaactaaaagatttaggagggaaagagcagctccctttacaggcagcccaagacacaggagcactttaataaaatagaaacttaggttccacaagaatcatcttgtaaaatctgcagtaacactcctataaaggttatatattccagggcatccaagtggccagagaaagcaagtcaaatgtgacaggagaggaaattgcctaaataagagaacctcctctctgccagtaacttacagggggccatggggtttttctctcattaagtccatctgcctgggctgggtgcctggcagttcttctgctaatgagaatctgctcttcctaatactggaagaaataagtcttcatctctacctctttgcatgtgccagtggcatgtcagaaacaatttttctgtgcatttcaaggcacagctaagtatgattattcagtcacccagctccttggccattggatgcagaggacagagaacagcgctgactgcctgtccttcttctgctgagtcattggatttcagaagggaatcacatcctttatcaatctatgccatcaagatattagcttcccataaatgcttatgtgaaaatgtgcaatgatttgcatctggtcatgatttttttttttttacaatacatcatgttatagctatattaatttcttactattatatatccatatagcatgtaattgtttttattttgcttagtttttttcaactttctacttcctgaattttaagaaattgacacaggaattatttggctcaagggaaaaatagactttgagtccttttgcatattcttattgatcaggtatggtaggcagatttctaaaaatcccttttcccatcaagattacatgcccttttcccctagaaccagtgagctgataagatatcatgtccatgattgcatcatggtatatggtacagttgaccctaaaataggaagatcatctaggtgggccagatctaatcagactatcccctaaaaacagagatatttctggcagaagagaaagtcagagagatttgaagcataagagagattcagctgtggcttgaaaatagcggtaaccacaggagaaggaatgttggcagccttaagggattgaaagaagcccctggatgacagcgatcagggaaacaggtatgttagttgtgtaactgcaaagaactaaattctgccaataataggaataataaccttggaagaggactccaagctccaggtgaaaacacagctggttgatgcattgaattcagcattgtgagacacaaaacactcagccatgatgtgtcagacttccagcctacagaagtgagctgatacatgggtgttgctttacaccactaaatttgtggtgatatgttaggcagcaatagaaaaggaacatacctggtttcttctcattgcattcttttaaatggctgaccagtagatgataattgggtagaaaaaattaaatggcctgagaaatacccggggttagtttgggttatttgaaatcatggggttatttcactagaaagagactccaattgacaccatcatgctcataattattgcaatataattgagacaaggaagaaagaacatcaagtctgccagtgctatcataagagttcaccaggtgctgagtttgacaaccatttttccttcaaatttgaattataccaggaatgttatttgctttttgagctctccttttatatttggtgtatagagtgcttccccattcctgtaacaacataggcaaggttcagtagtgccatgacagctccatcaatgcaatgggaacatgttgacattacatgtctttgtcacaaaatccactattaaaacatacatagcctaggtgtcacaaggtgctagaaaagtggaaggtgggaagtggtgattaaaaatattaaatgatttccagaattacattacaggaaactataatatatggatccagaaatcctggaagagaaacaggatgaaaggatgggtcctgggtgtgtctaacacagagctaaaataagaaactgttgagagagaagaatacacttctctgtcccagcagctcctgggaagagatgtgtaggccttctactctggtgtggtccactcaccttgggctctgctttccatgatgtgccaccaatcttgctggattttctctacactcctgacctcctttgcccttcttctgtggccaggaacagagccctttcagttctcaggataagatttttttcagaaagatttccccataatagtgcccaaatagtgctgttttccaaagcactctcctcaacagaggtcacatctcttgctttgttggatgagtttagatagactagtgggatagtcgaatgaagaaatacagtagttttttttaggaagagggaaactgagggtcatggattttcataaatgaagggggcaatctagatatttagaaaatccctctttcagagactatgctaagctttctaaatattataatagatatattctttacagaaaaaagtgtggttttcatgacctgctacttcaaatgagataagaactatggcattctctacagccaaaatctcaaaataaaaagcccagggtgtcaaatcagggtgatttattttattatccttactcacagtgtttcttttgcctacataagattttagagaatggattttattgctttttttgttcaaattaacatgcttttaataaaactagaaggcttgttctaccaagcaataattttattccctacctaaacgagtggttctaaattatctaaagtattactctgtccttaaacattcttgctagtcaaatgctgatttgagggaaagacaaacagaagaaaataattcagttcagtatcggcttttcagtttgataaaagcaatttctttcctacttgcttatcttctacctttctagtgctgaactctagtactaatcacagcactttaacgggtgttgtaaatgctgttcacggttggatctctgaaaacataatacttaagccttcatcttcaatgtgaagaagaatttggatggtagcacgaataaaattgtggcctgcacaactttactatatggccattaatgagaaatgttggttttaaaaaactgatgtgacttccatgatccatattaatagcataggtaggtaaagatgaacagaaactccatgtttgctctgtgcatggtttgattaattgacttgggtagacaaatgatgattgtagggtggagggtatatatttccttgatttgagccacaaaccctctttacatacagatcaaagtgtctaatacatagtcttcctttccttatactagtaaaggtgagaatttagttgatgctttcatttttctcttctccattcctcatggctgcacatggttcatatttttattgggttctacttcccagtatcttcctctgggatggatcatctatttgtcaacagaaaatgagaaaattatggagaaatgacagtaaactctatgttccctcctttcctctgagctcataattagacaccgtgcccaaatatacgtgcaaatggcagagccatttttcaaagcaaaatactttgaacatagatccaaacaaaacacaactctaaattcattatctcacctctttgcaattaacctaaaggagaaaccagagcaagaacacaccacagctttcggtggagtccacctggggcttgctggacttggtgcatcattagataacttgttttcccacagagtgagatagatgtgccttgaacaataattaaagggctttcatctgttgggttaattaaaactgcccatttgtttgcctattcccatgctttgctgtcttccttgtacaatacctccattgatcctctgtgagctgagaagtatcacaaatttagtctacaaaaaattagctcttctaccttccaacctgactgcatgaatacaccattaaagcacttcctctgaaaaaagtggagacagttggacaatgctccagaagaccatgattaagtagttagggaggggaattacattatcctaagaaataaaaatagccaatttaattgcatgccaattatgtaccaagccctcttctaaaaacgatttctacatattatgttatttaatgcttaacacaaccccatatggtgaagacactgctattatacatgaagaaattaaagcctacagagattaattgtctagacttagactgcatagccagtaagtggcagggacaagatgagaacctagagatttataattctgaagccatgtgcattatggctccattctaggttcctttaattggcacaaaatactgtacttgtattgactgcttacttggtactgggcattgttttgaattctttacctgattaatattttaattaactaatttaatcaaacaacaaatgaggcagggactgttactagcccattttatagtttcataaactgaggtaagagaatctcagtaacttgctatcttcagaaaggacgtatggcagaactagaatttgaattcagaaaatcttgctccaaagactgcacttttaactgctacctctccctgtatcactaaataactaatttgaacctttcttgtgataggaagtcagcaaagtaaacttaatttgaggagccagtctcagtctcataccagtccagtggacttgaaagaggataactgggatgtgcaggtagacatacgatagagaagacttagggtgatatagtccagaggtgggagtttaacaaaggtagagagaatcaattagtggagaaaggtatgtatcccagtggcaataatttcacagctttacctagggaggcacgatcttttaattgtgttaaaaataagaagtgacagtttactctgggcttccactttcccttcttgccgtatgtgtcccaggaccttgtaaaagacagtgacaaccaccttggggcagggctttacaactgcaaaacctgattaaatcaagcaaaataggtcaacattccgccttcatattagctgtacagagcctgacacggggaagcatgaacagatgttgggcagtgcacagagggatccaaaagcatctaattaaacacagagaaaagtgcagaaggaaccaggagagttacaagctcagggctcaccttggtacagggagattcaggagccaagagccattggaagtaacaccaatgtgggtgccccagaacacatttgtcccaaacatttgtcttcagctgtggggctgacagatgcatgaatttaagctaaagactgatttcaatcatgcttataagagtttgtataacatgttaaatttacaaatgactttcccatccattgtattattaatttccagagcagccttcaaagacaggcaggagtagatctcctttacaaaggaggcaattaagggtccaagctctactaccagtgcttggcagtaccagagtcggaatccatttcttataactcccagtctgtgtatacataaggctgaacagggcaatgtggagaaagggaaaacaggagaccaatgggaccctgctaatagaggaaaacatgctacaagtcaggagaatgggtattaagagaaaaatggtgagaagctaaggaaaaacaccatttattttatttaaggtaaagatggatggatatttgtggttatgtagatgaagaagcattcacatttatgtggtcatttatctagtcagatcatgggaaggtacataaaagtggtggcttttgagatggctatgatattcttagggagaaatgaagtagagagaattccaaggtgaaagagatagcttgaatgaatgtaaaaacgtagaaattaagggcatagatgaagaaaaatgaattgtccactttaagtgttgcaatggatatgtaaaaggaaatagtgaaaaacaaagctggaaaggttggaggataatatcatagaatcctttaaatgccaggctaaatagtctgatcttaattcattaggctttgaaaagccaacattagtttacaacatggaagtaacacaatgtctgcctcatgaaattcttgtgagattttaatgagaagttgatgcaaaaatgctttgtaaaaatatttaataaattaatataattgtattcctttgtttatgtaacaagtacttattgagagtctgttatttattaggcatggtctaggcattttacataaacaaataagacttatcactatgcattgaagcttacagtctagtggggaaaatgaacatttaaataaataatcacgtactctaaggtaagtgtacatatgatattatgaaaatacagagggtttgatgaactcttcctggaagaatcacatgggaaatgatatttgaaataaatcttgaataaacatagatctaaataaagtagctaaaattattaacttctagaagaaaacagcagggaaaatctctgagacattgggttagagaaagtcttctcagatcacaaaaacacaaaccattaaaaaatgataaaatagactttattaaaattaaactaacatttaagaaaatgcaaaagcaagccatatacttggagaagatatttgtaagacacataactgaacagaacgcttatatccgaaacacaaaaaagagctcttaaaaacaatgggccaaaaaatttcaacagaccctgccaaagaaggtatacaaatggccaatttagcctaatttaacttaaatttaacaatttaatgctcaacatcattagtactaggttaatgcaaaataaaatcatgagatatcattatacacctactagaatggttaaagtttaaaagaatgattaatgttggtgagaatgtggagcaactgaaatcctcatgcacttctggtggaaatgcaaaatgtttaaaaataatgtggtagcgaattataaaattaaaaaatatggctgggcgcagtggctcatgcctgtaatcccagcactttgcaaggccgaggcgggcgaatcacaaggtcaagagatcgagaccatcctggccaacacggtgaaaccccgtctctactaaaaatacaaaaattagctgggcgtggtggcacgtgcctgtagtcccaactattcgggaggctgaggcaggagaatcgcttgaacccaggaggcggaggttgcagtgagccgagatcgcgccactgcactccagcctgatgacagagtgagactccgttttttaaaaaaaaaaaaaattaaaatatacttaccatgtaacacaatgatcctattcctaggtatttacccaagagatattaaaatatacatctacacagagacttgtatatgaatgttcagagtagtaatttttacaatattcccaaatacacaacccaaattccatcagtagtaggatgagtatgaatactgtagtgtatctatactatgaactttaagagtataaggactggtggtgatcattaaatatatgtgtacctatagaactaaaactaaattatggctataaagaagaaaacatagtagataatggctttatgttctgacaatgcagatacagtacatctagcaagaattagagatggagaagaataaactcatgaccttgtaatttaaaaaagttaggccactttaaattaattgtatttttaatgttgagagattaaaataacttttaaagtaaataaagtccaagacgcaatacatgatatttcttcctaatatttaagttttctctgacctgcctaatctgactccaaatattcctaagtcttcttccctacctctcatcaggatacatggatttttactgcttactctaaaaaacatggagtttaaaaatgttaagcagatataaaatgattttctaaaagttgatcattaaaacacttcattgttctgaattagttgacaactatgaaatgattgttcaatgcaaaaattctaggtaagccaaaaaactaccaagttacagattcatatgacaaataatattcaagcccaggtagtattgtgttgcatacattaaagcttaataggaatattttagtttctgattatcacaggactactgaactaatcatcttcaataattaataaaacattggtgcgaggaaaacaaaatctaaacacaccataattactatagggaaatctttgatgcaatattacaatatataataaataacaattttgaaagctttttaaaactgtgttttaatcacgtttgcctccattaagctgctaagttaattaaataggcaaaccaacttgagacaaggaaattgattttctacataggacactctcaacagagtagcagacataagaaaacgatcaatttttcttcatggtgtgcaaattaagttctgttcagaaaaaaaaaaacaaaatccctgtttccttgttctcttctgctcttttgttctttagtgacaggttaatcaaataaatatggcaggaagggaaaatacatctgaatattccctgtacctttcactttcgggaagtctctagtgtcagagagagcttccaaccactccttccagcctcctctctaacaaagcctgggcacccaggctttctacccattgagaaattctagcagcaatctatttaccatggaccaaaaaaaatgtaacttgtgcattgcaatttttaattataatagacagtctattcctttgtcttccctttcatcacaatttcccccatctccacacctttcccaggtgcacaagggtcttactttcatttgcatcccaaaagagaaatcaggaggatccacatttgcctgtatttataaggctagagaaagcttaactgtggcatcccaagcttgaactctctgacatgggattttattgttttaaggacttcatcaatgtccacttataatctggaataagtgaatggagggatctttgctttgatgcataaaaatcaaaagaatatccctttgtgaattctgatgctgaaaatgtgttcttgtttggagggtagaaaaggggaattttcctatgtcctttgcttattatgacattagtaaagatcgctatagtccagaacatatatgtcaacagtccaactatcatagtgtagtattcgctgtagtgtgccatctctgagataattttgtacaaacatgaatatattttttactcttttgttgaatgtgaaccacaccaagacatttatcacttgcaaaagaacttgtagggcttcatgagggaagaatttttgaatacataaaattcaagcaggagctttaaataattccagaaaactgttttcccatactttgtaattccaaagctggggataggaagcagtgtagtttttttagatgtaaatatctgagttgtgagaaatttcaaagtaaaattgatattacattattatataattattataatatacagtcatgtaccacacaatgagctttttggtcaacgatgaaccacatatacaatggcagtcccataaaagcatagtactgtatttttaccatgtgttttctatgtttaggtatgtttagatatacaaatagttaccattatgttacagttgcctacagcattcagtaaagtaacatgctgtacaagtttgtagcctaagaactataagatatgccatatagcctagatgggtagtaggctatacagtctaggtttctataagtacaatctataatgcttgcacttcaaaattgtctaacaacacattttgcagaatgtatccccattgttaggtgacatgtgattgtatatagcctaatgccatgttattatatccagatatcccccagtaaaatcagatctattatgaaataaatgtttgtgtctcaccaagatttcttgttgaaaccctaacctccaatgcgacggtatttgaagatggggccctttgggaggtaattaggttgagatgaggtcataagagcagggctctcataatggaattagtgcctttgtaagaaaagacaccagaaagcttacttgctctctttctctccctccccatatgagcacacaatgagaaagcagccattcacaagccaggaagaggaccctcaacagaacctgaccgtgctgggaccttgatcccagactttcagcttcccgaactgtaaaagaatgattttctgttgtttaacacacaagctatggtgtttaattatggcagtcagagctgacaaaggcactaacttagaacatattcaactaactttgcttagtgtgctttacctagactgtcatctagccactgctttgcttgtctgagcagaaactgagtcaggggattaccggacataagtaagggcagaaaatcatcctggtgtccttgacacagcagaataacattgtttttgttgtccctctgcatttctctccacatatataggcgtatctcattttactgaactttattgcatttcacagctattgcattttctacaaattgaagatttgtcgcaaccctgcaccaagcaagtctataagcaccccttttcccacagcatgtgctcactttttctctgtgtcatattttagtaattctcacagtatttcaaacttgttcattattgttatgtctgttatggtgatttgtgatcagtgatctttgattttactattataattttttgggggtaccaggaaccatgcccatataagatggtaacttaattgatcaatgttgtgtgtgttctcacttctctatgaaccagctgtcccccagtctctctccctctcctcaagcttccctataccctgagacacagcaatattgaaattaggccaattaataaccctacaatggtctacatgtttaagtgaaaggaagagttgcacatctctcactttaaatcaaaagctagaaatgattaagcttagtaaggaacgtaagtaaaaattcagaataggttgaaagctaggcctcttgtgccaaacagtcaagatgtgaatacaaagaaaaagttattgaaagaaattaaaagtgctactccagggaacacctaaatgaatatttaggctcactgttgagatccactgctcagaaaaaaaaaaagattcttttcaaaatattactggtcattgacaatgtacctggtcacccaagagctcttatggagaggtacaagtagattaacatttttttttaatgcctgctaatacaacatccattctgcagccaatggatcaaagagtattttcaactttcaattcttactattttttaaaaaatgaatttcataagactatagctaccatagacagtgattcttccaatggatctgggcaaagtaaattgaaaaccttctggaaaggatttaccattctagatgccattaagaacatctgtgattcatggaaggaggtcaaaatatccacattatcaggagtttggaaaaagttgattctaaccctcatggatgactttgaggggtctgagacttcagtggaggaattcactgcaggtgtggtggaaatagcaagaaaactagaattagatgtggagcctaaaggtgtgactgaattgctgcaatctcatagtaaagtctgaatagatgaggagttgatgaagaaaggaagtggtttcttaagatggagtctacatcctggtgaagatactgtgaacattgttgcaacaacaaaggatttagaatattccataaacttagttgataaagcagtggcaggagttgagaggattgaatccaattttgaaagaagttccactgtgggtaaaatgctatcaaacagcatcacatgatacagagaaatctttcgtaaaaggaagagtgaatcaacacagcaaactacatggttgtcttatttaaagaaattgccagctgggcacagtggctcatgcctgtaatcccagcgaattgggaggctaagtagggaggatcacttgaggccagaagtttgagacaagcctgggcaacatagcaagactgtgtctttacaaaaagtttgaaaataagccaggcatggtggtgtgcccctatattcctagctactggaaagactgaggcagaaggattgcttgagcccaggaagtcaaggctgcagtgaactatgatcgtaccactgcactccaccctgagtgacagaatgagaccctgtctcttaaagaaacaaaacaaaacaaaaatcactgaaattaccactgtcacccaaccttcagcaaccaccaccctaagcagtcagcagccatcaatgtcaagacaagaccacatcacaccctctaccagcaaaaagattacaactcactgaaggctcagatgattgttagtattttttagccatgaagtatttttaaattaaggtatgtacattgttttttagacataatgttattacattgtgctatgttttagacataatgctatgtctaaaattttagacatttttagacataatgctattgcatattgctattgcacacttattagactataacttttatatgcaccaaggtaccaaaaagtttgactcacttttttgcaatattcactttattgcagtggtctgaaccaaacccacaatatttctgaggtatgcctgtagttagcatgtgggcatgttttctatcactaatgcattttaattctctgaaatcagtatccacctctagtgaacttatatttaaactcagtgccctaagcatgatggatactgaaatatttttggttgaaggacatggtagcctggattttcagagtagttgtattagtccattttcacactgctgataaagacatacccaagactgggtaatttataaagaaaaagaggtttaatggactcacagttccacatggctggggaggcctcacaatcatggtagtaggtgaaaggcacatctcacatggcagcagacaagagaaagaatgagaaccaagagaaaggggtttccccttataaaactatcagatcttgtgagacttattcactaccacgagaacagtatgggggaaactgcccccatgattcaattatctcccactgggtccctcccataacatgtgggaattatgggagctacaattcaagatgagatttgagtggggacacagccaaaccatatcaacagtattccaaaatggaggagagggagagctgtttggattagaaaataataataataagccaggtgtaatatagacactgagcagagactgcttgcacatggggacttctctaaagatggaagtaagtgattacttgggtaaatcacagaatcctgaaatttcattctgcaaatatggagaagttaggtaaaaaacaaactaggtgagatggaggcaagctaggttgtttggagcatctgtggagcacagagctgggtgtctgccaaggttctctattatctttgcagtggtgggttcctgttctccccactgtaatctgggcgaggtcacctgtaacaggcttaacttcatttttgttcagccactcctgaattacttccttctgtagacttggaaaggttatggccagattatgttctccatgttaaatctctgttattcttgatgaaaataatccaaactgagggttcctgcacaaactccccatctgactctttgatgtccactgttccctagagaaatgtgaagttggctcctgcagctgcacttttggatttgttccattctcagaataggcccagaaggatgtttctacagcttggtacttattctcagctcttagaatattttcttaattgcttccctccgcatcctcccagcacttgtgagctatgcttccactgggcttcgttgcctgcatttgtacattgttggtttcccattttttccccaaatatgatgtaacctccctattaagtatggggtctttgccatgagtccatctgtgttgtaatgtggctctctgtacttatttcataactatgcaaatacttttttttctaacccaggtcacttacactctagaacctccccattcaaagtgtgatccacaaaccagcataggcataacctgggaacttactggaaatgtaggatctcagtccctgtcccagacctactgcatcacaatctgaaatttaacaagatcctcaggtgattcaggtgcatattacaatttgaaatacgctgggctacagtggtggtttttgaagctggttgtacagtagtcacatggagaacttctaaaaaaatatcaaagttgggtcccactcctagggattctaatttaattgatttgaggcagggccctaatatggatattattttcaagttttatatttgttccatatttacttcatttcacagctgaaacacactttcctagaataagcaatattaggtgaaatttgtgcccttttagctgtacatgttgtatattctgtgttagactagaagatccttgaaggccacttccacattttctatgttttgtgaatcctccaaatcatccttggtatggtgttaagtgtataatcattgttcaatgacatgttcatggttgatggggtactaaagcaggggggagatgactagcatttatgtcctggccctgtaagccatgacctctttgaccctgagcagatcacttaaacctctcagaagtcaatgtttttgttcagtcaaatgtgaatgacttctaactctagtagttattcagtcattcattcacataataaatgtgtatgaacatctgttctttaacagctactgttctaggcactgaggagatagtggtcaacagccaagacagaaaaagcctttgtcctcatagaacttataatgggagatataaataacaagcaaataaataaaaatatgaagcaggatagaggcataggtagtaataagtgctaagaagaaaaatagagcacagttaagtgttggagcgtggtaaattgttaggtgacagtggggagactttatttaactaggttatcacagaagacctttctgaagaggggacatttgagcagagacttgaatggtgtaacaggaaagctaggcaaagatctgggggcaggaaagatctttctaagcagacagcctccaataatagaagtcctgggtcagaaacaagctaatgatggtcaagcgctagacaaagagcaagggtggttgtagtagcattctttgtggatgtctctagtctatgacttaaaggatccgtatttaagtcttaaaagtatcaaagctttagagcacttatgggaaacataaatcacctgcaggcataaatgcccaatattggggcagcacaaaagtaacagaaaccaagagtgtcatcatcattggctcaacttctgtactttccaatatagtaatattttactttaggatcagcaggatcgtgagaccaaacacatacagagataatatttacttctctaggcagtgccttgagttcagcaaatttactcctgctctcttgtgtgatgtaaaggtccatttaggcactctcctgcttctgtctcttcccctttgagtgaactgctcagaaaacagggatcagcacaaagagccagccctctgggcatggtgtcctgggtgttggggcatggctctgattccaaactgtttgagtctctggttccagccaaggggctgagtggcattaattttgttgctctcttgcttcttgaaccattttgtttcagatatcatggttttatttctacagttcagctgccaaagtccatctagggtccatagatttgtgtcccaattatagaaaccttaattgcaaaatcttgaagttaaaatatcagccctcaaaggaacaatgcttgatgatgatgattggtgatgatgatgattatgagtaatgtaaccataatgggtctcctctttttcacatgtcatttgactctggcaatgcacattaaacatttataatataacaacatggacttacacaaaataactttaattctatttcatctctcttctaattaccttatatgtattatcaaattcgatcccccttctgtattaggcactgtcttcattaccaggaaactgagtcacatagacattaggcaacttgtccaaagttatacacttaaccaggcctcaaaccccagcatttctgattccaaagcttgagttcatagtcatattgcatatcttcctgagaaataaccacttattttacaaaattcggctcaagaatctactctcaatgaaactttctcttacctgcccctcatcaggtatacacactatgacaaagactatattattatcattttcagttcttattctgtgtcaagctctgtgcttggtgttgtgcttgtgtaacccttataaagttaggctgcctcctggccatgcaataaaatggttttattcaaagtcctatactgtaaaattaaatcgttttcgtctttattgcattatctttaaaaagtccagaaagataatagtattcataacacagaacaacacttctgataatctttctctccctttgtcctcatcctccctcatcataagcaatgcatgagagctgtatccaatcccacttcttccaaactctaaaaatctttcctcaaaactcattccaggtttgatttgctcctctgtctcttcctcgtttccttctttcctcctttttctttccaaatctagtttattttttctccctacagtagttttgtatcctttctagtgtaaataaatctactgtgtcttaagcttcttcacactggcagttctacacacccaatgagatgaaagctgaatcaaccaacctcatcaaacaggcagccctagcaacaaaggaaccttagaagaaaaaagaaaaggcaatggccattcatatgtttatattttccccttgtcatatatatattcttatctatcatcaccactcttaaatggctttaagtttttgccatcttaagatgaaaaattgaggatcagagacggttatctcttacccaaagtgatagggtaaatgaatacaaatccagaatatgaacctactctgagtaaataaaagcccctgagtttagccagactagttattggatgtgttgcctaatctcttcactctgccttaaaggctccagtgtcctctatagcaggggtcagtgagctatggcccatgagccaaatccagcccactacctgtttttgcaaataaagttttattggaacatagtcacactcattcatttacatacatctatggctgcttttgcactacaaaggcagagttgagtagttctgacaaaggctgtattgctctcttaacttaaaatgcttactgtatggctttttacagaaagtttgctgactccagctctagaagaccctcatagcacctcttacagttaaccagaaacaggccaattcaccaaaaatctatttgtagattatttatgacatttaccatactatatttaccaatctaacaaaaatatatttatttgaactacttataggatttaaagcaatttgtgttgggtgaaattaacagcttttgaatcattctgcaaaggtttctttgcttggttcttatgttgttttcttaattaatatgtcagtgatgctcagtttctcattgcccttgcatcctgctgagttagctggagggtttggggtagagaaaggggaccctgagtctgggggaaggcagagagaagagccattttagagcacatcctgggctgccatcaagaggagtgaacctgggagaaagaaggagaaaggccaagcacaggaagataggagaccctgcagctgggggcgagtatgacagcccagaactctggattctagctactcacaacattaatgagtgagtcctactatcacatccaatactaatttctgtcaacctacaaatagttttaaaataatttggtaatttgataaatttgttcaatatgacacgcagatcattcagtggatttatctgttgcaaattgggttctggcaaatcgttttagttaacaagttcatcaagaaatgtttatggggcatctactatgtgccaagtacccttgggatttaccagtcaaaatttaaagacctccgtaatcttcttataggttatattccatcagggggagacagataataagtaatatatacaacaaataagcaaattatatggcactttagaaagagttaagtgctgttggggggcaggaaagaatcaatagtgtaatgaagattgagactacaaatggaggaatacaattttaaatagtatggtcagggtaggcctgattgagaagataatatttgagcaaagacttgatggagtgaggagaaaggcacatagacgtctgggaaagaacattccaggcagaggaaacagtcagtgcagaaactctacggtgaaagcaacaaagaggacagtgtgtctggagtagaaagtgaagggagaattagaaaatgaggtcaaagtaattatggtggatggaccatgtaggtccttgttgaccactgaaaggattccagcttacatactaggtgaaatgtgggccatggaggtttttggacaaagaagctgcatggtatgacttaggttttaaaaaggatactgcagctgctttgttgattatagactgtgggtgaacaagggagggagcaaggataccagttaggagattattgaagttatcaaagcgagagatggagattgggaccggtggctagcagtggagagatgagaaagggtcagattttgctgcatgtacattgaagtagggccaacagaacttcctgatggattggatatgggatttaaatgaaataaagtagttaaatgttttgcgtagtaactggaatgatggagttagcgcctacttgaccatgagaaagactgcgattagaacaggttaatgtagacagctatgagacatcaaagtagagtcagtgaataggcatttgatataggagtgtggagttaatagaaggttttggctaaagatacaaatttcactgattgaaatacagctcctggcatttctttgtttcgtttactagactgtaaattatttcatggcaagagcctgtctcattcatttatctccagcccttaacatggtgccagaaacataataacactgtgttttgctgatgttcaaagatgctacatgaatgaatgaatgaatgaatgaatgaatgaacagacacatacttttatgacgctaacttacttatgcactttgagacaagaacattttcctcctgtggaaggaaaaagacttcaagttgtttcatttacctctaatggtatttagaaagcttgcatgttcaagcaggtatcatagtaaaggatcaaatatggactttgaacttggcagtgtgctatcttttccatcatttaagttgtaggaagagataatacatatattgacagtccaagttattcttgctttaagaggatgactcatattgatcaaagaagagttgtcaatttctagacaagctggatgatcagagtaactaaagtctaaagtaaaaggtcaggaatattcatccatctgagaaaaaaaaatgtatagctgacagactaagacaagagaaaaataataacttctaggaagtagataactttattatagcttaatttaaaagtagaaaatggctgggtgtggtggctgaggcctgtaatcccagcactttgggaggccaaggcaggtggattgcctgagctcaggagttcgaaaccagcctgggcaacacggcaaaaccctgtctctactaaaaatatgaacaattagctgggtgtggtggtaggcgcctgtaatcctagctactcgggaggctgaggcaggagaatcacttgaacctgggaggtggaggtttcagtgagccaagattgtgccactatactccagcctgggtgacagagtgagactctgtctcagaaaaaaaaaaaaaaaaaagtagaaaacatttgccaatatcatccacagtctaagaattaagtatatttttgcagcttactaataaatttttgaggttcataatatctcaagcctatgatgtattcaaagtagcaactctgcccaaataaatatactaatataaatatttttatcaattttaatttccagctcctatttaagaaagggaatggaatagtttggtagatagaactgatgtatcaggacaccgagatttattattttcctgaatattaccaagtttgttactataattccttctgttgagttgtgacaaatgagaataaattatacattttcagatctgttcctttgcaattcataaagcagaataaaacacacacacacacacactcttacatatacacagatacctattaataaaaattcatgatcaacaaggcagttttatttaaaggagcagatataacttgatttcagagttgcagaaagcttggctcacatttttttacattaatttcagtatatattactgcacagaaagatgagcaacactattttcttaagctaactcatttttaaaactgtaatttcagatgtgaatgatgatagaaagcagagaaattatcctgataagcattccaggctccaaacaaaatatatatgaatgttcaggctttaaaggtttaggcacacatgagttataaaaatatttatttaattttctgaacaagaatagatttacatgaatgctatatatgatttgttttaaagtcttccctgaccacatatactatgggcacagtacctaagtttgcatctctgtcaacaggcaaacaatttatatatttattaccaacacattacagttacaaagttaacttataaaaggattaaaacataggatactgaacttttctatgacagagcacggaatgtcttttcatttgttcaaatcaacttttgtgttcttgcacatttcctgttaagtttattcataaatattttattatttttctgttgctattgttatttttcattatattttgtatgaataaaagttattaatttccacatattaattttgtattttactactttactgaactctctaaatatttatactagtagtagtagatttttcagttggttctcttgagttttccagatagactgtcatatcattcacaagtagctaccatgttaccatctcctttctaatttgtatacctttagttatttttcctaagtgccttaatgtctaccttgagtacaatgttgcataataatgctaatgtaggtatccctgtcttgttcctggtactagtcataattctatatttccccattaaacatagttttggcttttgtatatatattttccctgaattagtattattaaagattttcatgaagaatttaggttgaatgttgcaaaatctgtttagcatatcagtagctgatcatataatttttgcattagattccaggcgcagatggattcatagaagacttctagtataccttgaaaaagtagatgatgctaatttgttttgtcaattccagaacctaatgtatgaaagaaaaacttctaaatcataaagcaagcataacaatcatgccaaaattactagaaaagattacacacacacacacacacacacacaaaataactgaagacaagtctcacttaggaaaatggatgtaaaaatgctatgtagcaaacaattcagctagaaatttaaaaataagttatgaccaagtacgatttatttaataatgcaacgataatttattataagaaaatctattactaaaatatttcatgttaatttatctaaggagaaaaatcatatggctaaatgctgaaaactgtagcccttgaaaaaatttttctagggaaatgggctacttagattttttaaaaatatctcctcagtttcagtaaagtatatttttctacaaaactgtccatttcatcctgattttccaatgtatatgtataagttaaagtagtctcttaagagtcttttaattttctgtgttctttcccattattgtttcttattttatatagctatattttctctctttcttgattagtctagcagtttagtttatttaaaaagctagttcttcattgtatttattattcagctaatattcttttttaactcattaactcctgcttttatctttattaattcctttattctattttcccctagtccattttgttgtttactgataaaaatattaaatctcattctgagtatgtctctagataggtcatataaattgtggtataaattgctttattactattttgtagacactgtgcaatttcagcttgtatttcttctttggttcaaggactaagaaattcatgctttccccagaaagcaaaatctttttatttcctacattttgttgttttatttttagttttatcacattatgggaaaatatttgctatattgtttttaatttttgaagtttattgagattgtctttgcagtctagtacatggttgatttttatgaatattctatgggtacttgcaaagaaggcatattctttatttacagaattcagaaaataccggttagattttccgtgttgcttatgttacttagatcttccatttgatctcccttcagctgtcagcttactagagatttccatagatattttctcaaacttgcacaacctgaggccagatgatctccttttctctgcttttctagcacctgtacttcctgctactttaacaattcttgcattgcattataatttacttgtccatacattcaaggtccttgaaaacaggacctgacagctgttagcacatagaatgacctcaaaatcatttgttgaatgaatggatgagtattttataactttctcccatttagaatttctctttaaagagaaggctggaggggaggggtcagggaaggagacactgggaagaaaatattatagatacattggaggtgtccggcaaatggaaaatcttccaaacaagttctataattctcagtcagacactggcagcctaacacattggtactcagatatggatcagtagcacgccatcagcccaactgcaacaggaaaaatggcaaatgggccagtgttcatcaccagcattacctatttccctaattttgtaccctgcctctgaagacaccactaatctcatattattattctggcttcaatgtttagaaacttcctcagtccttttctcccttttgcaatgaaaattccaattaggccagtctcagttgagtattggttttattaaagtaacttgcaaggagttgtgactgactctatcaacttaatttttcagggcatattttctttgccaaatgggagcctgctaatctaaatacatcttctgaatagctcttccactttcatgcctaatcatactttgtgaatgcatggaatcagcatagtttattggaggcggccatatacaatcttgccctttccctttcgtttcctcatctgaaaaatgataaattccattagctgatttagaaagttgtctcagctctgaagttctggcatttagcctttgtaaattattttaaataaccccaatcaccattggagaattgctgagggtaagcaaggcaaatattgaattcataataaatcctcaaacggcagatggcatggtggaggggatgtatagtcagtctttgaccatccacagcactgaggtatggcacaaatcatcttaacagtggataatacagaaataggttatcaatgatcaaagacaaagaatggagaaaggcctaagagatcatctggtccatgtcctttccatagacataaatcccctgggaaaaggtagtgtaggttaatcaaatattcttattaattgctaggtgcaagataccaggaaaactaatgctgaaagaattagagtaaaataaaagatattccaagtggtaaaactagaatgagtatgtgatgtcacagtggaaataaagctggaccaagaatctagctccaggcttggtttttctcttaactggttctttgagattgggaaaatctctcaagctctctgacctcagtatttgcacaagtattgtatgtagagatagaatgagttatatattaactttttgaaaaattagtttatcctacacaaaatacataataattgttcacagtgacaatgtgcttcatgtgagagaaaatcaggcaaaatgatacaaacttggtattttcataatgttactcattaatgaaaagccttcattatcaccactatgagtcataacactggataaagctcaacaaatgtttatggtaaaaatcaaattcaattatgcattataaaagcataaatggatctctagcatttgagagactatacagttgatatacagtttatccaaaattccatggaaataattttgcctggctttctgaaaattaataattaatagttttagatgtaaaggtaaaactgagctgtttcaaaccaaacagtaattttaaagcaagaattgtagcaggaaagttagcccctctctgatagcattgatgtcaagaaacagcagttttcccatatctcttaagtgctactatccaggaagaagtcacacaagaatgactcccacgtttaactttaatgaagatcctaaattggatgaaactattaattaatctaactaatttgcagcactcagggcattgattctaatggccggatagaagtataaaaggtaattccaccatgatgatgagagttaacatgtttgagcatttacaaggtaccaggcccagttctaaagcactacctacttgttatttcacagatatctcaatacttacagcaaacctattaggtgggctccattattatcctcatttttcagctgagaaaactgaagcacagagtcattaagtattgtgtccaaactgtacagctaggaagaggcaagacaggatttagaccctcaaagtccaatactagtgcttacagggtttatcaccactctaactcagcactgatagagtgcaagtcaatcatctattctcttgtatttatttacctctgtaaaacagattacacaagggcaggaaccaaatgttaatcatctttgtatacttctcagcatttcacacacaaggaacagtctacggtgatttgttgacttattgctgaaaatatgcaattcattttggggccccatatctgtgtatacaatgacaagtggaaattgagatgagaatttatttaagtgattccgtaataaacccttacaattaaatgttttaagatatgaattatccagttttactttttatgatcattaaaattagagaaaatttgttgattcagactatattaggtaatgattagcttgaattaaaatataggattaaagcagtaattcataatactttttttctataaagagataaatagataacattttaggctttctgggcttaaagttctctgttgcagctactcaactctaccatggtaagtgggcactagagagccatagagaatatgtaaatgaatgggtatggctttgttctaattaaactgtatttgcaaaagcaagtagcagaacagatttaactgatggacagtagtttgatgactcctggacttcagcttaggtaaactgattttgaatagctacttttatacatgttcaagcatggagcctacttgaatggatagattaaaaatgaatatattatggtttttcttctcttatactgattaattatcctcccagataccttgcttattatttttaaactgaacttttctctttaaatagtaaagaaaaaaaaatcaaatttttccaaattctggattcatgaggcccaaaataagcaacttatctcccttttctcatcttttttatctatctatatttctttctctctcctccacaacaaagataacatatattaactgtcaattgctgcataacaaatttctgccagattttagtggcttaaacaatattttaatcttacagtttttatgagcatttttatcttgtagtttctatgggttaggaatccaggcacaactcagctggaacctctctttcagagtctcccacaaggctgaaatctcacatgatttcatagccaaggctgtagtctcacatgaaggctcaactagagaaggatctacttccaaagctcactcatatagttgttggcaagattcagttcctcctgtgctgtcagactgaggcctcagctcttcactggctattggctgaatgctaccctcagttccttgctaggtagccctctccacaaaggcaacatgagaagagccagcaagagagtgccagcacgaaagaaagtgcaagcaagatggaaggcagtcttttataacctaattgtggaagtaacatcccatcaattttgacacattgtatttgttagaaacaagtcagtaggtcagcccatagtcaaggggagcagattatccaagcacatgaataccaagagacacgaatcattggggcccattttagaaggctgcctaccacacactattttaataaaactaactctgcattggtcttttagtgtaatgctgtttgtattagtccgttttcacactgctgacaaagacatactgaagactgggcaatttacaaaagaaagaggtttaattgacttacagttccatgtggcaggggaggcttcacagccatggcagaagatgaaaggcacgtctcacatggcagcagacaagagaagagagcttgtgcagggagacttccatttttaaaatcatcacatgtcgtgagacttatttactatcatgagaatagcacgggaaagacctgcccccatgattcaattacctcccactgggtcccttccacaacacgtggaaattcaagatgaaatttttggtggggagacagccaaaccatatcattctgcccctagcccctctaaatctcatgtcctcacatttcaaaaccaatcatgccttcccaacagtcccccaaagtcttaactcatttcaccattaactcaaaagtccacagtccaaagtctcatctgagacaaggcaagttccttccacctatgagcctgtaaaatcaaaaacaagttagttacttcctagatacaatcgggatacaggcattgggcaaatacagccattccaaatgggaaaaattggtcaaaacaaaggggctacaggccccatgcaagtccaaaattcagcagggcagtcaaatcttaaagccccaaaatgatctcctttgactccatgtctcacatccaggtgactctgatgcaagagatgggttcccatggtctcaggcagctctgcccctgtggatttgcaaggtacagcctccctcctggctattttcacaggctggcattgaatgtctgcagcttttccaggtgtacagtacaagctgtcagtggagctatcattctggggtcggaaggacggtggccctcttctcacaggtgcactaggtggtgtctcagtagggactctgtgtgggggctcccaacccacatttcacttcttcactgccctagcagaggttctccatgagaacatcaaccctacagcaaacttctgcttgggcatccaggtgtttctatacctcttctgaaatctaggttcccaaacctcagttcttgacttttgtacactcacaggttcaacaccacgtggaagctgccaaggcttgaggcttgcaccctctgaagccacagcctgagctctatgttggcccctttcagccacagctggaatggctgggatgcaggtcaccaagtcccaaggctgcatgctgcaaacagcacagggaccccaggcccaacccatgaaaccacattttcctcctaggcctctgggcctgtgatgggaggggctgctgcaaaggtctccaacatgccctggagacattttcttcattgtcttggtgattaatatttggcccctcgacttatgcagatttctgcagacagcttgaatttctcctcagaaaatgggatttacttttctattgcattgtcaggctgcaaattttccaaacttttatgctgtttcccttttgaaactgaatgcctttaaccacaccgaagtcacctcttgaatgctttgctgcttagaaatttcttctacaagataccctaaatcatctctctcaagttcaaagttccacaaatctctaggccaggggcaaaatgcctccagtctctttgctaaaacataataagagtcacctttgctctggttcccaacaagtttcttatctccacctgagatcacctcagcctggaccttattgttcatatcactatcggcatttttgtcaaagccattcaacaagtctctaggaagttccaaactttcctatattttcctgtcttctgagccctccaaactgttccaacctctgcctgttacccagttgcaaagtcacttccatatttttggctatcttttcagcaataccccactctattgtaccagtttactgtattagtttgttttcacactgctgataaagacatatctaagactgggcaatttagaaaagaaagaggtttaatggacttatagtcccacgtggctggggaggcctcacaatcatggtggaaggcaaggagaagcaagtcacatcttatgtggacggcagcaggcaaaagagagcttgtgcagagaaactctcatttttaaaaccaccagatctcgcgagacttattcactatcatgacaacagcacgggaaagacctgcccccatgattcaattacctcccaccaggtccctcccataacacatggaaatttaagataagatttgggtggggacacagccaaaccatatcactgttaaaacctttaactaactgatgtcctgtcaacaggagtaatttgtactttcgtaatatccacatccttataggctcaaaatgtaactgtgactctgtcctcctaaggagctcagggtgggacagattatttatataacatttctgcaaataaggtgctctcattatctgaccccaggagagttggcatatgctgaatgattctcgcacagtattagacaggaaatactagtttctgtttcagctccattattctaattttataaatttaaaactagctgtgcagagcaaaaagggaagtgataggtgttaaatcatatgggcaatataggtcctaaattgatttggtacttactgcttgaagaatgttttttgattcatgtcaacactccattcttactggtgatgggcaagccagccaggcataggatatttgctagtaagaaaaaaattttcaggatgtgtttctttgctatcctggttctaaatggcaatgatgtggcaggcatcatttttgtgataggctctcctgatctaatttggggtttgagtcatttgtttcagtaaactgcagaccctgtgacaagcatttggatgcagtttatttgaaagatggtgacaagaaagacaagagagaatgtggaatgtaaatagtgaaaagagaaaaggcaaacaagtgtattattgagttggttaccatgagggacaactagtgttcaattatgctagggatcctccaaaaactgtgtagaattctcttcagattgccccaacaagtaccaggaaatccagggtctttatccaccaacccccatccttccatggttgaggactgcccctggtagtgttctaggcttccttgcatgcatgtcaagaaagtttccaaggtaccagagaaatctcttaggcagaaaagcagagcttggggtgagttgctgagggtttatgtgagaattgtccattgaatctgcaagtaaactcagtgtatctgctatgcacatagtattgcacatgcaattgtttttcctgaattagtactatttgcttctaagcaaggaattcactattttaggcaagtcttgcctggcacatagaggcattcaatgaatagacattatcagatgatactgaaagtgctaagaatgcagagtagagggcctgaaggctgttactgggactcacagctctgatcaccttgacattgggaacccatactgctattgatgtggtttcctctctcatcactttttatttcccttgagtcacagaatcttagaatagcagaacccttgaaaattatcagcccgatccttttatatcccaagtgggagtgtgagaccccaaatcgtgagataatgtgcccaaatttgcaatgtgagccagtggcaaagctgaggtccacatttttggcatcttctcatggctctctctaacacagccttgctgctttctcttactttagatagtcatactggattgatttccgccaaggggctgagattgatctaaactttctgaagcagatgtatgcaactgatatgttagaaactgaggcactcaatgagcccaaccaaaatattttcacacttacactttatcttttaagcattctgtacacttccatattgaaaaataataatgctatctgatggcatggccttttatttcttcaaagagcttacacatctacttatgtcattttactcaagaggcagtaggatttctttttaatcattacagactcctgtaggctagtatctattgcaaataggtatttaactattaatgggtgatttgtgcttctggtttttttgttaaagagaaaggaatggagctgacttgtatcaaaatgctgctcaactataggaagtggatacagtagagacataatctttggtaatttataactaacaaaaagtgagatcaacagcccagccagaagcttttgaaccacattaattacaaacctttgactgacctgtagctccttttcttgttttctcctccccacatggaacctggagcgtggtggatgcctggaatttttccatttcagtttcactttgaatagtatgaaacagtaggtagctgattaacttcaagagctttaggttagaacacactaggcttgagcgcccagagtgccatgccaagaagggaaggtgtctggcaagttggctcctatcgagacatccttgatgatctgcagcctccactgtgagctcacattaaagtacagagctgacactaaatcagtccacaagccagagtctgggtcggaaagcttctcggctaccactgactctaccattcaattgaaattcatatttcacactatactctcatatattaaatactctatggccctccactaaaggaatccctgttctcatccccaggatgtagcatcacagtgctcagagggttcaggtgcattggtggagaagttcagcaccagaaggggcctctttgtatcctggagttatcacaagattctaggtattctgaggaaatgatttctccatcactgcaacttgaactgggcttctaagactgcctctattttgtactccagaatcacccattccctacatatcttacccactgttcatctcaggagtacatcatccataattgttatgagatgatgacgcatctgcacatagtcacttaacacaggtacacccactcactctggtaaggttctgagtttgagaaatggtcaggggtgaaaggtttggccactgcttccttcctgatttggctcctcatcccactataggaggcataggcaacttggaaatcataaaccaacaagctcagtccagggagtggagacctgtcagctcttccatattcctctacccatcactataaaccttacccaccattccaaggcctttccaaataacagttattaaacttccctcttttatttccttgcttgtaagtatgaattttgaacctgggttagggtagggagtaaatgcacaaatagtatacaagtagtcgaggcactaattgctgactgagaaaacaaatgaagattgcggttatctgccatctatgaacacttatcttcacagtatgtccatggctgcaggtgtgacagtgctactgttgtttcttgcttgccagtcccactgcatgtaccttctcacctcttttccacatcagatgttgtcatctggtgtaagcacagtctgtgagtaattcttctgactcatcgccagagagggaggttcccacaggggtcagtgaggcagaaaagcacagaatttggagtcaagccagatttaatgcaaatcgcagctcaactattcttttgctgtgtgatcttggtaaagttaatgagtgaactcagcttccttatccttataatggagataactcatagaatggtggtggtgtaagctttttgttgatgatagtggtggtggtgattttgttctgttttctttttgtaacagcatatatcagtccccatgatatacaggagtgctcactgcaatgaagttccatttatgtgaacttagattatgtgaatttaaagcaaagcaatataaaaatactaacaaagtcttagtccatgcacaaaacatcaaatacaagatattttactttacattattcctgtggggaaaactgccttgaattatgcaagttttgaattatgcagtgtcttcaggggctcatcccttacaagccaatgtgtctgagaatctacaatctgccaaatgagtgttaagttttatataaagtatcttattcaatccttcaatgaccccatgaaactggaatgtgtgggcccctactttgatatgaagaaatcaagattcaaaaaggttaagtaatttttccaaattcattggtcattcacctaggattcaaatccaagttggtctagcttcaaaaatattcattatttttccttttttttctttcttccatatcttcatagtctcccagtttttctcttctctttctttctccttttctctctctctctcccatgcacacacacacaaacacacacactctctgactacacaaacatttattaagtgaagcatcatctcatcatctccccaaagcccattgttgtctttccaatactgagatcacccaattgggtcttttcttcattgagattgtttttccaccagtgggcaatttgttccgaatccccacttcccccttattcctgcccttgttagataataaacatacatcacttgttttgtcactgaaggtgcaggcacaggaagtagactatggcaggaatcaatgtgcttgtctatcagccaaaaatgtagtgacgtggcagacataagcacagggaagaagatgctgcattgccctacttcctccagatgctaacccctccttcaccttgactctctcagatgcctacatttgcaggaggctgagacttagaggtgcctttctgcagagtgtccctatggtgcctctaacaatggatatcacctggtgttgcttgtgtattctagggctggcagttttactcttcttgtacctctccactcatgaaactcacacggatagtaagttttggcaagctactttaaacaattttctgaccaccataatggagagaaatgtattcatctttggaaagaatatcaactcactaggcctgtgtaccgtccaatgcccaacaaactaattggtccccaaaggtccatttataattgggtggttcctgcagataccaggcttggaggcattgccactcagtgtctgtttctgcaaacagcactttaataagtaactctttactcaactactcagtatagaactcaacaatattagatatggagagaaaatggggtgagggtggtgacactgggatgggccaggtagtcagtgctgtcatcatccatctctgccaaggaaatctgatttccccagcattaaatggcaggtgtgagctccttaattaggcaataaaaatggcaacttggcagtgaaactataaacatgaaattgtacagcaccatgaatctttggcaccaggattaacttgactatatttttttctcgtgatacagttactgaatataggtaagagatcaaacagaaaaagcaaagccagaattctcattcccacctctgttaattactagctatataaagtttagatatgcatttaataaactaatttccccccaaaatgggaatggaaagcatgatggtatactttatagcactcaataaaagataagttgattggagttaccaaagccttctattttatgtaacagaaacacatctcaggctactgtggccaacagttatctctcatttcaacagctgcattaatcaaggttaattacatattttccacatataaattagataaaatgaaattgtactgtacagaaaactattctgctttaccaatagttttcaggcatagtttgagaataattaaacatttttatttgtataaatgtaagtggcacaagtgcaattttgttacatggatatattgtggagaataattaaacattgactcaagcaggtggatatgaggaatcattccacttaaagaaggaatatctgaatattttgagattgccctatgaatttcattttgtttcttttctattacaaaacaacacttgatcatagtcatttgtgattttttctccactgtagtgaactgctctctgtacacattcattagcaatcctccttgattagctgctggaggaatgtcgcagttctctggggtcagcctaggggctgggaatgtgaatatactttagttggcacattatcacatggaagtgccttgcccatgaggaatggagagggtatccaagctgtaaggacattcaagtaatccttgtacaatggtgactcattcttctgtcctggggataaacatcatgtagaaaatgtcccaaccaataacatcaactggcttcatggcacaggaaacagtacagtgtctgaacacagacaaaacaaattgtggggctaaagtaaataaattcatgacttgattttctactttgaaactgaactaatgatgtaattcatgaaaaaaattgactcaataaaacttgccaaagttttcaaaaatgccaagacagtattaaaaagaatattaatgggaaacacctctaagaaatgtctatacaatgcgaaacaactgagcaactaaccaaattccaccatctcacttatctgttcaaacaacagataaatgcttatctagcaccatgaaactctaaaccacttgactggttctactttcccgccagatatatttgcaaactacataagttataaagtcatctaaataataagtattctcctttccgttaatgaaaataaatccagagtaatttggatatcaacaactatcatctctaaaagaccaaaactacatttttcttctttttagttgtcttttttttttgtagcttaccctttatataaagcaataattgtgaaaggaatttgaatttatatagcacttggaaaatttgacagtcaacaaaaacttacagggacacttactatatgcacaaaaacttgtccttggtggcatggatacagaagacattactggatctatattcccccaagtatcctatactttagttgggtggataaaacacatatgcatgaagcgaagactaaactggatgattctatctttaagtgcgttacaaattctaaagatgggcaagacgaccgtgggctagaataggcaaagaaattatcaccttggggatggaatttggtctactccttgaagaattatctggaaataaacagatataaaatgtgggaaatgtttctatgctgggagaagagtgtagaccagggtttttccaccttataacactattaacatttgggactgggtaattatttgtcataaagagctgtcctttgcattgttgggtatttaacagcatccctggcctcaacccactagaaaccagagcaactctttacttcccagatggaacaaccaaaaacatcttctggcactgctgaatgttcttcagagcaacatcacttctggttgagaaccactggactggatatagttacctcggttttttgtttgtttgtttttgtttttgctttctctctctcagggttttccaacctcagaattattagcatttcgactggataagtctttgttttggatgctgtcctgtgcataataggatgtttagaagcatccgtgacctcaactaccagatgccaatagcactgctccctggttgtgacaatcaaaaatatctccagacgttgccaaatgtcccctggagtgaaaagtcaacctcatttaggaactactggtgtagacaaagtcatcagtgggaatggatttggcttactcagggctaagcaaaattgtttaaacaaaacaccaagcttgtgttatgaaagagtgcaataagattgattaactagggtagacacatgctgtgcgaggccttgaataccagagactgcaataggcagccacagtaattcctaagcagatgtgtttcaaaatgaaattggtgttttaaatttaatttcacagaagcaaaagactaggtgccatggggaagaactgaatgcagggggactggttaggaagttgttataataaccaggcattaggtgttgatggataggattaaagtgacatctttggaatggagagagtaaagagtaaacccaggattgctttacagagagaaatgttgagtctgtgcaatagattgagtattagagatgaagacaatggagggggaaacagtggtaaaaccaggttgctagtgagaagaaagatttaaatgagatgaataagaaggaggtggcatttaatatgtttaattttgcaaatactaactagctattttagtattatcacagaatgctgctgtgaggtcagggctgagggaataatttgagagctttggaaacacaaaaccttcatatcctcaatgaatttatccactcctatagctttcttcttattcctgtagcttgacaaaataaaaatttccttctcactcacattaaactctactatggggttggtggccctaggtcttttggggatccagccttcttccatcttacggcactgccatcttaaaccggtgacatctaaggtggctgcagaaggtatagtcttaagggcctcatggaagattttagcggtcctaacatgtgtaacttctgcctacattccatggaggatccaaaagaagtggcaaatccagcttactggtagaggaaatgaaatttagaagaatatagccagtctctgttatagcgctcaacatacacaccaccaccaccaccaccaccaccaccctgacacacagaaataagaagaaagctataggagtggattaattcattgaggatatgaagatagagtgaaaactgaggaggagagttcaagaaatggaaataccaaatggaataagatgtcccaaagagagtaaggaagatcagatgattcagagatgttggagagcctagaagagaaccaacctatatagaggtgaaagtgccaagaagacggaaggtaaatttccataaggaggataatgtctactttgctaagactcttgctttcatcagaggcaaagagcatcatgatgattgttaaaaaaaaaaagaaaagaaaaagacaccttatacatctatactccacctcaaaaccatcattagcttatctttacaaatttttgaaaccccaaacctatcagcttggctttcaatgccttcttttgccagcccagcctaactgtccacccctcaccgttaactcccaggtgcccagcatatcccggtcactgggttgctcattattcgcaagaccaccatactctctcccatctttacagctttgattttacagcttcttctacccaccaaagacctggctctcctcaagcctaaaacaagtgctacaccacctaggaataaagcctttactgatttttccatcgatattaacctccccgtattctaccgactttttgtccttcctttactttgtcatgtggaaccatctactttatatcacttatatgttcatgtgactgtttccctcagtagaccatgggattcttaagtggtgaagcagggccactaagatgtacaaccccaagaaaaacaagataacactaaagtctaggtcagaggctggaaaatgttttctgtaaagagccatatggtattttaggctttgtggccatttggtttctgtcacaactactcaactgtaccattttagttcaaaagtatccacagacaatatgtaaatgaatgaatatggctgtcttcaaataaaactttatttataaaacaggcagtggactgaatttgatccatggactataatatgctgctccatgatctatgtgaatgatactttctagagcacagcatgagtggggtcccctgaaatataatctgggaagtcctggggagaattaatatacttcttagtcatctttgtatcttttaccccatttcccaccagcacctagtagagccttcaatgtagtatgctctcaatgtttgtttttgtttttctgaattaaatatgctatgcctgaaaagataccaacttagttaatcataacagcactttgagaacttcattaccttttaaaactatcttgcaagtttgtagtaaagtagttcaagaaggaatcttgtaagcccaagaatcataaaaataatgtaacaggggaagatgtgagctcaaaacatctaaggattagcagctgaaagaagagaatctgacatcagagctgggtaaaagcaacaaaaaggcatttcagttctgagaaaccagcaccaaggaacatcacatcatatgtgatagatgtctcacaacaccctctaaatccatgtgaataatgcatttaatgccagcacttcaatgctggaaagatgttcatgatttggaggaaactcagagagcaaccaaaatgattaagagactgaaaggactcatttgtgagcagctgaaaaagaagccaaatatgagcttggtctgctgattgctagaagatggggaaaaggtgtataaattactgaatgctgtaaacaccaggaagaggaggaatgatggtcagctctactggacttagctcttggtaggcacatatctcgggcattaacacattcctctcattattgggtcttaaaacatttatgggccatgtgaataatatataactggaaatgctgtgattggtaatgttctattattacaggaaaatagtataacttaattatactttaagttctaggttaaaggtgcacaacgtgcgggtttgttacatatgtatacatgtgccatgttggtgttccagaagagcaaatacaagacaaactattaaggaagcaaatgttccaggaatgttaggcgagctaagagaataaaaactcactaatagtacactcttagaagtatcaaatatatacaatcgtgggtaacagtatatcattcataactgtttaaattaaagcacaaagatgcaaaaatagctagatatttccttcctttccttccttgctttcttccttccttccttctttcattcaattcattcattcattcaaccatcagtccatccatcatagatccatccaccatgtatttatccaccaatccatctatccatcccacataactactgcctatgcactatttgctaggtcctgtgctggtgatacaaagtaatactgcacagggcctaaactaaaaacgaaaacaaaaaaataaacctacagtctaagagtagggtcagggaatactttaaaatataactggccgggcacagtggctcacgcctgtaattccagcactttaggaggctgagatgggcaaatcatttgaggtcagcagtttgagaccagcctgggcaacatggtgaaaccctgtctctactaaaaaatacaaaagttagccaggtgtggtggcacgtgcctgtaatcccagttactcggcaggctgaggcaggagaatcatttgatcctgggaggcagaggctgcagtgagccgagatcgcgccactgcactccagcctgggcaacagtgcgagacaccatctcaaaaaaaaaaaaaaaaaaaatatatatatatatatatatgtatatatatgtgtgtgtgtctatatatgtatatttatgtgtgtatatatgtatttatatatgtatgtgtgtgtgtgtgtgtatatatataaatatatataaaattgtaagttgagtgagatgagggacatcttccatgtaaaaagtgggctaagaaggaacagataagttcaatagagagtgataagggaacaaagaaacatggcccctaactcagatgagagaaaggggaaaggtcgggatattcccaggggaattgatatcttggctaagtcctaaagaattctgaggcatctattaatcagaaggagtgggaataaccatcccaggtaggaagaataatatgtttaaaagactggagataaagtgctagatcattttatcacaacacatgtggaactgatacaagtacttcagattgttttagacaaatagtgtaaggcaggtggtgatcttaaaaataataattagaatatattatgattgtgggtgagttttatgttccttattaatttttgtctcttccaaaatttatccattaacaaaatcacacccttctatggccaaataattgcaaacatttataaggacttattctgtgtttgaaactattttaaaatctttttttttttaattatactttaagttctagggtacatgtgcacaacgtgcaggtttgttacatatgtatacatgtgccatgttggtgtgctgcacccgataactcatcatttacattacgtatatctcctaatgctttcctttccccctccccccaccccacgacaggccccggtgtgtgatgttccccttcctgtgtccaagtgttctcattgttcaattctcacctatgagtgagaatatgcggtgtttggttttttgtccttgcaacagtttgctgagaatgatggtttccagcttcatgcatgtccctacaaaggacatgaactcatccttttttatggctgcatagtattccatggtgtatatatgccacattttcttaatccagtctatcattgatggacatttgagttggttccaagtctttgctattgtgaatagtgccgcaataaacatacgtgtgcatgtgtctttatagaagcatgatttataatcctttgggtatatacccagtaatggggtggctgggtcaaatggtatttctagttctaaatccttgaggaatcgccacactgtcttccacaatggttgaactaatttacagtctcaccagcagtgtaaaagtgttcctatttctccacatcctctccagcacctgttgtttcctgactttttaatgatggccattctaactggtgtgagatggtatctcattgtgcttttgatttgcatttttctgatggccagtgatgatgagcagtttttcatgtgtctgttggctgcataaatgtcttcttttgagaagtgtctgttcatgtcctttgcccatttgttgatggggttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctaatggtattgcctaggtttccttctagggtctttatggttttaggtctaacatttaagtctttaatccatcttgaattgatttttgtataaggtgtaaggaagggatccagtttcagctttctacatatggctagccaattttcccagcaccatttattaaatagggaatcctatttaatgcagtgcaccagcatggcacatgtatacatatgtaactaacctgcacattgtgcacatgtaccctaaaacttaaagtataataataaaaaaaaaagcagaatcagtagggccatggagaattcttagctaagaattttattatgggcctataatgtctatgacattaatttgatgggattttgctacgtgaatgtacagaatagtaaaacttgggtttcaaaaataaaaaactaaaaaataaataaataaatggggaatcctttccccttttcttgtttttgccaggtttgtcaaagatcagatggttgtagatgtgtggtattatttctgagggctccgttctgttccattggtctagatctctgttttggtaccagtaccatgctgttttggttactgtagccttgtagtatagttcgaagtcaggtagggtgacgcctccagctttgttcttttggcttaggattgacttggcgatgcaggctcttttttggttccataggaactttaaagtagttttttccaattctgtgaagaaaggcattggtagcttgattggggatggcattgaatctataaattaccttgggcagtatggccattttcaggatattgattcttcctatccatgagcatggaatgttcttccatttgtttgtgtcctcttttatttcattgagcagtggtttgtagttctccttgaacaggtccttcatatctcttgtgaactggattcctaggtattttattctctttgaagcaattgtgaatgggagttcactcatgatttggctctgtttgtctgttactggtgtataagaatgcttgtgatttttgcacattgattttgtatcctgagactttgctgaagttgcttatcagcttaaggagatttttggctgagaccatggggttttctaaagataaaatcatctcatctacaaacagggacaatttgacttcctcttttcctaattgaaagccctttatttccttctcctgcctgattgccctggccagaacttccaacactatgttgaataggagtggtgagagagggcatccctgtcttgtgccagttttcaaagggaatgcttccagtttttgcccattcagtatgatattagctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttggttccatttatacgctggattacatttattgatttgcatatgttgaaccagccttgcatcccagggatgaagcccacttgatcatggtgggtaagctttttgatgtgctgctggattcggtttgccagtattttattgaggagttttgcatcgatgttcatcagggatattggtctaaaattctctttttttgttgtgtctctgccaggctttggtatcaggacgatgctggcctcataaaatgacttagggaggattccctctttttctattgatggcaatagtttcagaaagaatggtaccatctcctctttgtacctctggtagaattcggctgtgaatccatctggtcctggactttttttggttggtaggctattaattattgcctcaatttcagagcctgttatgggtctattcagggattcaacttcttcctggttttgtcttgggagggtgtatgtgtccaggaatttaaccatttcttctagattttctagtttacttgcgtagaggtgtttatagtattctctgatggtagtttgtatttctgtgggatcggtggtgatatcccctttgtcattttttattgcgtctatttgattcttctctcttttcttcttagtcttcctagtggtctatcaattttgttgatcatttcaaaaaaccagctcctggattcattgattttttgaagggttttttgtgtctctatctccttcagttctgctctgatctcagttatttcttgccttctgctagcttctgaatgtgtttgctcttgcttctctagttcttttaattgtgatgttaggttgtcaattttagatctttcctgctttctcttgtggcatttagtgctataaatttccctctacacactgctttaaatgtgtcccagagattctggtatgttgtgtctttgttctcattggtttcaaagaacatctttatttctgccttcatttcgttatgtacccagtagtcattcaggaacaggttgttcagtttccatgtagttgtgtagttttgagtgagtttcttaatcctgagttctagtttgattgcactgtggtctgagagacagtttgtaatgatttctgttcttttacatttgctgaggagtgctttacttccaactatgtggaagtaattttggaataagtgtgatgtggtgctgagaagaatgtatattcttttgatttggggtggagagttctgtagatgtctattaggtctgcttggtgcagagctgagttcaattcctggatatccttgttaactttctgtctcgttgacctttctaatgttgatagtggggtgttaaagtctcccattattattgtgtgggagtctaagtctctttgtagatctctaaggacttgctttatgaatctgggtgctcctgtgttgggtgcatatatctttaggacacttagctcttcttgttgaattgatccctttaccattatgtaatggccttctttttctcttttgatctttgttggtttaaagtctgttttatgagagactaggattgcaagtcctgccttttttttgttttccatttgcttcgtagatcttcctccatccctttattttgagcctatgtgtgtctctgcatgtgagatgggtctcctgaatacagcacactgatgggtcttgactcttaatccaatttgccagtctttgtcttttaattggagcatttagcccatttacatttaaggttaatattgtcatgtgtgaatttgatcctgtcattatgatgttagctggttattttgctcgttagttgatgcagcttcttcctagcctcgatggtctttgtttttgcagtggctggtactagttgttcctttccatgtttagtgcttccttcaggagctcttttagggcaggccttgtggtgacaaaatctctcaacatttgcttgtctgtaaaggattttatttctcctttacttatgaagcttagtttggctggatatgaaattctgggttgaaaattctttcctttaagaatagtgaatatttttccccactctcttctggcttgtagagtttctgccaagagatctgctgttagtctgatgggcttccctttgtgggtaacccgacctttctctttggttgcccttaacattttttccttcattccagctttggtgaatctgacagttacctgtcttggcgttgctcttctcgaggagtatctttgtggcattctctgtatttcctgaatttgaatgttggcctgccttgctaggttggggatgttttcctggataatatcctgaagagtgttttccaacttggttccattatcctcgtcactttcaggtacaccaatcagatgcagatttggtcttttcacatagtctcatatttcttggaggctttgttcatttctttttactcttttttctctaagcttctcttctcgcttcatttcattaatttgatcttgaatcactgataccctttcttccagttgatcgaatcggctactgaagcttgtgcatgcgtcacgtagttcttgcgccatggttttcagctctatcaggtcatttaaggacttctctacactgtttattctacttagccatttatttaatcttttttgaaggtttttagcttctttgtgatgggttcgaacttcttcctttaacttggagaagtttgatcatctgaagcctcctctcaactcgtcaaagtcattctccttccagctttgttccactgctggcgaggagctgcattcctttggagggggagaggtgctctgatttttaggattttcagcttttctgctctgttttttcaccatctttgtggttttatctacctttggtctttgatgatggtgacgtacagatggggttttggtgtggatgtcctttctgtttgttagttttccttctaacagtgaggaccctcagctgcaggtctgttggagtttgctggaggtccactccagatcctgtttgcctgggtatcagcagcggaggctgcagaacagtgaatgttgctgaacagccaatgttgctgcctgatctttcctctggaagcttcatttcagaggggtacccggccatgtgaggtgtcaatctacccctactcaggggtgcctcccagttaggctactcgggggtcagggacccacttgaggaggcagtctgtctgttctcagatctcaaactccattctgggagaaccactactctcttcaaagctgtcagacagggacatttaagtctgcagaggtttctgctgccttttgtttggctatgccctgccccgagaggtggagtctacagagtcaggcaggcctccttgagctgctgtgggctccacccagttcaagcttccaggccgctttgtttacctactcaagcctcagcaatgacaggcgcccattccccatcctcgctgctgccttgcagttcgatctcagattgctgtgctagcaatgagtgaggctccgtgggtgtgggaccctccgagccaggcgcaggatataatctcctggtgtgccgcttgctaagaccattgcaaaagtgcagtattagggtgggagtgacccgattttccaggtgccatctgtcaccccttcccttggctaggaaagggaattccctgaccccttgcgcttcccgggtgaggcaatgcctcaccctggtccggctcacgctcggtgggctgcacccactgtcctgcccccactgtctgataagccccagtgagatgaacgtggtacctcagttggaaatgcagaaatccctcgtcttctgcgtcgctcaggctgggagctgtagactggagctgttcctattcggccatcttggaacttctttctgaaactattctaaaatctttatgtatattaagtgattttatccacttaacagctctatgaggtaggtactattattgctcctattttagggatgaggaatagaggcagagagaggttaaataacataactgaattatacagatagtagcagagcagcatttcctaattggggcatcttactccagaatctctgcttttatgtccactgtgctcctgcaaaccttctaattcaagagcctgttttcatatctttacttctgtaactcacctaaaagttgatccaacaaataatcagggacacagtcaagtattttgggagaagaatgttcatagcagcaaaacttacagtcataaaatattagatagaaaataacctatatgtcctacaatgtagaatgtttaatcatggtatagaccattaggcaagcattagaaattatgatctagaagaaaaataagtaacatgggaaatgctcagtataaaggtcaaagggaaatgcaaagatacaaactgtgatcctagcaatgtgtttgtgtgtgtgttcagaaaggaaatccattagtcagactgagttccaattccaatcttgactctgtcatttattacttttgttaccttggataataatttcatccctctttaccccagttttctcatcagaaaattgggatgagttgttgtaagggttaaaaaattcacacatgtaaaatgcttaaaatactggctggcaagcacttgacagctatcaaaatataggaaactctatttaaaaattagaactgaatagtacacattcagatggtagtttaataagtattctttgtagtctaggatccaatattttatagcttcctccaattatttttcccttttacacttgaaaaaataattgtaagtcgagtgagatgaggggcattttccattgcaagcaaaaagtatttgctttcagaatctactttgtcaaattataagacttactaaacacttaagcaaacactgaagggttatcaaagttttctttttaaccagataccttctcaaggctgtattcctcatattttactttggttgaatactctttaattgtgaggatttaaaactatttagaactgtgttttcatgtcagttaggatcagtaaattgaagaaaattacaaattggcttttgaagagcctaaggccatatatagtttatttctcatccatgttttgaaattatcttaattatattgatttttaaatttcaatttaaaaaatagaagtgagcagtttgaataatagcacccatctattttgcctcaaagttttgtttttcttgtctaattaagagaataattatttttaattgataagtaaaaattgtatatatttatggtgtataacatgtttcaatatatgtacacatcatggaatgtctaaattgagctacttaacatatgcattatttcacatatttatttgtagtgagaacacttaaaatctgtcattaaggaaattcttgaagtcattggagctggtctcaggaataaagctactggttcaggggcatgtgactttcagtgctctgcccagaatcttcaaagtagaatcaatggcttaagcactttcttaagaaaacgctggaaaatcattgaccaaggaaattaggttattttgctgctcacaccattaagaatctggtttcctggcaggctttcatagtctttctttctctctctctctctctctgtgtgtgtgtgtgtctctctctctctctcaggtctcctatgtaaaagcgattgacatctggatggcggtgtgccttctgtttgtgtttgctgccttactggaatacgcagcggtgaacttcgtctccaggcaacacaaggagttcctgcgcctccgaagaagacagaagaggcagaataaggtatgattgcccctcagttcagacaatgtagagcttgagttggttagctaggcaatgtaattcagaaaacagaagagcacacaataagcaagaagccaaggttaatttttgttctgatttgtcctactacactgacttagtgctcagcttaggcctttaaaattggggaggattgtcagattcagcaaataaaaatacatatcatggagttaaactggaatttcagataacaagaaacaatttttagtataagcacataccaaatattgcatgggacatacttatactaaaaattgtttatctgaaattcggaagtaactgggctccctgtatttatctggcaactctaattggggatatatacttgatttgacaaagttactttaaaatcctggttcttctaaatattgactgtgtgtgtgtgtgtgtgtgtgtgtgtgtgtgtgtgtgtgtgtgtgtgcgcgcgtgcgtgcgtgtacatcactgatctgattgactttttttcatcaattgctctggctttatgtaaattatgccgtacccatgtagattgcaacatgataaatccagtgagactggcctcattatctcaacttaaactttagtgcagaattctaagctttacactgtccagagacttcaggtttgaaatgcatagctcaagatctccagtcctgtggttcccaaacttgcctgcacattagaatcgcctggggatattttaaaaatcccaagccttagacacaccttacaccaactaaacctcaatgttaggaggggcaccagcctctgtatttctgcagctccccaggcaattctggtgtgcagacatgcttggaaagcactgttctggtttataacccaatctcatagaggctatcaaaaggcttgcacctgttttccatttcaaactctgggagagaaacataccctttgatatgaagaatgttacctcctgtaacaatattgcttgagaactaaagttaacattttatgtacagtagagagagaaagatttttcaaaatctgttccagaaaatatttgataaattaatcctgctggtgaagtaatagttatatgctactctgttggaatgaaaacaaaaatatttcacagtccctattaatgctgcaaatacctagatgtaaagctgaatatttgttgtgagacattgcttatattgaggagtttatgtgggtatgagctcactgagttctgactgcatccactgaaaggtttcctgcacatactctgggctggaagagataaatctatcctgttagctgccctgtctcactcttcgctacctctcaggaacattttgtcctgccatagataaggaaaacaagtaaacaagcacaaatatcctctttgctgtacattaccttttaatgttgtgcctttctcaattttctcctcactgcctccctgttggtgctaacgtttctttaatcacattcacagaagtccagcacacagcagcaaaagttcaggatcacttgtgccacctagaaaatattcttacattacgatggtatttcaacacaaaacagtacagagttaaaagaattcatgctgcaactgtctattggtcagtggatggtttaagtccttcaacaacttcttttacatatggtaatactgctcaggtttcccaaacttaccttatcataatgagactcacctaggacccttgtgaaacatactaattctcagcaaaattcctttcagatgttgatttataaagttgggtggaatacaagaatctgtacccttaataagcactctaggtgattattatgatgagataaatttaagaaacactatcctggcttactgactgcatactctcctagaccaaagatggaaaatgggtttcattttgcttcccaattctaaatagttgttagggaatttttgaaatgctgtgtgaaggattcttagactgtacctgggctctgtgggaatgagatctgtcatcaattagcaatgtctggcattacataataacagatattaaagactaatttttaaaaaagtataactagcaaacaaggggggttggatatggaataataaacagacaaaatcaatctaaagcaccagcatggcacatgtatacatatgtaactaacctgcacattgtgcacatgtaccctaaaacttaaagtataataacaaaaaaaaaaaagaaagagggaatgcagaaccagacagacaaagagaaagcaaatagagaagtggtagattaaacccaaatatattataaatgcagtaaagaaaaatagaataaatacctctattaaaagacaaacattttcagatgaaatttaaaaataaaactcaactttagtcagcctccaataggcacacctataatataaagatagagaaagcttcaaagtaactgtggataaagatatctcatgcaaacactaaccaaataaagccagtttagctccattaatattagataaagtagactttaagaccaaaattattactagaaatagagatatttcataatcaaaatgatcacttcaatagggggatgtgattactatagatatgtctacaacgaataacatggcctcagaatacaccaagtttaaattgacagatataaagaagaaatagacaaactcacactcatagtgaggaattgtaatatacctctcagcaactgatagaaaaaaagcagacagaaagatcagtaaggatataaaacatttaacaacataattaacaaactacaccctcaaatgcagtaaacatatacttttcaagtcagaagaaacattttggtatatttatcatgagttggactataacgcacctcataacaaatatcaaaacactgaaataatattatctgagtaaatagaattaggctaaaaatcaatggtacaaagataactagaacatctctataaattgggaaataaccaaatacttctgaaataattcaggaatcaaaaagaattcacattggaagttagaaaatattttgaattgaaagataaattgtacatatcaaaatatatgaactgagctaaagccatgcttagtgaaaaatgtatacttcaaatgcatattttataaagatggaaagctgaaaactgattatctaagaatctatttcatggagacaaaatgaagaataagatattaaatccaaagagtgtagaaggagtgaaaaactatgaaaaaaaacacaaagagcaaaaattaataaaataaaagaatggtccattaagtttactgattatcttgtcatgaatgttttcaaatcagcatttgggaagaaccagattgcagtagtttaaggtaggtgaggatatggaaaaagcaagtatagattacttgaaaatttagctctcaaagggagagagggtaaaacaaatttctgcacaatctcactccctgtcatcattagactactcacaggttaaatatatatattcattcaaaagatgtttattgagcacctactatgcttaaacatggaaagctgtgaatatagtagagaatgagagggacaaagaagtagaaaatgaggttgaaaaataggtaatttcaagatttatttgcaagccagtataaaggattttattttattctaagtgattggaatccactagttagtttcaatatagcaaataggctattgagtggatagttgtggtgtcaagagtagcagcagataagttaggaggctattgtagaactataggtggaaatgttgatggcttagattatggtattggtcatgagaatgaaggaaagtggttaggttcaggattctttcatttgttccacaaaaatttatttacttcttactatgtgccaggcactgtgtaaatccttagaatacgttgcttcacaggacagaaaaaaatgcagccttttgatgaaacttacattctagtggttatgctttggaggtaaaaccaataggtcatgctgatgcattttatgtgaagagatgagaagatgaattgaatatgactcacagatttttggcttaagcaactgggtaagtagtgttaccatttattaagatggggactattgtgacaagcgcagatttggagtggaacttgagtcacatttttatgctcttaagttcagatgcccatgagacatctcgatagagttggcaagtaattagatagaaatatatgttcaagaaagggataaaatctggaaatgtatatttggcagtgaccagcaaacagatactgttttaaatccacaaaactaagtgagattacacattgagataacagaaacaaaaaaaaaagctctgagaatggagcattccatcatttagaaagcctatctagagtggattgggcagaaaaaggaacaaaggaaatggtgacaaaccttagatatcacttgcaattgcctttactgtgcaggggaacatagaagatggtatggaataaaatgtgtgctcatggggggatatattttttccaaaatggaagataaaagaatgcatttggcaaaggaaaagggaggtattcacattgcagtgaaaggagggcataatttcaagaacaaatgtcttaagaaggtgagaaaaaataaaattcaaagaaaagggtcagggttggcattacatggagacaactatttcacccattttaataatgacttaaattattgccagttcatagatggagatactgaagcacaaagaggttaaatagcttgctcattctcatgagccaagaagtggtgtagtgggtctgaagtgagatactgtgttcccagagtctgtgtgcttcaccattgtacaaacaaaatgggagaatgactatggttgctagccaattggtatgtccaattatgataggatgtaggagctcctaactaatagctcctatcatgtccatgaattctgaggctatcagctaagagtatggtggaaaaaagaaacataggtttgaggaagaaggatcaagtattaaatagtagtttgggagggtaaaaaagccattcctccaagaagagtaatggggcagaatgctgaggcagaggcagtgggagtgcccatatgagaactgtggttatgactttaaagtgtgaacaatcaggaggtatgtgtttccccccagcaagcttccaggatcagattcaggtactgagataacaggtacttcggtttaactacaattgaagttttgccaaatgagcaggaaagtgagtggaagacaaagagaagacaatagaggagttgaaagaagagaatgtagaagggaagaaggaaggaagaaagaaaccaagaaaggagaagaagggagggagagtgggagggagggagaatgggatggagggagagtgcgagggagggagggagggagggacggaagtgaagttaagggaggttgcatggcagtagttgcagtgatgaaccagaaattctaaggtggatagagaggggaaaacacggaagagacactgtattcaagagagagaaagagagagactcaaaattaagatttcacaggaagtaaagacaaagataaggttatgatcataaataagcatgtgtgactaaggttgggttgagaaaaaattattgacagcaaggcagtccaggaattggaaggccgaggatggggtctattatccatatgaatattgaagatcccccaataaagatgacattagtatgagtgttgggttgacagggaaatggatgctaaagtcatcaactaataaaggagtacaactaataaagggtaacagcacagataggtaacagcagtgataaggaaaatcagtagtgaagtctaatgacctgagcttcagagacgccaaaggatctgggtttgaggaaggaggaaaaagatatggtttgggcattgcagtggggagcaaaaaggataccttagattaaaagatgttttagagatgccagttggcagttacaatccctgctatgtttattgagaaatgcaagtttgcatgtttgacatggagatgttcttaagtttgtgtatggctattcagaacataatgttttattaccaaagttaagtcttggggggagttgaagagcaaatcaaatcatgcttaagctttgtggtcaagtttcctaattatcaccgatggttgaattttgaaaaaataggcaagaaatatttccaattatttgtcccttaggaaaggcagcatttttcagctttttaaaaaagtctgaaccatggttagaaaaaaaaaaatgataacaagagctaacatttattgagggcttactatatgccaggtactcttctagatactttacatatagtaattcatttaatcaccactacaactgtgtgagtaatgcaatcatacagcccagtttacctgggaaagtcttgatttaggcctatttttccaataccttgtgtgatttagaatttgtcctggattactcattttaaacaaaatgttttttattaatagttgcattaaaataagtggaaacgggtttggttgacctccactttatagacctggattctgtcatagggtgatcctccggtataggggtatgcatgtgcagtgaacgagttctcaccttaacacatggtgaaatcgaaaaaataataataatcactactatccaggcatcttttcttcatatgttccagatgcagtgtcataactaacactccctttccaggatagcttgcgggaggggagcttgcttataaaatgaagtgcaattggacaccagaggctggggacagatgttgctctctatcagtgatgggtcactgctgcccctactggtcacttgggataccagccttgttctatggcatggcatggcatggcatgcaaaatccatgaagccaccgggctatcacttcatagggtcagtgggaaacatggaaaatcacaggttctgtacacataaaaaggaaagaaaaactgagcagtcttgctgttgagcatctgaatgctcataattgagtgatttttttcatttttgtatgatataaatccgttttaactacgttttattgtttgataaaacttttttttactttgcaattgtcaacattatagagttgtaatgtctgtcagtgccacttgccactatcaaaattgtccttgtttggattaaattgagtaaattaactaataacaatgaagatactgttcttatctcaatttacagatgaggaaactaatgcaaaaagaaaatagggtgaggcaaggtgaagcaaatagggtgaggcaagtgagtcacacaagtacagggtcagatcctgttttattttttatttaatgttttgttcaccatggattttttgtattaataatgatattttcaaacattgcattaaatatcatttgagtactggagttttgggtaccccctcagattttgcccctgaggcctcacttgttttcccctagtttggggcccacctagtcatgaactactaaattaattttcacagaaatgcattgtggcctgagttaatttttttttaattatttaaaaatgttcaatattttggccgggagcggtggctcacacttgtaatcccagcactttgggaggccgaggtgggtggatcacctgagggcaagagtttgagaccagcctggccaacatgtgaaaccctgtctctactaaaaatacaaaaatcagccaggcatggtggcatgcacctgtggtcccaggaactcatgaggctgaggcaggagaatcacttgaacccgggaggtggagattgcagtgagctgagatcacgccactgtactccagcctgggcgacagagtgagactctatctatctcaaaaaaaaaaaaaaaaaaaaaaaaaaaagtaaatattcccaaggcaatatgtcatctctttaatttcctactgagaaactgacctctgaaataacatacaggttgatattttagaaggtataacaaaaaacaagagcagatcatctcccaaaaagacaatggcattaagctttattcagggaaggtatttattgagagaacacctgagattacatttacatgcatgggaagagtgtctggtatttactgagcaatcaagttatcaaatggggtcactttcaaggagtggccgggcaatgtgcaactaggtgtatttgctttgattatcttttctaggttttgtaaagcagccactgtcaattttatcaaaacagagtttctcagaaacaatcacgcccagatcttccctgacagaactggccaaccccagtctattagaagctgatgccccaggtctatgcaataaaactctgttttaatgttatcgcctctgctccaataagaaatatgtgcaccatgtgaagttataacaacttctctacaatgcagcctcacctgcatttatctcccactttcattttatatctggctgcaccatgccttacttctggcattgtacctaatttcaaatgtttccagttacccagatagccctgacttctttttgttcagctactaaatagaaattgtggctgcttgagaacatggttatggcatgtgggccacctaatgacaagttgccttttacttatttttcttctattttgtttttaattgacacataatagttgtatatatttatggggtacaatgtgaggttttaaggttttatacattgtattatgatcaaatcaggataattactgtatcaatcatatgaaacacttatttcttcaccaaatcatctcttctagatattttgaaatatacaatacattatcattaacgattttcacccaactgtgcaatagaagaccagaacttattcctcctatctaactgtaacatagtacccactgactaacttctcctcatctctccctccccctcattttctctaggcactgataaccactattatactgtctacccccatgagatcaaattttttagattccacatatgagtgagatcacgtcctttgcagggacatggatggagctgcagggcattatcctcagcaaactaatgtaagaacagaaaaccaaataccactcattctcacttctaagtgggagctaatgatgagaacgcagggacacatagaggggaacaacacacactggggtcttttggagggtggagggtggaaggacagagaggatcaggtaaaactaatgggtactaggcttaagacctggggtgatgaaataatctgtacaataatctgtacaacagacccccagttacagacatgaccctcagtgtgggataggtgaaatgtgagagatggaggtagcgatgtccatgaggcagtccagcactcaggagagaggactgggttggacagacatgctgagaagtcattaggatatagatggaggttaaagctatggaagtggataagattacccagcaggagtgtacagagtgagaagagaagtggaggagaaaggttgagaaagagcaggaaggggcagggacggagcaggaagagggaatggaaggggaaggcagtgtaagggaaggcagtgtaaggcaaggcagagggctgagggcaaactcctgtgagcaccagcatatcagagacaggcagggggaaaggagcccatgagagagacagagaaggtcagacggctatgtaatcactcagaggctagaaaaagaaacatattcaggaagaaaattcatagtatctaaagatgtggagttcacataaaataaaagctaagaagcagccatggattttaggaagtcagaggacattggtaacctcaacaacagcaggctcagtggagagacggaggcagacacaagattttaggcagtgtagtagtgaagtggacagtgaggaagtgaggacattgaatgcagccattttatccaagaaaaagaggcagaagtggctgaggaggcatataggccatggatttttttgttggttggttggttcttttgctttttatttagtgttttttttaatgagcaacttgagtacatttaaatgctgatgagagagttgtttatagagagaataatattacttacaggagttttgaggaaaggtgggagagcatacttaggtggagccactagccatacccagtagaaggtattccttctgataactgggagacaaaagaaggaataagaataaggacatggcaagtttgtgggtgggtgggtaggcggacaggattttgaaggaatccccacatgatggcatctgattgttttctgtgacacaggaaacacattcattttcagagaataaagagggaggtgacagagtaggaggtgtgagaacagtgggaaaactttgaaatgtttgtgaattgcgaaatacatcaccaggaacccacagaagttttctcaagcaggcttagggtccatcggacgtaggggaaattggatatgtaggggcatcaatgtgctggattcggtgaggttctccagaggagctcagcagcctagaataaccagatggtgggttccacaattgatccaggcaggactgactgaaataaaaatgggcaacccctggttcaaaaacaattaagaatttcaagatggcaacagcagagcattaaactaagcctagcacccctctgtgtatggaccctgtgtgtctgcacaggttgcatgcccgtgaagccaatcttggatccaagctgagggttttgccagacaggatggatgaatggataaaaatatgaatcacgtgatggtccaagcagggtagagaaagggggatactgtaaagaagagatgagaatgaaaggagaatattttacacataagtgaaataaatgtaagcaataaaatgtggcagttagcccacttatttattctttatttgcaataaaacagttaactctagcttttaatttcaatgattctttatatttctatagttaccaaatttagttgaagttctagttttgcacagaccttcttaagggagttttgctttacagattttttgaagggagttcaatgtttaaatgagaaagaaaacttgtatcaactagtgtcctttttgtgttgttttgtttactggggtagacaggctcagacaaatatttcagtgcagaatgttgtgtgctgtgggaaaggtttaagtgcatgatttaaagtgatgactgaggacaaagcatcttctccacttggtagtgccagggagttgagcctttgtctgggtcttgacacaggagtagaaatttgccaggtcaaaaggaaaattaagaggatatccaggctgaggaaacggttatgcagaggttcagatgttagaaacgacatgatgctttcactacatcataaaaagttgagtcaggaaagtgctaaagcatggggcctaaaaggaaggaagacttcagttgctcttgaactgggagccaccaaaaggctttataaatgatagaatgctacaatcagattggaactgtggaaacatcactctatatagaaaggatcagattggaataaggcacaagatcaggaaaatgctgcttcagcatttcaacttaaaaacacccttaattttataagtagtctacacttccctgaagcccctccctagaggcatagatcattattactattttggtttgcctttttgtaattttgctagaactagctttccaaatctgggatgtatattataaacttaccaaagcttgtcttaagtgtgaatataaaagtggctttctggtttgaattctttgcagtaacacaggtgtcttatcattgctgtaacaaatcactacaaacttaatggcttaaaacaggaaaaacttattatctacacttctgtaggtccaaaatgggcctcactaggttaaaatcaaggtattggcaggactgcattgcttctggagggttgtcacgggggttcaagggattgggggccatatcaaagaaaaagatatgaccacgcaggcagtaatacacaacaaagtttattgggtggcacttggacagggttgcgtgaaaaggtggctcctcacagcatgaaatgatccagaggcttagagacaggggccaccatacagagaggagaggacaaggggactcccagtggggaggtgaatcagagggggctcacttgtctaggtgatgttgctcagctgcacagtgggggagcctctgggtcagagagcttcaaagagcagcagtgccatgggaccttataagtgcaaggaccagcagatgctaggcatggttttgtgggctatgcaaagcagtcagggtctagatggctaaaaatctgcttgtttaggctatttttaaaataatggaatgtgtaaaatttgagtttggtgccagcaagctttggagataacaggtctcaacctatagtggggaaataaacaaccaaggggacaatactcagaggccatctttggctcatttatataacagtgttctaggggagaatctgatttcttgacttttccaacttctagagctacttacattccttggctcatagtcccctttctccaaaggggaaagttgttcaaagccataacattgcatttctctgacccttcttccattgccatgtgtacctctgaccacagttgagaaaggttctccatttctaagagtcatgtgattaagttgtgagcacgtagatcatctagggccctctccccatccttagtttcttaatcacatctgcaaagcccctctgctttgtaggataacatattcacaggttccaaggattaggacacagacatctttggtaggcattatcctgcctgccacaaacagcaatggtttccactgcaactctgagagcatccgttgggcactgtagcatgctccatgcacactcaggacagtccagaagtaccaggaggtgaatgctacaggagtggccctcaaccaatgagaactgggagttggtggccaaataccaagcttcctcaacccttggtaagtcaagtctcagtctctcagaggtttgagccccatttggcaaccatggtcacctgctgattattcacacatcctttattgacttttctcctttccttgtcctacacttccccactccctcaccacactcctgttgttgcctcccaagtaaacctcttgcatgcaatccctcatctcagggttgctttggagagaacaaaaacaaactaaggtgcaatgcctcctaggccaaggacctcatgagaatcacaacccactgaaccccatcctcggcctccccactaaacaccagattctggaggactttttgtgcctaaagtgtggaaacagagggaatctaggagcagcaagtgtcaaacaatggtttattgtaccttacagttggcattgctaaaatatttctgtgctgctgagcttctaaaataggtttcataacacaattctattgctttatgtccctgaaatcaagcctgtgccttcagctctactagtgtttcataaaggctatgatggcagataccttgaaccttcttctttcactatctagctcttaattggtgtaagattctttttttccactttaaaatccagatcctgcacaatggtttaagattcttgatggcaacttgagctgtagttatttcagcataactggactctcataaaaagatcgagctaaatgacagaaaagtctggtgcttccttggcattacatcagagatgtgggtttgcctaatcatagtagtaatttgtctctatcactgttattcttgtttttaacaagctgatttggggacaatatgcttaaatggagttatttcccacctgattgatgaggcagcatcagacgcgagtataaccgtttataaaataaatgaccttggctctgtgcaggagtgggtaaaaggaaacgacccctgccttcttagttttcattctaagctgctagacaatcctagatttcatttcttcaacaaatagtttttgaatgcttgccttgtacagtgttttgttttagataaggggcagataaaaaaaactgcttgaaacctgttttcacaaaattttagaggtcaatatcagaaaaaaagtacaaaaatgttctaatatgaggtagagaattttaagaaccataagagagttatagttggagctgtggcaattcccaggaagggagagtatagtgtacttccagctcttaaggagggaggagattctcaagaaagaagcagcatttgtaaagttcattttatcttagaatgttaactgtaagttattctaaactcatcttgttattgtcagtaaatgaaacagagattaaataattaaataggtaatgaaaactacattctttaaggtggcatttaatgctcattagaaagtagccttatcctgccttgctgatacacatttacatcagatgaacctggagagcttcccactccaagaccttcaagaggaaagtgagagtcagtgacacagaagctttgtttgatctaaggcagtggttctcagccaggagctatttttccccaccccaggggacatttggcaatgtatggaggcgtttttagttctcacaacttggggttggggactgtgtgtgttgctgaactctaatgagtagagaccaaggatgctgctaaacatcctacagtgcacaggatggtgcccatagcaaagaatcatctgacccgaatatggatagtgtcaagtttgaaaaaccctaatctaagggacagaagcatgctgtgcacacagaggactgaggtttagcttcatgagtgcaagctgcttatgaataaagatgtcactcctgtcaggagtaattaattagagctagtataacccagttgacaaaatagtcagaaaaacctttcattaagaatttcctcttttgtaagtgaactcttttactctacataaagttctttttatttacatcatatagcaaatcagggatccaaaatatggttctttgtactggtaatgaacaggggcatgaattttgttgggtgtatgatttaattgcttttcaaaatgttgacatgttgacatgggtgtaaaaacatcaggaggttaagttattaaatgcctccacttcattccactctatctgctgctgctaggatttgttcaagagcaacagaagtcataccagaaatgagctctggtattttctagaaacaaggtaacccattacagcatggttctcaatcctggttacacactagagacacctgggagctttttaaaatctaaatgcccagaccccacctcagaccattaaatcagaatatttaggtgtagagcccagacatcttggttttataaggcttcccaggtggttgcaatgtgaagccaagtttgagaaccttgcttctttaaatgtcatctgttgaccagcagcatcagcatcacctacagcttgctagaaatgcagcctctcaggccctaccccagacgtgtggaatcaaaaataacaggattctcaggagattcactagcacattaaagcttgagaagtgctgctctagaatatatcgcagagagtccacttttaaattgtatgcatgttgcaatatgcacagtctaaaacaaggcatattattactattaagacatggtaaaaagctccaaagctttaaatagaattattttcacttggtaagaaatattaagtttattactgtggctgcttgtgttttgcactaaattttatttttaattgtgaaagatttcaatcatatagagtaatttaaccctatgttgcttgttgttttgtttctctcaagaagagtaatcactaagtagcctaggattatcattctggtattaggagccaaatgggaaccccatgaaagaccttttcctataactgagaaggttccttctcagctctgtgttcacatacacaaggaggaaatgatctgaaatggcatgtaacaggatccatgatagagtgaggagcttcacctttgttaacaagattgaacagtgcacacatgcattgtagtaaaacaataattctaaatagtcatacaacttcattctggaaagcacaaaatgcttcaaattatggtagtttggcagtgatatctccacagggagtttataaggtttgctgaatgtcgtacagccaattcctgactgccagacctgagacgccttaattcaacacagaatcattgaatgttctttcacacttcctgtcttttagggcagattgattaaaataaaacttacaaaaatacctgtcttaaagtcagccttcttcatcccagccaagtaccctatcctgtcaatatgtttcattacagcaccatttcctggaattactgccattgaattcccgtcctcttaataacatatactttttctctccaaaacatgcaaaaaagaatatgagagagaagcatgacatagtgacacatgcttagggccaggagtccagctggctgaatctaaatcctggctggtgctttatttgctgggtgattagagtcatggcctaaccactctgggtctcagtttcttcatctgtagaaagagtctaataaagtcctttctcatgggctgctgttaggagcaagcaagattatgcacgtgaagaacagtgccttgcatacagccaatacttatgaagtatttcctttctcttcctttcgcctgctttttgacatgagaatattgcatgatacagagtttggagcatgaatcccttcaccctggtagtgagcttagaacctgataggtagttttttaacccaccccccaccctccaccctctaaaaaaaccaaaaaacaacaacaaagaaaatatcatggtatatcctgctttgtaaaagtaaatactactttgtgaaacttttgttgccattagatatattaatgtgtgtggaagtgtgtgtatgtgtgtcctggttagtaatggaaaatatgttttcctactttgacagcaaaaaaggtgtgtgtgtgtgtgtgtgtgtgtgtgcacgcgcgcgtgttgcatgcactgttagatgacagtctttattttttttctagctttaaggtataattgacaattagaaatcatatatatttaaggtatacgacttgatgatttgatatatgtatacactgtgaaataatcaccatgattaaactaattaacatgtccatcatctcacattgttaccagtttcttttttttccttcctttctaccttctttccttccctccctccttctttctttcatgagaacactaaagatctacccccttagcaaatttcaagtatacaatacagtattgttaactatagtcacattgttgtacattagatctccagagcttattcatctcacagaactgaaactttgtatcccttgaccaacatcttcccctttcccctcactctatctcttggcaaccaccattctactctctgcttctgtgagtttgattattttagattccacatataagtgagaacctgcagtatttcacagcaaaaagttttgaaggccagtgctctcagggtggatcaggccaggtaaacaaattcacctgaccatctcaggcttaaaccttctcacataccctcaagaggcagtcacagacacagtaggaggggtcatttggttgccatgatgacagggacaggaggtatatgttgcactaactatattgcacctcactaaaacttgctaagccctcgcttttgtttgaccagcccacactcacacgccacctgagtattatgatgcccatgacccagtgggctcatcactccgtgacctgccttcagagttcaagctgtgtcatcctcagctggacacaacatctgcccaattatacagcacacagctgggagaaaagagagacatcaggccaggcgcggtggctcacgtctgtaatcccagcactttgggaggccgaggtgggcggatggcctggggtcaggagtttgagaccagcctgaccaacatggagaaaccccgtctctactaaaaatacaaaattagccgggcacggtggctcatgcctgtaatcccagctactcgggaagctgaggcaggagaatcacttgaacctgggaggcggaggttgcggtgagccgagatcgcgccattgcactctagtctgggcaacaagagagaaactccgtctccacacaaaaagaaaaaaaaaagagagagagacagcaactcaggagttaagtccattttctatgaaaatatatcgtcttagaaccatatcaggttttcctttttgcctctgattataactattgtattgacatctttgaaaacgaaagggagagctgggcccagtggtgcatgcctgtaatccctgctacttgagtggctgagatgggaggatcacgtaggccagcagttcaaggctgcagtgagctatgatcacggcactgcactgcagcccggacaacagagcaagaccctgtctctttaaaaaggagtagggaagggctacagaccccccatcatgtgccaaatactgtgttacataccttcatgcacactttcttaactagaaactcagctggtcaacaattagatcaacagatactggcattattttcccatagtgaccaatctgtcttctgtgtttacttcaatcaatcttccctctgggcctacagacaagttttctctctgaaatattaaatctggtaaccgtaataatgaagcagagaaaagaggaactcttggaaatgcactacagatactccaccaaacaaactctcattttatccataattttccatttttttccagcaagagttgcgtataagaagctataagcgacagtgaacaaacaaatggttgcagggaaagcataagggagctaggacagagatgatctgcaaagctaaatcaatcataagccagaataatggagcatagactgtgtttctggttcactctgctgctttgatctgcagtccaatgctctacctctgagctataccccctccttactctgctgctttgaatgtccttgagagaagcaataggaaagtgcctcctgatggtttacagtgttcacctgcttcggtaactgctaattttaaaccagaacctacagtccatattcattaaagaagagctagcttaccaacatcattcaaattcaggagataagattggccagagaaagcaggtttatagtttttcacctggagaaacacatttgttctgcagctgtggaaagcaatgacatgatggcccatagatgtctctctcctcaggacatgcctcactgcccctctgctagaaacctcctaacacttctccaagtcacacctgggcgatttcatcatgaacctaacctgtctcttctaagttggcaggaagacatcgagggccagaccaaatatagatctgatcctagtgattgagttctcagttcttgagtttactgagccccctgcagaaacaaacaactcaccaaacttccactgcaaacagcattgactttcatccctctgagctacttccagcagaaattgagcagtaagagggaagaggggaaagaaagcagtggctatctggaaggttgatatcattgcttgaagcctctaggctatcaaaacaatataataaagacaggcctctgtgaacaccatgtgtcagcctctaaaaggacatacattcattatttacataatgtgaggtaacatgttactatatcaggagttttcttattctatattctatattttatatattctatattagagtcatcttcaaaattataacagcagcaaagggacttgttgcctaattaaaacccttaaaaatgatgaaataaaatattatgtacgtcaaagataattgaaagaggaaaatatgcctgaactgaactgttgttacggttgattatattagaacagggtttctcaaaactggactagaaacttctgagagattatggagggccatagcaggacatagcttatcaaatacatctttcctgaacttgggtcagcaccttcaatgtggtttaccctcttagacttcttaacttagcagtttttacacacagagactccataaatagaagagatataaattttcacctagtcccctaacccattcaacatttccaacaaatggctgaatacttgactatttctagcaatggtgagttcattaccttccaaggtggtatgttccatgttcagtcacagagttgttaaaagttcatcctcatatagagttgaattctgtctccctgtaatatcaaccaacagtctctgattagtttccttggagccattaatacaaatatgagtgaactcaaaagagcccttcattcttttgaaaatacttgtcatatcagccaggcttatctcttctcaaggccagccttttgttgttccttctattcttgttccttttatgcttcctcatgtgttgtcactttcaggaacattcaccaccctgggagggttcccttgcccccaaacttattctcaatctgtcctgtttgtatctcataatcctacccctttttctatccagtgacccagggacaactgtttataaattggaatatcaatgagattctctctttcaagaattcaaacagaggttctgatacgctaattagatgacagtgaggacttgagttgaacagtttcacatagagctgaggcggtgtgggcctgattggaacatgaatgattatgggaacctggtaagagaagagcagaaattggagagagcatgagccctgagaaattgagaacactctcacttcctgacttgctcattggagctcctgggctagatagccctgtgtataccatcatgctaacatttattgagcatacactatataccaggcatgtaaacttttaatgtacatttccctgaatcttctcaaaaaaccctctaaggaaggagatatcatctctattttactacaaaagagactgaggcacgtagtaagtgacttacccagttcccacaatggttagtggcagagccaagatttgaaaccagagttttcgctccagagcccaggcttctcacctttacagggcattgcttccctatccttggaaacttatgagattatcttacaataattttcttataataattccttaaagacagtcccatttatttaagctactatgagtgagtttctgtcctttgtaacaaatcttccgcgattaagatgccagatggttaaaagataccaactaatggccaaatggcagaggcagtgcattttgtcatgttattatagaaaaaaatgccatctagctttccttcaattgccttggcataacattaccttttccatagtatctggtggtctgttcctttgccagagcagatatcacattatattatagtcatttgtctgtatcagggtttcccaaccttagcactgttgagatttgatgctagataattcatgctttgtggtgggggctgtcttgtgcattgcaggatgttcagcagtatcctggcctctatccactagatgccagtaaaacaccctctcccagttgtgacaaccaaaatgtctccagacattgccaaatatcccctagggggcaaaaatgaccctagttgagaatcactcgtctacatgttctagatcccctccactaatcgcacactgacttcaagtgcaggattttgtcttctttatccttgtttctgtccaacgcttggtacattaagataatcactcttaattgaaaaaaaaaaaactatagttgcttgcattaaagtggcgttttgtagttaaaagtctggagtaactgtacacctgtatccatctgggtatagtcatgaagacaaagacattaaaagtagtaccaaaatcaagggtttaatatagaaattaggctttatatgaatgtgggggagtaactgggggggttaaggtctaaaaggcaatagtcaaaggatgggacttaacatgaagttctgagtagaaaaccaagtgttcacagaaaaatctgagaagtcaccaggtctaggcaccaaagtaagatcataaagtgggagtccacagaaaggtctagccaccgtgtctaacaaagcagcctcttctgaccccaatgattcccaaaagtaatagcctctgcttcctttctgctttccagatcttccaagtttctcttactgaaaaatcctaacctgcaaccaatccagaagagaattctgggaaatatagttcttcccagccttaggcagatgcctaaggagtggtggtgccagataaacaacagataatcccatacaataaccactttggcaccaagtgtgtggatatatatagagagagaagttgaagcacgataaagatctagagaatttggcagtcaggatcatccaagttagtaaacaagcaaatgcttgatgtgatttgtcactgatgctgttattattgttttgagtttagtagtgggttcatcccctaatcacctgacccctccagtctcaacattcaccttgcaccctgaacagatggcaaatgatattaataatcaaacagctcatactccagatggaagatgttcaccttcatgcttcttagaattttgtgtgtcttttgagcactctagctagagcagaattgacagaaactgctgtgaaagaatttccatatgcaaggcattgcttctcttatgaggaattgaaatatcacagccatattatccatttctaaactactctctaaggctacagatgacattaaataaaaacatttctgcttgatagattttgaacagaaagccaaacaactatttttaaacaattacttctagtccatttaaaatgtggtgctgtaggtgaggtatgatccaaagaagagtgaaaaatatatttcactatagaaaattctattcaaaatatacattgaaaagacaaagacttcagagtttgcatggcccacaaagcctaaaaagttgactatctagccctttacagaaaatgtttgctgactcctgggctagagggagaacagcaggagttaaggtctgagaggtaaaggggatgttacaaggacttatgaggagaaccactggagagttttgagctgaagatgacctgatttgactggaaatttaacagaatccatttatttgctatgttgaaaatagacactattgttgggaggacaggtctagaagccagcagaccatgtagatgactactgcaataattctggtgggaattatcctgatgagccaccaaggggtggctcagaccagcatgtagtgttggagatggcaagaagttattaggttctggtttgaagcttgaactgattctatttcctggtttgaagcttgaactgattctatttcctgatactagatatattgcatagccccacataggtgtaggggaggctagaatattcagactttccacgtacacatttatgaccagccaaaacaggggttctcaagtagggttgatttactcatccaggagacacttggcaatgtcttgagacatttttggtgtcacagttcaggggcggggtgctactggcatctagtgggtaaaggccatgtaggctgctaaacatcctgaaatgcaaagctcagttcccaagaacaaataattatctagccccaagtatcaatattcctgcaggtaagcaaccttgaactaaagaaagatccaccattatgagaagaaataaagaatgggttttggtggtaactaggagttgtatagcccaactcaactccctatgccgccaccccagccatttacaggctgtggcaacatcagttccaagatttctgctcataccacaactgagttctgtttgttctcccctgcccatacattttccccactactgggggtgaagtctgtcatgaataagaggccctactggcatttttaaatgcatgaggcttgtaaaaataacatgtgtgatcaaggcaatgaaggtgatgttgtataatgatagctaaatagtacaaagcaccacagtgcaggtattaatttgttttaagagatttatgaagagaatattccattaattagaattttaagacttaaaaacggatgtttggtaattactatagatttacagggattttgctttccttgctaaacccaaatgaatagaatatgagttcaaataccctaatgttatacaaatactccttagtcttttgctatgggtgttaactgataagatcgaaatttatttggtaaaatatttgaatatatctaatatgtattgacttttaactagctttattattttgaattgtaaacacatacataaatgaaaaaaagtctttatattctaaaatttttgtctattccatttgttttccttgcaaataagtatgcactttcttttaagattcttaacagggtgaatctaattttcacactatgtggctgctcacgagcttaatacttggccaaaaaaatggacggtgtttcaaaaatagaaaacctcagttattgagtgacattgttaagcttaggtttgccctaattttatataaatccagtatgcaaaaataagccatatggtaaataagcaaggaaatgacttttcaagttacaaaatacttttttcatattaccattcacttaagcctttactttatacatatatgcattcaatgtaggaagattcagccaagtattattctaggcactggggatatcaaaatatgtcagaacgggcccctgcacttgaaagttacatgaaagaggcagacacgtaaatagttgaatttaatatgatgcagtagattccattatggagacatgtactacaggaggtaaggaggaacccatggctcaggatcaggggtcaagaaaaggcattctgaatagaataatggcagagtagaatcttaaaagacttgaaggagtttaccaggtaaaaagaggtgaggattattctatataaagggaagcagtttatagtcaaaggtcatgtaatcctatgagagaagtaggtgtaaggcaggacatgggggtccttgaatgtcacacaaaggagcttgggagtggtcattaaggagatgagaaactgttgaaaagtattaagtcttgaaatggaagcaatggtccaacggcatctattccactaaagtagaaggcagggatagctccataatctgcgtagcacagtgcaaaattaaaatgtaggtcccttgtttaaaaattattatgaatgtcaacatggctatagcagagcattaagccaagcacaggacccttctaagcactgggcactgtgtgactgtatagtatgcatactcacgaagctgaccctgtcagaaggtctcagggccggggttgaaagaagacaataaaacccttatttgcatgtgtctactccctggttgggaagaaaaatcttaaatatatcaaccagctagagattagtctcaaggcaacatactagccagcattatagtcctatacccacaaattcagaaaatggccaaatgtcctatctcttcattttaaagatgaggaaattgaagaacaaaaaaaaattgagggactgtcccaacctcacacatctaggttatagtaaagatgtgaattcaaccaaagcctttcagattctagcccagtgatttcctctgttcctctgcaatatccagtctatttaaagtgagtagaagaggatggaagtcctttgagggaagagattgatccagaggctgcagaaaggactacaattggtaaagagagagttatctgccaggagacaactgctgtcctctcccttcccccagggagcacgacttttctgtgtccttacttagaattaagaggatcactacaaacacaattattgagtaatgattaggaaccaggcaatgtactctagagaatagggctacagagttaattttgacatgctcccaggagctcacccctctggtgagcaaagataatagtgaaaatcagctatcaaaacccagagtccttgggcatctatcctttaatatgaatgggaagcaatattaaagaaaataataaaaagaaaaatggaaattaatacctaaaaccaataggtaactagaaagtctttttcagaataggagaatcatggatgatttgcacatcgccttgtatgtctcagcagtgttaccatcagtaccttcaccaactctggagacttcaggctaaactgaaccccaataaacctttgtacatatctcaaaaatatgcctcctattatactctatttcgttatttatgcccccttcaaaaaaagcaacaacaaatctgacgtgtccaaagtttagaagtatatcttaattatgtgcttccagagccaagtccagtgcctgccctataataggagcttctttattcaacattactgccgatggtcaataaattgaatggattgacagatgaggtcagtgtaactgggggcaccctccaagtggagggcctgggtacagagagaagctttcagtgcatcaaggtgagagaagcagggtcagccacatccaagagatacttctgccatttcactcttcttttatccttctgccaatttcttcacttaagaaagtaaaaaaaaaaaaaaaagtagatatcaagtcctttacctaggcttaattcttatatatactcctacacacagttttacctctcattgatcattttaaattgaaataattaaactaccttataggacacgggctcacttttctaaccaggtcaggttttgattgcattcattcacaatctttacctgtgcataagcctgctctaatatttatttgtagagatcatctttctttcttaagtttattttgtcatagagttgtatatagttatgagtacattcaactctgtggaatgcagatattatagaaaaggttaagtataaatcactttatatggagtacatcatgaattagatgagcttggatttactagcaactggaagatccttctgtaaagtaaaaaaaaaaaaaaaaacccatcggtcaataaacaaggatttatcaagaattttttgagcacgcattagattactcagttatgaatccaatttcaaagaaatcatccactgatttattgcttttatatggttcagatacttattttgaaaggaagcacacttgtgtttggttttataccagaggagagataggctgatgagtaaatgtgattctctgaaatggtacccctgagaatgtcgtcgggtacgacattggtttcctgctaatgtatcattactgagatgaagtcaagatgtttatttttcaagcagaagttacattctctatcaatatgacattacattatagtgctgctagttcttcagggatatgattgattcctatagtagggtggatataggagccttaggcagtgatgctgtatctcaagtgactaagataagatacaggcagctcactgcacagagagccactagccagtttacctagcatgacttacagagcagttttcaccaacactgtacttagactggcatttttagtcctacttttaaatttgaaaagccaaccagtggtcaatcaggaacacattcaatcccatatatttgtaatatttatcttactttatggcaggaattctaggtttagataactagctattgaaagtgtaatatttggcacaacgatgactcaaatagcctgttccagttactgtgctgaataaaccacttcaaacttattggcacaaaacaaccatcttactatgctcaggaatttgtaaaaggcagagtaggaatgacttgtctctactacatgatgtctgacatattagctcagacgattcaaagacacatgattatttgacagctaggagtcagtcatctgtagacttgtttgtccacatgtctggtgcctaggctaggaaaactctaagactaagactgctcatcagagtgcctacacatagtctttccatgtggcttgacttcctcacagcatggcagcctcagggtagttggattttttatatggtgtcccaagactccaggcccaagtgcaccagtgaacatggcaaggctgcattgccttttatgaactaacattggaagtcatacagtgtcatcttcactgcattctattacttacaagcaaacataagcctgcccagattcaaagggaggggacatagacccctaactctcagtaggaagagcttcaaagtcacaatgaagaaaccatgtgaatgggacatattgttgtggccatctttgacaaatacattttgccacagtccaccctcttcgcacaacaattcacatccctcccacgtgcaaaatatgctcactcccttttccaagaccaccaatattaaatgcacacctacaggaatagtaaaatagaaagctgttttttgttattggtgttttattttattttctgggtaaggggaaataattaatgacctataaaagacttcaatgggtgaaacattgattacaggtattgaactaaaatgtagctcaacctgaagaataggagaagacactttcaaactcttcatccaataagggatcaatatcaaaaatatacaaggagctcaaacaactcaacagcaaaaaatccaaataatccaatttaaaaatggaaaaagtatctgaatagacatttctcaaaagaagacatacaaatgaccaacaggtatatgaaagaatgctgaacatcactagtcatcagagaaaagcaaatcaaaatcacaatgagatatcatctcaccccagttagaatagctattatcaaaaagacaaaaaataacaaatgctagcaaaaatacagaagaaagggaactcttatatactgttggtgggaatgtacattaatacagccattatggaaaacagtatagctcaaaaggctaaaaatagaaataccatataatccagcaatcccaatactggctctatatccaaaggaaaggaaaacagtatgttaaagagatatctgcactcccatatttactgcagcactatttacaaaagacaagacataaaatcaacatacatatccatcaacagataaatggataaagaaaatgtagtgttcatacataatggagtactattcagtcttaaaaaaatcaaatcctgtcattaatagtatggatgagtctggaggacattatgttaagggaaataagtcaggcagaaaaagagaaatactacaatttctcatttttgggagctgaaaaagtagatctcatagaggtagagggtagaatagtggttactagaggaagagaagggtagaaaggagtgaggaatagggacagtttgattaacagatacagaagtacagctacataagaagaacaagtttcagtattctatagcactacagtaaacaataatttattgtatttttttcaaagagctagaagagaggattttgaatgttatcaacacaacacagtgattaagttttgaggtgatttatatactaattaacttgatttgatcattacacattgtacacgtgtattgaaataccacccttacctcataaacatgtacaattatgtgtccattaaaatatatttaaaaatttaaatgtagctcaaaactcaggatctcatcatgtaagtcaaatgaagcatctcaggttaagcattttggatacagttaaaaatgaaaacctgggaactaaagagacaaggtatctgctccacttactcaacagacaatatggagacatacagaggataactgttatagactcttccattcaaaaatagggggaacaagaggcacacagcagtcactagttaacaggaattctgagacctagaaaggtccatgttggaagatccttgtttgggggatatattccttggttgtcctctctagtttttgggtctgctctctggactcttattctgctatttgaaacatctttctttttctataagaaggggcacttgtttgccactgagtaacctttttagtctatttattgtctttaaaagattaggagtctaaagacctcctttcattttatactatctttgttgttttcagtccaaacatacaattccttaaaaactgttgggggcagggctgggcatgttggctcatgcctgtcattccagcattttaggagaccaagatgggaggattgcttgagtccaggagtttgggaccagcctggacaatatagtgagacccccacctctacaaaaaaattagccagacatggtggcacatgacccgtccaccttgggaggctaaggcaggaggatcacttgagtctgggtagtcgaggctgcagtgagctgtgatcatggcactgcacttccagccttggtgacagagtgtgaccctgtctcaaaaaaaaaaaaaaaaaatactgttggggtttatatataaatttataatccacttcattagacaaaagctatactcacaaatattttcaagataaaccctgttttagttaggaggattacgttttagagatgtattgcatagcatggtgactatagttaataataatgtacatttcaaaattgctaaaagaatagattttaagtgttctcaccacaaaaaaatgattagtatgtgaagtaatggatatgttaattaccttgagttaatcattccacaacaaaacactacattatactccataaatatatacaattattatttatcaattataagcccttgttatcttaggctccctgtgagtatgctgtgtggcccaacacccttaatattcgtagaagcttattgtttagaggagacaatctgtaaggcatgttcttatgatccttataagacctattgcctgtctgaaagagcttatcaggtactgctttagatatttctcaggttttaacaaagaatcgtacagtcccaccctgtatatgattttttcccctgaggcctgttctgatttgaggacccttcgcaggctgaaaagacttattctggatcctttacatttcctccaacttctacttggacacttaatggcctgttcttcagttctttgtcctctctcagtttggtatcagcagctaaaagccaagcagcatcctcagtgctctatctggaaatctccttaggtagatgatgaggtttattaagtatattttctattttccatgttaccacaggaaacaatgttggtaaacttttccccatcctccagctttccacagcaattgcctttctttcctcccagtcttccaacaacctccttgagggccttccagcttctgcctgctgcctggtcccaaagataatgccacaacatttcagtttttgatacagcatcaattatctgtgtagctatctattactgcataataaatcatccaacatcttagtggcttaaaacgataacaagcagttcattatctctcacactttctgtgtgttaagaatttgggaagatctcagctaggcagttgtggttcggggtctctcctcttggtgcagtcagacagtaactggggctggaacagctgggagttgggcaggcatcattctttcttcatgtactcacagggcttttccatgtgatttctccacatgggctactttgagttcttcatagcatggtggtctcagggcagtcagacagttgacatggtggctcatggttccaagcacaccaggattggagcttcatcactttttatgacctagacttagaagttacttagtgtcacttccaccaaattctgttgattaggagcaagtcacaagcccacttagactcaagtggaggggatacagaccccatgtctcaatggaaagagtgtcaatgataatactgttaagaaaaaagcatatgggatgggagatattgttgtggctatctttggcaaacacaatataatacagtctgtgacttctatatgacatatggaagcatgcagaggagaaagaagtgggaactgcttctcttctctttgccttgccaacatgccactatgctatccacagaccagtttgagagggccctgcagaatgagtgtaggggatcccaccagctgacctaaaccatggctactccataaagcttcctttggaatacttagctgacatgcagaatgatacttataatttcattttatcctcagcatcagagcaaagatttattctgaatccaaaattatttacaagtattgccttatctgggtaaaacttgaaaagtatttaaaagaataattttaactgtattggctaatggctgattttagcataagtcaccttcagtattttttgtcttgcaaacagtttggggttgaaaagaaagactgccagtcatgcattaaaatataaccaagtgtatgcctccagctgagatctctctgagttacagactgtccattgcaatcaatcacctaccccatgtatctattcgaatgtctcaagtgcacctcaatcgtattattttccccaaacttaatgtgatcctcttttggtgtcttctttctcattgaatggcattaatatccatctagtggtttaagctggaggttaaccttgacaatttccaatccatctctaagacctgttgattgcccctctatgtctctagttggcacattgctctctacctataccaccacccattaaatccaaatcattatcatctctcatctggaccattgctgtagctttgtaacttcttggattcacttttgcgttcctctaggcagtcatccacatggcaaccaaagtgatttatttcaatatgctgatctggttatgtcatgcaatctccattaaaagccagttatggctccccttggttctcaaaataaagcttcatcagacactggtttacagggccctatatgatgtagcccctggttcatttctgaaacattgtctcactccacactccccctgtattccaggcctcagttgcatccctcaattgcagcaaaccctcctatctcagacattgccaaaccctgccttcacctctttaatgcctctcattttttaaatctctaatgaaatatcacttcctaggggaaaagcttctcttatctgtcagattagaccaggaccccatttagtaagctctcatagcatcttataattttccttcagagcccttatcatagttagtaattatgtattcatgtgattactttattgtttcccttcatctcaaggttgcaaactccttgaaggcaagaatcaaatctattttgctctccactggatccccggcacatagcacagtgcctggcatctctgcaagccttttccaaccactcaatctaaaacactcccttctatgccacttgcctaagtctcttaccttaactgtttatttttttccaaagcacccatcattatctgtgtgtgtcttgtgtgtatatgcattcgtatatgtatatgtgtgtatatgtataaatatgtttgtgtgtgtgtataatttgtttacttgttactgtttccccctctagaatgtaaattccaaaaaatcagagacttttgtattcttgttcattgctgtaactctaccacgtacctggcacataataggtactcaataaatatttgttaaaaatgtgagaaataagccaggcatggtggctcacacctgtaatcccagcactttgggaggccgaagcgggtgcatcaccggaagtcaggagtttgagaccagcctggccaaaatggtaaaaccccgtctctactaaaaatacaaaaattagctggacatggtggtgggcacctgtaatcccagctactcgggaggctgaagcaggagaatcacttgaacccaggaggcagaggttgcagtgagatgagatcacaccactgcactccaacctgggtgacaaaagcaaaactctgtctcaaaaaaaaaaaaaaaaaaaaaaaaaacaagaagaagaatggcagttgctcaataaataaatcctggaagtttcttctttaaaaatcaatgataaaaatatgctgcactgagaaagagataatacattgacatgtttttcttttggaaaaattgcctttcacaatctgcccaaaatgacactttgacagttttaattcatttcagcacatgtcattaagcaacaaggggctatatttggtttagtttatttcaactttgttgttctgcaaagctcagtcagattcttcattcataatcttgaatggaagccatttgggatttgataatggaagccatttgggatttgataggggcaaaaacgtacacaaatcaaacccagagactttggaatcagttttagaatcagacagacctggatttgaatctcagcttcaacatttattagcactataactataggaagccacataacttttcttggcctcagtttccccaagaaatatgtgacttgaaagatcaattcagtaacaggactgaccatggttttaagtgaatggtacagactcttaataaatgctatccatttattattcatgtctattcccaaagtacccatgatacaaaggaggaaattgaagccttaacagttgaagaaaatttcccaaggccattcctcttatatccaggtctgtgattaagcatcattcaaccatcatttgcttgggagattttttcagtgaaaacccactgtatttggacacatattgcttcctaagacagactggagagtccattatgtccttgcattgagtgagactcactacaaccttcagttccaactgagaaatttcctgtcccaacagaaaggaggctcagtccaataaaaaaatctgggtgagaaatgcgatggaaagatttttaggagtccttttacttcctcctttctcaagaataaaagaaaaattacaaatatagactctgctaaaatcttttcatctgtaagtgccatgttctttaattatattgaaatcatttgcttatgacaaacaattcactacaatgcaactccagtgagctttaggtcaatttcccatctagacaagaattattctaaacacaggaatgagcaaattttacaataagtaaaactgatgcataaaatacataaaattagataataaatttcaagcaaattgcacagtgccatggcagtgctttatacagcagacgggattaaggagatcttatcaaagtgcgatataaaaattgcatgtgttgaaaccttgactggatgattcattttctgtgagaatttaactaatcagtgaataacaaaagagggtcagctagaagtgcttattgctcagttactaaagatggaagatgatggataattaattgagtttctggctaatcagaagaaatggagaatatatgcctaaaattaattatttccttactggaaggacctaactgagtctacctgtaaatatgctcaactcagctgtggctacagattgttctttattttagtttcagtttatccatgactcaagctcatttcatataggaatcttgtcatattaccataacattttattctgaacctgctagaaaggcaattagtcatttattataacacaaaaaaattcaaattggttgcagttatgttttcagaatcaaaaccatctcctttgatgtgaataccataaagttctatatttaaaaggcattgaatgcatcataatggtaaataagaagacccttaaactagcattcatacctcctgcacataaaaccttaaatggataatttttactcacaacaggtttatttttgtggcagagaattttaaagaattgattaaattagctataactatgctcagaagcataatttgaaatagtgttgaatgaatgaggaaagtattttcaagcatagggaaaaccctcttaaaattcccttttgttcattattcagcaaacatttattaagcccccacagtttgcatgacgatgtacaatataatgagattctaacctgacatccttctattctagctctgttaattgaatgagttaatctttttagctgtccattcacagtatgtgatgaaagactatagaaattaaatgaatgagtcaatctgaaaagacacgtggacatgtatatttaagtttccttttgtgtgctaaaaatagtttactacctacataccctttctatttctttaggggcttcagaatttaaaagaacattatcttactgaggcggtgaactatatgcttaatcatgagtttctaaaggtttatagaggtgagagctgtaatttgcaagattctgcagatacgcaaaggaaaaaaacagcacagtaaatttgagcagataaggagaaaggtattttgaggggttgtttctatttcaatagtaactttagacttaaaaatatagaataggttgtacattttagagatggacatcggaactcatctagaccagtggtttccaacattttacattagagtcactggatctttaaaaaaaatagaccctaagttctcatccccagagactggtctagaaagggctgggaggggaggcaggcatacatgtatttgtaaaagttccccagcagccagagctgaaacccacagatcccagctcagccttgacattattggcatgaggtccctgaggctttgaaagaataagtagcttgcctaaggtcaacacagcttataagccttggagcaggcacagaacagaaatatccaaattcccagagcggatctctctttactaaaccaactggcatcatttctacttcacactggttgagatctaattaccaattagtagtagttgggaagtccaagactgcctataacaagtcccctcctcctaatgacctgtatgtgcttccttttcttgctaagcactgagtaagtcttcagatagttatgaggacactgatgacactgtaataattaatatatccagttattccacattttgaaaggcttcacttatttaaaacttttgcatccataaaatattcatatttttaaggcaaagaaaacaggtttaatatttgaatctgagtcccactttaagtcttcattatcgagtttatataactgagcacatggaagtactccgatgttaggctggattttgtttgctgacttccttatatgataatacctttagtttggccccttccaccagattctgaaagttccatgcagatagagcccttgtccaacttcatcaattgtctcccagcacctagtacaatgcttgtcacagaggcaacactcaacaattaatggttgaattaaaaatcctttattatattttgttaagaaatgagacagagtgcctttagccaacttgtgtaggataatcccatataaataaaagtatggaaagatggctttataaagtagtagttttatagttactttttaaagacctttggtctgatttttgtgatataatggtctgattaaaggttacaactaggccgaggcaggaaaatcacgtgagcccaggagttcaagaccagccttagcaacatagtgggaccccgtctctacaaaaagttaaacaaaaaattagctgggcatggtggctcatacctgtagtcccagctactcaggggtctgaggcgggaggatcacttgagcccaggaggttgagactgcagtgagccgtgatcatgccagttcaccccagcctgggcaacagagtgagactgtctcaaaaaataataataataaaggttataattaattttttattggaagcactaggtgcagtcattaataaaacctactaatgtatcaagcaaatgaggtttctgttttcccacctgattttcctagagatcaaatttacatggcgaaggatgacatggaatatttggcaattattcacacttgctatctctccagctcaaattccaagtcattgccaggttgcaatggaatgttcagccatgtttagggctggcttcaccagagatactgtatcacaatgggcaatgtcgataaatcaaaagcctcaaggactgcgttgaactcttcttcattttcaggctgcatgtatctcccacaaagggaggtggcacctgggtactacactaatttagctaaatgagccacatagaagcaaatctgttctgccttgcaggttctgcagcttcccctctgagcacgtatactataatctaatctacctattctgaagtccttgcaccactctttaaactgttacctgctctttcactccccattttgcacatgatcaagtgtaattaactgaaatagttcttctcaccttccttacctctccagggatctgctgttgaacttacaaaactcatttaagtacacaaggtacaaattgtccttgttgtaccatttgagttttacttaggctgtcattcatattataagtccttcatttagtataccttttatatgtggatgaagacactactgacattcagtaagcattaatgaaataaagttaataccaagtttccttgtcttttgggaaacataaccattattattatctggcaagataaagagtttagtgcctctggtgactcagaggagttgcatgttattgtggaaggcagtaatctagttacagaagaagataattcaattgatggctgtttacagttaagtcatttcaatcccagcttttcaaccccaccttttcaaccccaccgtttgaccccctcctttgacccaaacacatacccagatcccatacatttttctctaaggctatttgtcctttacaccaaggaataaatacaatttttcagacttttatctaatttatgtagaaataatcatacaaatatcactgacatcagctaaaatgacacatttaaatatggtagaaatgattcaccagccaaataatcaatgttaaaaatcaacactggaaaaattaaattattaatgaatatttaatctctgctatataaatgagatgaactagagggctggagggggaacaggtatatatataaggggctcaccttagatgtaacatcaacattaaacctaatgttaatgggggaattgcgctgtgaatgaaccacaatactataggttccttagggccaggcacacagcacaggctcagtaaatgttttctgaatgaatgaatgaatgaatgaatggtcctcttcatagacttacagtgtaacactgggatttggagaactgctttaaaatctctattcatatctagggattaataaactagattttgggaaagtcagtactgaatataatgtaggtgtttctgtttgttaattaattaaaatgaccacagtcattattcttacccttaatttctcagtctgaaaagttaatcaactgtatctgttccatgaataattgagttgaacttgaaagagaactcgctattccaaaagcctcccacaccaccagttaactgtgatttatccttttacttctaaagaattttaagcatcttccatctaacttgactgacaaccaatctgtgcttcctctgtctttattccgtcaggaagaagacgttactcgtgaaagtcgttttaattttagcggttatgggatgggtcactgcctccaagtgaaagatggaacagctgtcaaggccacacctgccaacccactcccacaaccgccaaaagatggagatgctatcaagaagaagtttgtggaccgggcaaaaaggattgacacgatatctcgagctgccttcccattggccttcctcattttcaacatcttttactggatcacatacaagatcattcggcatgaagatgtccacaagaaatagatgtgccctacagaccctgggaccttcttgcctcagtgttgtgcttgtaaatacacagtgaaattgtctttatatcactttgacagaggagaagattgagggaggggggagggagggtcatgggggtgggtttcctggcacctacatgaaaaaaaagacaagttatatgggtgatgaagaaaactgcacaaaattaaggggttgcagaatcacgggagcataataattcccttccataatctttagcattgttctttcagtcagacatgatatgcgcaacattcagacatgatatgcgcatcattcagacatgatatgcggggtcaagttcttaagggctgtttgccttttggtccttttggtttggtttggctttgactaattctggtactgaaaagttagctatacacacacacacacacacacacacacacacacacacacacacacacacacattcaaaaatgcttaaccatctgaccatagtgactagcctatagtgagtcgaggaccaaactttttcaggaaaatgctgcctcgtttttaaaacaagcctcctaagctatgttctttacaatgtctgtaattagtgtttcacttgagaaagccttttgtgggtcgtaaattatttctacttatccagtaaataacaatgacaaaataaacaccaatgacagaaaaatttctactttactgtccatataggtgtgcattttaatatttttctttccaagataaaattttgaaacttaaattgtgtattgtgtaattaatttgatagtgtaccctcttaataaatgcccactttattttatatccaagttagtgcattatatatatatttttgctttggctatatttacacgtgactttaatcgcccaactgtgactagtcattgcagctactcagctacagtatttatggagatggtgtgtcctgaacagtgtagctcaggtcagcttgaactttccatttctgctctcattgtaggtgtaactactagtcctaatgtcaactgacccatgatttctactgtcagtcaatataagtgaacattgttttaaatatccttaactaacttaaagaattttaaaattgtactgtgattttcataacccgttgcctttttggtaccagagctacgtggtttgaattctggctacatgttttaagtaagaaaaaaaaagacgtatttttgcttactcagataaaagacaacctgtaaaaatataataattaaattttacatgtgctgtacaaggggttattttaaaaagcatttgttcaatttcaataaagctaagtgtgccgcaaacttctctagaggctttcgttttcatttttgaattaaaatgtagatatttactttatctcatttttttatttgaaaatttttcttattatactttaagttctgggatacatttgcagaacgtgcaggtttgttacataggtatacacgtgccatggtggttttctgcacccatcaacccatcatctacactaggcatttctcctaatgctatccttcccctagcccccgacccccccgacaggccctggtgtgtgatgttcccctccctgactccatgtgttctcattgttcgactcccacttatgagtgagaacatgcggtgtttgtttttctgttcctgtgttactttgctgagaatggtggtttccagcttcagccatatccctgcaaaggacatgaactcatccttttttatggctgcatagtattccatggtgtatatgtgccacattttctttatccagtctatcattgatgggcatttgggttagttccaagtcttggctattgtaaatagtgctgcaataaatatatgtgtgcatgtatctttatagcagaatgatttataatcctttgggtatataccagtaatgggattgctgggtcaaatggtatttctggttctagatccttgaggaattgccacactgacttccacaatggttgaattaatttacactcccaccaacaatgtaaaagcattcctttttctccacatcttctccagcacctgttgtttcctgactttttaatgatcgctattttaactggtgtgagatggtatcccattgtgat

SEQ ID NO: 17010 - DNA, 45983 bp, Human
  misc_feature (1)...(45983): n = A,T,C or G
agtttttaaaatgctaaagtaaacttctccaaattaaatgttgcatcagtgatggaattatttcacttcctgtcaagatcttatgaatcaatatagatttggtataatagtctttaatttcttacttatctgacatcatagaagattgctaatttgaattgtctcatgaattttcaatttttttttttctgaaacagacaatataaactgaaataagatctattacaaaggtaactttttcctagtctgttcatgggattcttaagtgcacataaccacagaatcaaataataatctaataatattaagccacttaaaaatatagacttgaggccaggcgccatggctcatgcctgtaatcccagcactttgggaggccaacgcaggcagatcacttgaggtcaggagttcaagactagctggccaacatggtgaaaccctgtctctactaaaaatacaaaaattagccggacgtggtggtgtgcaccacgtagtagtgtcccagctactcaggaggctgaggcaggagaatcacttgaagtggcaggcggagatcacgatgagccgagattgcaccactgcactccagcctgggcaacagagcaagactccatctcaaaaaaaaaaaaaaaaaaaaaaaaaaatatatatatatatatatgtgtgtgtgtgtgtgtgtgtgtgtgtatatatatatataaacttgatatcgatgtcatattttaccatttaaccatttcataaaatgatttatttcagtggttcttttggtaggactgtgcattaaatttttgtatacagtaattaacatatactttaatgtcacctgactaccccatttgattaaaaatttttctactttcaacaaatcctgttattggtaaatattttatgttcttaactcgtgaaatagctacgtggaaactaaatttttattctacaataatattaatgtaaaattagatatattgtaaacgttgataaataaacaagtggtaagatattccaattttagagcacacgaaaggaacaaaataactttttcaatttctaatttaaaaagtgatataatgttaatattatctcattcttatattcttatatgatgtaatataaattttaatgatactgtatctataagtctcatgtatgaaattacctaagagaacgatttaaaattgagtataaactgtgttttgacctgtcaaaccatagaacagctggaaatcatcaaccatgctgaactgatcacatgatcttcgtgacacatatagtataagagaaaccaggtactgaaagagaaacctagaaaacacatctggattttgaaaacatggtgtttgtttagtgtttagaacagtatgacatataaataagttgcacatagtagggtgatgttaattatgtttattttcatttttagatcaaattcaaaggtgtttctgtgaaacctagggagaaaggattattttctaagaaagctagaaattttcttgtgtgtgcgtgttgaatttggagagcagttctgatcagaggcacacaactatctgtggtcctccatcatgggtgttccaggtgctctgcctaggtaccagggtacaaagatgcatcagatccaaccccttttctttggagattaaaaaaaaaaacctacctacatcatatttcagatttaatgtgtaatatctctcaatacaaatgaatatagcacaaagagtagctttttaagaatatttcttacaggttacaaaaattatctgctttctgtgggtagttgagtacacatgtactttctcttatacaaaaggtattttgaatgtatagttgaaggaggcattatgttgacagctaagcaaatgctgtaatgttcagaatgaatgttaagatcactgattggtagagtaatttgatgggaaatgacaggctgcatacctgtgtttttctaggcattttttatcagcctttccttatcacagctcatgttctaatgatcattgcaggatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggtaagttctgtttcttttgttcttgctgattttctgtttatggctattgaatggaatcatctttaaatggcacatcacacccactctatacacggcttgaattctataggacagcttcaatttgaggaaccacctaggtccgttttaaacatgtaaatgaaatttctcactaaagtctaagttataatgccctcctgaaaatctaattgtgtaggttatatctatatttctaactatgtccatacaatataaaaagaggactaagtgactaatcgcagtgagcaatgatggttccagaatgttattgttaggtgacttactttttgcatcactgaaatttccattttttttgtgaattgcacaaagtatacattatgatgaaatgcattttgcctctatcatcaatcaaccataaggatgtgaagtttgttcaatttcgttctgtttgaggattacttgcaaacaccaaagtattataaagagtggatagcttcaattctatataattgtaaattcagtagcataaacaaaatagtagaaaacacttctataagctgactttgaaaaagtcaatgattttaatttcagcatacataaatcagactgcagatactgatttcaacacagatttattgatatttgtattatttttattcaatttttaaggaggccagccctcaaggagctcatggtttagttaagggagagtcattcattctatggtataagtcagctataataagcgctgttgcagagcacagataaagttcaacaaagagaggagagtgttggattctgtctgggaaggactacagaaaagtatgagttagatatatcctaattcaaactgagccttgaagaagagatagattcctaggcattctaggcagtaagaaaaaaatcacaaagtgaaatagcatatttttgagaaatgcactgatttgtctagattgtagaaaaaaatgtgtggtggaaagtgatcagagctaaaactgaaaggatcagatggcagaatgatgttggaattcaggaaaccattgtttacatgtaggacaagaataagttacatgagatacaaataaacaatgataaaggagagaatggattaaaaagattaatcaaggaagaattgacataattcagtcacaatagaatgtatctggtaaaggtcaagttgtagacaggaaactagaattttgaatttatgaaataacaaggattattatgcctctattaacaatgaaaggggagcccagaattggagcaggtttgggagaagaaataaaaatgtaatatgtgttgaatttgcagcacaaggaactatctaggtagaggtgttcaggaagaagctggaaatacgagcctcatcggtaaaagatgtgctagaattttagatatggaaattattccatgatgaggtggttgaactcaggagagcaaataagtccaccaaaaaaggctgtgtgtggtaagaaaagaagtggagtgaagaatcataggtattgcattagatactaatagataaataactaatattaatactataatatagataactaatgtattatttattgctgtgtaacagattaacctaaaacttagcagctggtattgcattagatactaatagatagataactgatattaatattataatatagataactaatatattatttattgctgtgtaacaaattaacctaaaacttagaagtagaaaacaaccaatatttactgtctcatttattattatttattgtttaacatttattattatctgttttctggtggtctcggttctttgccacataggcctgtccctagggctgcttgtagcatgacagtgaaccttcctgaatgagtgatccaagggaagaacaaagaaaaaggcacagtttatatcacgaaataacctgttctccaagttcatccagaggcaattctgctttattctgtttcttataagagaatcattaagtccagcccaactcaaggcaaggagaattaggctccaactgaagtagagagtataaaagtatctttgaacatattttagaacaactacactttttttagatgcaaaactgatgaagagtaagttgagtgtcttagaataagaatgaagagcaagtgggtattttagaataagagtgaagacagggtaatgtcatactagcctaggaaaacgaagtttcaaaaaagagggattatttaatagtgcaccttctgcaggacaattaaagaacatgaagaataagagccttaggatttggagttcatggacaggtagactgacagagaagttttaatgaatggtttgaatagatttccagttatacagagcggaagaatatgaagaaataaagttaatttggtgatataaactcacctttttctaagtttggtgttgggaagtgataatagtttgagaaggctaagtagagacaggttttaaaataggaatatgtatattactcttcaaggggggagaggaagaagagttagagacatgtatagatatgaaaaagtgcaaaagacatgtatagatatgaaaagtgatgggaagggattaacccttgtaaaggagaaaaacttttcttcttcctgagactgaaggaaaggaagagataaatggtaacatttcagagaaattttggaatgatcagaatgaagtctgaaggagtgtgtatcaaatgctttaatctccacaaagaagaattccagattatttgttaagaggaattcagtctgggcagtggggccacagtgaaaagaggaacagtgaaaactgaagctttgagaagtttgaaaaaggtttcagacacatgtgtgctttttcatcttatagtctaactccagttactctgctcagcatcctaaatgagctccaagattagatttactttcatgtactatgtaaaagaaaaaatattttatttggcaagaatcattcactatcataatatacatgtaggcttataaatgtcatagtgttagtacatgagcaacttttgtgatgttgttagaactggaatatgtgactagtagaataactaatatgtttttatttgtatcatgtatgaatattttttctttagcattcccaaagattaagcatgggaaagtattttagaaaggcaagaacatacttaacgtcatttatcatgactttccccactactaaaacatctctttttttttttctgaaaagtcctttcaccacatacacatccctcataatttccaaggatttaagtctactacaatttacttttctcttttcaacaaatgcagatgttgaaagctgaaactttaatgagtaataatgtagttggataaaagctgtgaggattaatggtgttgtaaaggtcactcctgaaagaagaattaatgtgtgatgccattattaaaccacagaagactgtggactgaaagatgacttaagttatcgttaatcacatggggctctttgctatatatctattagctacaaatatagaaagtgactttttgaggttggtgaccaatattacagtgtattctataagaatgcttttgatatggtacgcaaatgataggcagctccaaaggaaggagatccttaaaaggtatgaatagttcagaagaatgatggataattttagaatcttttgaccagatgttatctttcccttattggctttttccacctatatcgaacatatgtatagcacttttaacttttttttcaaagcagttttttcatctattttctcactgcagctgttctacaattatagacccttaactagatggagtagatatccatataatctagtcaaagcttgttatttagcagatagggaacacagacctaaagagcctgtgtgtctacctagggatttgaagtaattttttgtcagagcgtagacagttctatgattctatatttattacctcagctttaattttaaggaaataaatgtacataaaaatctagtaacttatccagacttagagccaatggattttggagccttataaccatgatctattggttggtgttcattctttttagttgttgccttttggtagccactctgcattagatgctcttctcggccatttatcattttactcatccatacaataaatgagatttaaatactcttcctttgccatacgttttgcttagtctggaggataagcagacaacagcctttgactgagactttaggtgcctacagtctttttcctagcatatctttgggacatattggaatgtactgttcttagccttcattcctcagaggcattaacgcatgaaaactaaaactatacctgagcaaatgtagtaaatgcaaattgacccagtaaaacaaagggcaatatttccaagtccattaattggctacttgagttgtacaacatgccaggttaagacacgatgacttaaaggaggatattattttgaaagtttgttagtttacatttttattttatttatttattattattattattatttgagacaggaacttactctttctgttgtcccggctggagtgtggtggctggagtgtagtggttggctcactgcaacctccacctcctggactcaaatgatcctcccacctgagcctcccaagtagctaggactacaggcatgtaccaccaaaaatacaaaaatatgaaaatatatatatatatttatatatatttttttttttttttttttgagttggagtcgttgctcagtgagcccaggctggagtgcagtggcgcaatcttggctcactgcaagctccgcctcctgggttcacgccattcccctgtctcagcctccagagtagctgggactataggcacctgccaccacgcccggctaatttttttgaatttttattagggacagggcttcaccatgttatccaggatggtctcgatctcctgacctcgtgatccgcctgcctgggcctcccaaagtgctgggattacaggtgtgagccaccacacccgaccaatttttgtatttttttagagatgggttttctcatgttgtccagtctggcctcatactcctggactcaagggatttgcccacgtcagccccccaaagtgctgggattacaggtatgagtcaccatgcccaggtttttaataagcaaaatttatacaagggttttaatgagaaaaaccttgtttgcaggaaggtgattgaaggaatgaacaagaatattgtgatgcatggaaagccattggattatcaggaagttgtagatatcattcaaagacatctgacaattaacatttgcataacactttacagtttgcaaactgctttcacatgtattatctaattccggtgagctttcacagataaaaaaattgtctacctatcagggtgtcaaaaatgtaatgctgatcaatgaccacaaaaatagaaaaaaatatatttgttgaaaatcactggaaacaaatatgccattacttttacttacaactcctatataaaataaatacgtagtaaataagatttgtgtggcactaatatcatctgttaaattcatgaattttaataaacctgtaccatatggtccaggcttctattgataagaagacagaaattatcaatagatttggaattatcaaggcagatactttcaacttagaatgtgcatttatttcttcaacagatcctgccctgggccaaaggaataatagattgtactaaaaaatgctaagtagtccatagaccactatgaaagacaaatgcaagacaataggacactaaaaacattcacaaggttttgaaggaacacatgtgtgggaagtactaatcttgtcaaagaacatgtgtagggtatgtaagagaagttctcacagaaggggtgatgtttgaataaattcaccaacacaccagaaagaaagagcctttcagcgaaagagaaaaacttgggatacaggagtgtggagtgaaaggatgaaggcctgtccttggaaaagggggaatgttgtgtacagcttaaacgcaggacacatgagagactggcaagaggggacacaggaaagataagcagagttgacatcatgaggagactcttaggccttgtgaaagagtttgggacttatctcagaatgatgattttccaggaacattaaagagtttcaaaagttccagtaaaagctgcatactgtgatctcttgaagactcacaatgcacattaacatattcaggattttaaaaactcatgcaattaaacctttttaactttaattttgtatttcttacacttatacatggaattattttttcatgggctattacaggtcattatttttgaaatgtttcttgaagcactacggtaccagaggagggtttgtaatcagggatgttgacatcaatttttttaaatatacatagatagagagataaatagatatttttatttttgtctttagacagagtcttgctttgtcacccaagctgaagtgcagtggcaggtgaacatggctcattgaagcctctacctcccaggctcaagcagttctctgcctcagccccccaagtagctgggactacaggcaagcaccaccatgctccactaattttttgtgtttttttgtagagatgggatttcaccatgttgcccaggctgattttgaactcctaaggtcaagtgatctactcgcctcagcctcccaaagtgctgggattagaggcatgtgccaccatgcccggcattttttttttttttgagatattcttaaatgctttatctggaaagagaatagacatgaattcaaagagtgtaagcctaaagataggaaaaccagttaggaggccaaggcatagtgagatatcaggtggctttcatgaaagcagaggatggagaagcaaatttgagagcgaggaagaagtgaaactgtcagggtttgcctgccttgtatctttagagggtaaaggagagaccttaaattactcccaagaatcggaagggcaactgacaaggtctatggaatatagaaagaggggactgaggccatggaaagatgatgaattctgtgccagacatgctgcatatcaggtactcatgggacattcaagtagagaagcttagtcaataaacagatacatgtatctggcaatctggaagggtttgaggcaagcagtagttattttacagttcttgggatcatttctcaattcttagagacatggtaaagaccaagggtggcatattggtttcctagagctgccattacaaattactgtaaactgggtgggttgaaacagaaatttattctcttgctattcagggcctagaaatctgaagtcaaggtgtcagcagggtgggttccttctggaagctctgaatgagaacctgttccatgcctccatactgctgacagtcctggctcatagatgcataactccaatctctgcctgcatattcacttggctttctcccctatttctatgggtcaaatctctctcctcttataaggcaaccggttattggatttatggcccagcctaatttcagggtgatctcaccttgagatccttaattacatcttcaaagaccttgttttcaaaagaggccagagtcacagataattaagtttaggacttggatatatcttttgggcagacacaattcaacccattacaagtggttttgtattttattttctttccttgtatagcagccattactactttccttttagagtttatctcctccaaaattagactttctagtttgtcccttcttttctgcctctgaaaaaaatatataaggagactttttagttaagaaaaacagaaattttgagaatatttttggtaatggttaagaagaaacactgaagcataaaacatcaaattgcaggccaggcatggtggctcatgcctgtaatcctagcactttgggaggccaaggcaggagaattgtgtgaatccaggagttctagaccagcctgggcaacatagcaagactccatctctacaaaaacttaaaaagtaactgggggtagtagtgcccatagtcccagctactcaggaggctgaggcagaatgattgcttgagcccagaagttcaaggttgcagtgagctatgatcatgccactgcactccagcctgggtgagaccttgtttcaaaaaaaaaaaaaaaaaaaaaatcaaatcaaattatagtgaatttaacaaagttacagaatctcacaaatttcttacattaatgatttctaacccacattttccaaatctcatttgagatgttaactggaagttatattgacctttgccatctcattttcctcttaagactgaggttcaccaaacctctcctatacacatgccctcccatctgatcctgactttagatgcaattgttgcttgaatctataatgaaggcagaataaaatgtatctatcagataaccattatatgtctctttggcctttatggtctgacgcccatttaactgaacctctgtgcccgccaaggaatgacatcccctcacagatttcatcatgatagtcaaagccatgttaataagagtgctaagagtgaacatatagggaaaatgaaagtgtaaagagtaaagaaaggagtctaacatcttttcctgcctctgcagataccaagtgctatctcttccttcacatgtgttatttcatctaattcttccatcagctttaccttcattttgtagttaagggaagtgaaaacttagattgagcattaaaatttgtcaaatatcacacttaccaagaactggaaatcccagatgcagttgaatccaatttccaaattctgcttattttactatgccattttataaagtgacagttactgaatagctttcattgaccatttattatgataaaagatgatatttactcacttaatcttgacatttctgttatctagtgagtgttatccctatttaacctaagagacaattgcaacttagaacagtaaaacaacttgtgtaatttatatacctagtaagtgtcaaagctaggattttaattcgggcttgcccagctccaaaacacatccttttttaataattggcatcttgaatcaaaatctaaggattaggtgaaggaaggatcccaggcagggataccaacacagaggaggcagtgaggaaaaaggaacaatgctaaaatgagattcaataaagagaggatggtcaatgctgtcattccctctcaagaaatggaaaatgtcctttggatttatttgacaactagagaccaattgcaacagaaacaagattgcactgagaactggagagtaaggagggaatgggagattatgagataatgtatctttgagaagcttgacttcaaagataaaaagagaaacagtgttggaaagagagggcaaaacaaggttaaagaagacactttatttgcttgttttcggagaaaagagaaccttaagtatctacaagttgaggtggtagagatggtagagacaattagatagatgatataaatgagaaatagaattatcaatgaagacatatagaaatctagaactcttattaggagatttgccttgattgaaagcaaggaaccatttttattgaaacaggaggagcaaaataggcataaatggaaataaattaagccagcagaaggtaagagtgagggtagggtcaggaaggtgagagttcagccttgctgctctttgcaaaatcagaggcaaagccatttgctgagggagacggagtcagcagggttaaggatttggtgactatgaggagaacaaactgtaaagaaccagcaaacaatcatattaagattgaatgttgtcatatatacatggctttatgatttaacatagcagatacaaatgttaacatttcatacagcattataactaaaactcaagagtctctaaaagcaagaatgtttattttaaagtgaacagttatttctacctgcacagaaacacacatctcaaattggaaataaccattacagaacataggtctgtcagttactccccctcataataatttacattcctcttgcatctatattaatcatttttcctacacaatgttatcttggcagtccctaaaaagcataaagaattcatgcttttattcagtgccatgtgccaagccatttcaaatatatttgtgttctggagaagctaattagactacatagaagctaaatagactacaaaaatgtatgatgccaggttgcgtataaacaggggttagagcataagaaaatcagactgatcctcttaagatattactaaatgaacatataccaagaccatcacggtcatgtaagagttgtatttctatctagagtaatattgttcatgaacaagttcaagaattatacattaagaatgatgtacaggagatccaaattaggatgttgaggataataaaatacaaccatcttttacagtaaatattaactctgaagatctgttctaggtttagagttgttttcaattcactattgtgtttataatgagcagagatgttttgttctttgaataagttccaatgaatttagctctgaaaggcaaaatatataatcactctcaagcttcccttttctatcgcctacactggaacttttctttctgcctcaaggagatcagaggaccaggtctactctgcgcatactaacaggggaagaggcatggatcatttagaaacctgccagcactgaagtactacatcagtttctgacatcggtttcttcaatagaaacgtttaagcagcaagaacatattctatgttttttggcaatcagcagatcagatagaagagtctagcaatacaacaaggatgtgtaatctgacatgattagacaaggctcttagtaccagaacattcataattgagacaaagagtattaataacactttcctaacacggcagttagccattttatatttcctttctttaatcttagtgtttttcaacaaatcatgggatttaatagcgtgttttggcagattagaggatttatggcccagatgttttttgttctaaaaatggattagggtgtaaagtttgctggaatccatggaacatgttgaggcaagccggtcattttatgtgtgattagtgcctgccttctgtctcacagtccctccatctgtcacaattcaccaatggatctggttagatttagcctcgtgtcacaaacaagtcccttttctgggcagtttcgtattacagattcattttatgccattttatgccctagttaaaagatagggagagagaaagatgagatattagcttttctttaaatatttgcaaaacaatctttttccctcagtactaacgtacgtctaatgtcatgcagatcatcgtactaatatgcatcaaataaataaatgaccagtgttaaaaataaaattaagtaaaaattagttttggttgttacacctgttattttgtaacagcaatattttggtagtgtgtattactaaccatggactgtggagttgcatacataagctgatcatttggccatcttattaagagtgtgaattaagtgtgactatagtcaagagtagccacaatttcttatcaaacaatttacaggtgcttggttacatttctgtgcttgaaatttagcctaactattnnnnnnnnnnnnnnnnnnnngtttatttcaccataaatggatttttaggaagaaaatactcttccgtcaaataatgatttatttcttctgtatataacaaacttaatagtgctatacagaccctcttatgtggcctttctaatactaggagagactcaataatcatagtcataattatgaatacctaaattctgtgctaaaattcaaatgttccttgcaggaaaaaaaattaaaaatgggttttatatttgcactacaaaataatattcgaataataactaaagcatttacttaaaaattaggttttcaacttctttcaaaatagttggaaacaaccatatgtcacttaggtattatatttttattacagatatttgaacatattggaaacatgtttatgtatgactatatggatcagtcattgtcaattattcattcattcattttagataaattccatggagaaatcattataggccagacactacctattaccaagaaaagtgatttttatggttaaacgctagcctagacatgcttttatacaaaagatatcctttgatctgtctcatgttcaggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggtcagttcataaaataacttactttctagaaatacttaattaaattgcctaatgcttttttaaaaaaaatatatttccatcttcttatcatcctcaaaatgattctctgtcccttttctccctccattaatatagaaggcctcatcgccatcctaatcaaaaccatctggaaatagaaagagttataattctcttgatccatctccaaaccttattgacaatgaatatccccttttacgccaccagcttgtattaaaacaaaatggcatttgaaatatctgagtctgactaaaagttttgcttttcagagatgcttaacttgtatttggggatgagctggatttgaaatgctgaatcttctttaatcagcataagcttggatgatatccatgctcatattctaagtatttaggatcctgagcttgtcataatatgtttccagtgcaaaacactgtcaagtgttagatgagttcacaactggaaatttttactttatcataaaacaaaatgtacttattaaaaactttgacgttatttgtattataactaaggccagtgaaacttctgaatttgtctgagagacaatgatttcaagcccttttgtctaagcctacatggtgttttatttagaaaaatattataagttgtaaaatcctcagaattatgtacttttggaatagttgatatgttttgaactgaaattttaaaatgttacccagtgcgctttacagaatcctctagataaattgatccagtagataagagaaaaaatgatcagctacttagcaataactggaaagttaatcataatgggaagcttatgagtcaaacagacttgtccagaatgagcagattgctaatttggatagctttctagtttccaaggttttatgtggagtttgatgtataatcactaagaagctggcaatctgcatagggaaggtgaaatgtatgggtgatcctgccacaactgctctttccctggtcctaatatgataaaaattaaggatggagaaacgatttcaattctatcgtgtgtccaggggagagagcaaaggatagctcagtatacatcccttgcagtgttacaacataagacgtatgacattggtgtcctgagaagggcacatttttatagctaagcaccaaaaggaagggggaaagcaaagtgacagttctaagaaggaatgatagcaagcataaaggaatttatattcaaatatttaaacattcttgaaaggatgcttgaacagaaattccttttctctgctccccacgtagaaatgagtttaacactcagccagatgctaatgcaaagtgactcaagctattcctcgcaagcatagctaaattgccgttatttgttaagcgcattgaattcagctgtggatacagcagttggttgcattcagcaagcatctgtacccttttttttttttttttaatcctccaaagcagagacaactctacctatctcccccttctcttccccagtgctggctgggaattgtcaagtgacaaccgaccaaatccttttggacaggaagccttcatcctgagttctatatacttgcaaagcaggccttgtggttggatcagggagcccattaaaagtactttgatggtatggaaattcatcttcatgaagctcctaggcccctaagcagcgtgctgtttagctgtggttacagatcagtcattcacatcggagggcaataattgcgctgacggcttgtaaggcaatggaagtacatgaaataatcctaggccttccaccatggcactgtgagttaatcttctctaatacagatcagctgttgttctaacacatgactttatgctggcttcagtgactctgcacagccttttgattaagtaacaggagtggaaccatctgcattcactttattccatacttgtccattgttaggggaccttattgccacttctcgttccatctccacagtcatactttatttctctgattagcacctcctacttgggttgcaggagtgagagttgcctccgttgatagctactgcttcaattttcctttctcttttgtacagttataacaactttaaaaaaatccatttttgaaataataccttccaaaacctgttggacagttaagatgtctctgttctcaagatgatcatcattcctgaatctcttcatcatgtactttcaatgcagttgagttacatcttgaactatggtcttataatttaggagtttttaagtgaaaaacttaaattatgaaaatgaagtagtttcatcattgtagtagtatggcaaactcttgtaatataaaaggaaacctcaatcaacggatctgaattatctcatcccttatgttactctgacacctgaaaatgaaattgagattattgaaactctttgaagcaggtattactctagtttgtggttgacttttcctgttgaaataacttgggtgtcatttctagaatattaatgatcaatctatgtctgtgtacatcatgaaaatgagataataatgtcacacttacatcttttaattagtaattattcaacattagcacatgctatgtattagagacggtggtaggtactggaggtattgtattaaacgagaaaatatgagctctgcctttatagaacttacagtttggatcaaattattatctgactgctactcattacatatttatgtgtgtgagcccacctataggaattgaataaagactccatattgcttagcatgtcaaatcagttacatccttgagttgacaaaggtagatatgttttctctcatataaaccacatatctatgcatatagtgttatttttctaatacttatctttttattagagttttataatcactcaatattatctatggccaataaatatgtggattagtaattggtttgaaattttgccatagagtttagtgaaagacataaaaaatatatgataaattcctcttacattttgcactattatcttatatcacttgaatcccaaaagaagggcatttttttctgtctaaagtaatactcccggccaggcacggtgactcaaacgcctgtaatcccagcactttgggaggccgaggcggggggatcacgaggtcaggagctcgagaccagcctggccaacgtggtgaaaccttgtctctactaaagatacaaaaaattacccgggtgtggtggtgcacgcctgtaatcccagctactcaggaggctgaggcaggagaatagcttgaacctggaggcggaggttgcagtgagccgagatcacgccattgtactccagcctgggcgacagggcaagactccatctcaaataataataataataacactcctaactccccaaacccagaaaatatgtgtaaggtaaggagtgagagagataaagcagaaagaaagagggaaaggaactgggagaaaggaaaaaaagaaaagaagttcagccgggtgctttacatcaacataaaagatatcatgacctgagctccagatgattgaaatcttgtggtggagatctgttttcttgggtacacagccttatacacattaacttttcttcatatctcaaatagccagccacgtggttatcccagctagaaggtcttaattctgaaaagctgtaattggacagtgaaaacaattagaggtgtgaagatagggactgatgatttctcagtgatatgtaccaaaacacatcatgaaagtcatttttaccgaaacacattttaatggaagacttctaagagatttttttttaacttctttacttttcctggaagtgtttcatcatacccaagaactgtatgtgtcaggtttcttggaaactctgggacacagtgttatttataattgtcatctctggttaattgtagactgattgtatattcaaataatgttatcttttgccacacagctttgtcacagattagtgttgtgggtgaaaaagtgagcttctcaggtatgaaggaacagaaagaagcctctcatattttgttttgtaaaaaacacactttgcttcattaccacccagatggcacaactttgttcatagagtcaagtacagattcttgagcttgtgtttgaaagtatccatattaataagagattataaaaagctcagtttttgttgtcctgatcccaccagacagtcttaatacaatagaggcccagtgcactcagccgaaatgagaaacagaccagaagcttttccgtttgtgtcactcactccatatatacttaacctgggaagactgtgcctttactgtcatagctgttaggaacgagtttcgctacatgtatcaggaaacctgaatgtagtagcttagatagtgattcatggccgggcacggtggctcacacctctcatcccagcactttgggaggctgaggcaggcggatcacctgaggtcaggagtttgagaccagcctgaccaatacggagaaaccccgtctctactaaaaaatacaaaattagccaggtgtggtggcgcaagcctgtaatcccagctactcaagaggctgaggcaggagaatcacttgaacctgggaggcagaggttgcggtgagccaggatcacgccattgcactccagcctgggcgacaaaagcggaactcctctcaaaaaaataaaaaagtagtgattcatttttatcacataattgaagctcaggactaggaggttggtggcatgagttcatcaacttgatatcagagttgaaatctgtgattctcttgtcttttccctttgggtcacaaaatggttgctgcacctacagctatcccatccccacgaaggcaggcagattcaggaaggagaagtcattttctctttgctaacttcagtcttcattcatacgggggtatttcattcctcttctcaagctgacttccacaaacatctcattggctagaactgggttatatgaacatctttaagaccattactggccaaaggaaaagagactactttaaattgatcatgaattattttttaccactaaattagagagctaatcctgtcttctctgagatcaggggatatcttcagatcaaaggtaatgttagctgggaaggaaagaagggcaatggctactgggtaggaacaggcgattgtcagccacaggcatattacaaaaatgacatcaaagctctcaaatatttccttcatgaaactggtttgttttgtttgtcttataattgttaccatctatctatctttttcccttccactattacatgtccagggtctttttttttttttttttgaggcggagtctcgctctgtcacccaggctggagtgcaatggcgcgatcctggctcactgcaagctccgcctccagggttcaagcgattcctctgcctcaccctcgctagtagctgggactacaggcgtgtgccacaacgcctggctaatttttttgtattttcagtagaggcaaggtttcaccatggtcgccaggatggtctcaatctcctgacctcatgatccgcccgccttggcctcccaaagcgctgggatgacaggcatgagccaatgtgcctggcccatgtccaggttcttataccttgtctggggttcacaaagaattgaatgacacagaagcatgtgcacaagaagacgttgcttgataacaggttaaatctataaacgtatattcacatacacaccgtatacatgttaagaccaacttctgtatttcttttcttatgtaaaacagatgtcactcacaaaaataagcatgcatatgtgtgcatatatctcttaaggcagagaatttattcactgaacattaattgcctacagtgtacctggaatataaacatataatgcatgctatgaattcatctgtcattataaatcatagctggaaaaatgtcttcctttttctgctgagctttagtgaaaattctttgtaattttctgtcaaataagatggaaatttggtaaataacatgtatattttaattaagaatttactcaataatgacagtagtttcatttttgaccctttctgagtcatattcataagaagccttaccacagactatataggctgattgtaagtaaaggttagttttgtttgtctggcacttggaaactcgtccattacaaccacctctttcctgccattgtccaacccttttctttccctttaacagagtgccaaacatgaaatgacagtgaccaatgttgacttaatgtggatgtttaataataaaaaaaagtgtgtcattcccagcattagttacaaatggcagtaagtgtatcggatggcagccctgtaataattttacatccatcattctttcctgatgcttcgctggccatctgatggatggggccagcagtgttaactcttcggaaactgacacagtgtatgtagttcagcattatctaacacatgctccttcccttagataaggagaagggctgtgaggaattgtgaattacaggttttgctttaaaaaagtgaatatgaaggaactcatgcctctccagtcggtggaagttgcttccattaatgatttacggatgggttttataaatgttgcctttagctaaagtgaattataaaagtcaaattagaaatagatatttcaatagctagagaaaaattgtataaaggaagtaggcatgttaggtaaatccttctggaggaaaataagatagacctttgcaacagtgtggtaaagcagattttactaggggtgtgtgtgtttttaaaaaatgttcccaatgttttaaatcctctggttagaatttgcctaagaacaaattaaaataacacaagtgattaatattttctcgttttaaagtgagcgtatattattttttaatctctacatttacatgtaattatttatttggtgactttaattaaaagatacacaaaacctgaagttgaatatttgccttcttattatcagagtctctctaccctgcaaatttatataaaatgaaagggaaacggctttctaggcaactgattattagaaaatctagaccagctttttatgtgcaagttggcatttgatccttaggttttcttttcttttgttttttcattcataaaaccttcttaattctgagtatcttagctagggaacacttcttatgggacaggaggggagaggaaaaccccttagtgaatattatcagcacagagcagccagttttcaaagaccatgacaaaaaggcaaataggtattatgtcatcaccatccatcactctgtatgtcagcctttcaataattccaatcgacattctcgacaggctgatgcaagttaaaggggctgtttgtttttagaaattgagtataggctgtctatagccttttgttctagatggttttcttctgtgtcttttcatttctttctctttatttcttttctttttgggggtatttaattgaaatacatgccgagtctgcagactgcaaagatcagagctgttttcgtccagcagtggtaactatgcattaaacattttgatttgtttgagcttgaagtttagtccttttttgccatttgcttcatggagtttgtgtatatttacagcctctgcatttaatggccacatgccttattttcacagatggccagtggaagactttttctttctcttagtatagcctgctttcagttttgctacatttgtcacagtgccactacttgcagctagcaagtgcccacgcttggtggggagcaattatggtgtgagtttttaaggagctttttaaaggttttttttttttccagtaaactttttatggtttaattttctagcctagaaaagctgtgcatgttttcaaacagagagtcttgtgttctttacatcattctggtagaggggttagtgtaggatggtccaataaaatgagactcatagggcatgccaaattgggcattcagagagacacccacaggcctctctgatgattgaaactgtctatttgtttagggattcgaggatatgctcacaatagtacttctgaaaagataagtttgaaaacaccatgtatagaatgatgttgatttttttaagtatattatttccataatgcatagataaaagactaaaagaatatacaacaaaatggcaacaatagtttagttatgccaaggttatggggttgtaaattttcaaatgtatttccacatttctgaattttctaattttcaataagtaaagtaagactcacttttgttgttgggccagaactgctctttataaaagcctagcctatcaaagagtggtctttcttttcccccttgattctttccttcttctcctcaagatcaaacagctgccctcaagacacttacttacaatgaagacactgaaataataaaggagaagtttgttttgcagttactctctatatttagtagatagattctttattatgtttattgcaagctattttaccaatatggatttaaaactattattaggaaaataggaggaatgtcgcatttatttaaagggtctcattgaatctttccaatcacatctcttctcctcttttaccaataaaaaagacttgcttatgcctatgtcataggagtataacagctattgatatttattttgtaccttaacattttctcatggctttcccatcatattttgttctcactctgtaatgtaaatagaacagtattctttgtttaaaacaattttttaacttgagatttgagaagaatagaggaattcaagtggcagatcagtctttaaattgaagtcttacagctcaaagcccagtctcttttctaacggaatatggagagggaattccagaaagtaacgcagttcctgttcaattcgcctgtgccccagcattggtcatgtgtagcccttggcacatttttgagacttgatcaaaaaaattttgtttaagcaatcaccatctccacaatctgtacatctgttttccaattctttatttttcctgtatttgctccttccttcgttcttcctgtcttcactgcgcaccaaaccccatcactggagaaagaaccaagaaagcaaaaacaatatactcaatcctagttactttgtttctcctagcagctctgataaaacaagtgacgaagtttcagctattcattataaggagatttaaaatatctattctaatatatatttttctctctctgtatttaaaactaccatggatagttgaaaagagaactataaccctgatgtgcctgtttctattgtcagacccagcatttctgaaccaagccatgactctttaaaatggtcagattatatttatttaactgaagtaactactggctactgaggctacatttgtaagaatcctgccagttttatagcttttattccatgaacaggaaaatttgaagaaagtaatcctatatgtttctgtagctcagtaactgagttacccattgtttatagaataattatcatcagacaacattccacttttgtgtttacatttgtgtagccctcccaccaactggacatcctgtgtaggttgcaaattgtattatttttcttagttggcctcctgattttctcacattaacccttctgatttgactcagtatgtataacatgtctgtctgccacggtttggaagaaacacaaccttttctttagatattggctgaagcctgaccatatataaagacatttaaaatcccaggttttgtttttttcccctcctgcctcccttcttccacatgtacacaccataagcaccatgataacaaagaagcaagggcccatattttactgtgatagtattcctgtgtaaagttcttggtgaattgtttgttttctatacattcttttgagtagcttttctgtacattacacatccgggccatagggatttttttcctccctgtggcagcggttttctattttaaggactaaattcataatgttgaatggggacgtgtaagtgtgtctttaacaaagtacctgaatttgtaagtgtaattactgttggacagtctcttcacaaaatatgtctgaaaagcaatcagatttttgtttttttcataatttgaaatgtcttccttgaatttaagaaaagaattatggaattattgattacaaaaccatagctttaagtgttgaaacttattaatgatttttgagaaaattatcttttatgaatagagaaagtataaaaatatgacaaattacacaagaacctgaaaaagagacttcagtggagtggaaagaaaatatcagcgatagttgtctttaaatatcttgcacatctccaggtttaaaaagaatcaaagcctgttttctgtgagatatgtgtcaaaatagttttgttatattgagttcagtcaagtaggacataaaatcatagaattgaaggtttgaaagaaaatgaaaagggcctatcattcaaccttgaattgcttcttcagtatctgtaatatgctaggcaggtagtcgtatgtccaccacttgaaaatctctaggaaggtggaaacttcttccatcctgagacagcccattcaatggataggcagctctgactattagatcactcttccttcactggttcattatctttcacctgataacttacaatctttgatcagtgttctatctcctgactacatatggccaaactctatctctgtttcacaaataacagctgtttattctttttaaacatggaggttcttaagatattttatgtaaagacaatgattgttgattttttcttcctactctactcaaacctttttttttcaggatcctgtgtaatttcttcattatgacaacaaggtttaatggataggaggatgctcaaaaactgagttaaactaagttaagtccaagcaattattatcattgagtttccccggtctgcattccaacacctattaaaaaagaaaatgaggccattataacattagtttagtgaatccataccagcttcctgtcattaccacaacctctaccaagtgctctgaactaatctttataggtagccccatcttttctggagtatacattaagtgctaaagtcatatttcctcaaatttctctcttcataaaaatcaaaattagatatttgtcatcagttttgaaatatccctcccattttaaaatcacttctttgaaaatcattaataaggattcatcagtattatcaagtcattttcatatattgaaaagttattcacctggaccaaaactctcaaatttctacactgtgtgtttctgaaccatcttcgactttgtagtacttcttaagaaaacttgatctgttaatacatttcacttgatcagattgcctgatgaaactaacctactaagaagttgagtcagaattatacaagcaacttttcatgaagcaagctaccaaattttacaaaaggaaattagattctggaacaaaattatgggtttcaattcatgagggaattcagaaagggaaaaaaaaaaatcagtattagataaggcagattttgtggatacctagaccagaggatgtatatggacctttccatcccctgagttcatatctcactataattctcaatggagaaaatgaatagaaaaattttcttcaaggattattaaattccagaataccaaagggtctatggctattctcacggataaattcatacttgatggaggtaaaattagtgacagatctcttcaacatgtacttttgttagagttagaggaaagtgtgtatttgtgtgagtgtgtatgtgtgtgcacacacatatagtttatatatcatttatacataacttacaagaaacccttttctcccattttcggtgttatattatgtgggtagatgattattttctaaaaaaattgagatattaataagcaagagtgaaacgagaggttaaagagtggacatgcgccttatttctttacacttaagctgatgaaaaaaatctccaactgataaatcgttatgacattataagtaatctttcatcttctttggtggtctgtgaggttcacataattggaggnnnnnnnnnnnnnnnnnnnntcgttaatatagtagaagaccataaagaagtgcagccagaagaggtttaactgttactgagtcaacatttgacagtcacactctattctgtcatttcatgcatgtgctttttatgacttttatagctttgtgagctttatttcagggatgtccattatgatagctgatccatagcctatctctttgtgtatgtgtgtctggtggagagcgaagctcatcacttagctgaatcccagtttcagggagtaatagatgacttatctactcacgcactgtttaatttaggattaggtaactaaggaaatatctacctctaaagtacagtttgtgtgttcttttgttttgactgctctgtaaaatatcaacataggatgcctattagaacctttgcaaaaatagtgaattttcagttgttttttattttttttaagtcaaaataatggagcagggaaaatttttcagtttaaatatgtactagacttacagtctggaactgtaactcatcatgcctgagtatgaaattgaaataaaaaacaatgattgaatatattgtaaatgatagacaaagaggggaaatttctgagaatatttagagttgttactaaaattcccttttttagtgcatatttggttatacagaatagagtttataatcataacaggctacttaatactgaaatttaactatttctgtaattctcacatgttagattccctgtcttttcaattttccccactgacattttaaaaataatattaaaagtatatctatcttaaaattttcaaactaatgagaatctaacacatgtttaactatcattttacaaattaggattctgggactcgaggaggataacatatttgtctaaagcagtatggctaatatatacggcagagagtttgattaaaatatgatattcctgatgccaaaactcattattttctaacctcaaaagtgtcctcttcccatgaatccctgtggcctttcgccattcagaatggtttttggcttagaagtatgaattgatactgaccacctccaatcaacaaagtgtccatatctctttagctatttcttggctccccttttagattcccaccatagcctgggattatgtgcaaacagtacacatgctgttttgcattatgcaagtctctggataagtcacagagcacaagaccagctaccaagttccccaagtgaatactaatacgttaataatagttttctgtatgtcagattttggagttactcatttgcacccaggaaaccatgtggtctacaactgtcttctgtcgatgagatacaattcacttcgatcttgtttcaagtcaacataaaatcagaagattttttcaagtctgtttttaaacagacttaacctaatgtttctccttgatctcagcaaacctgcagagttgtaaagatgtgattaggcagataagactcatctttgcaaaggaatctagttgttatcccattgctagtttttattcaagagagaaagcatacaggtcatcttgtttggcccataccccaggacttttacatgttgactactttgttgtaattaatctctttttgccctctattctgacatcattcagcgcatttagaattctggcgagtattcctttaaatgtataaaaatgtaaaaagaaggtaaaggagagaagaccaatcaatcttgtcattttcatatcagcattcctaagtgctgtgctggatttgtgttccagaatggtgacctttaaatgggggaatgggatgctatttttctgcagaaactcttgagtaacatgatttttatcagagccgtgatttttatcagattataagatctatatcaccaacatgatttttatcagattataagatcggtaaaaaattgtcacttgtgcccatcaacatttatttgtttccccaaaatcagtttctttggtgtttcccattttcaacatcttcccacttaaccctctgcttacctgaaatctactgtccttgttttgttccatctgcctctatttagaaaagagtaatttatttataagaaatttgagaatcaaaatattaccttttccagtagtatttgctcttatgaaaaaacacttttagaaaaggaaatatttaacccacagaacagaacctcaaatggttgagctttatacatgatagtgcataggtgaactctttcagagaggggatggctggagacaggtgggattaaaaggatagagtaggagagatttttctagtgtgtcagcacttctgctttataacatttggctgagtctttcccctcctatatgccattcaattgaatttaaacttttgagaactattcttaaatcccattcattcttttggtggttcaatatattacctagacacctaaccacatataaatttatatctacttttatacataagtactatgtgtcagctttataggatcagttgtcatatggaattataggacaattattttttacttaagttattgtctcctcacatcagtttctttttcttctgaatttattgtccacactttttttaaaaaaaatgtggcaacgttatccttttgatttgcatgctgttataatctgttttaattaaaggcatacctcacattctccatttcctgcaatcacctttccttttgcctgttctcatgtctgttagcttaaattactatacaaagggttacgagaaagtacagcttactgtgttgacttccactatgtcccactgacgtcctcttgagaagcatagtaagttttacttttgggtagctaactgaatcattttattaatattgggtgcattagtggtggataattataggttacttattgtaaaaactgagtgtgactttcctgctcatatttgttaattttagtctcttggtaagacagcacagcatctgtagagctgaactcagaaccttggaagtcacttaacgtgtcgttctttttctactttgattaattttgctttttcttcttgaaagactttgcttcagaatggaaaactctctagaaaatgtgtagtattattgccctatactgttaaatcaaaagctaagaggtgatccaagccccgtacattcctcaaagagagtacagtaaagtcttcattgacccgaggactatcagatcatgttgatggaatgtgtgtatgtgtgcgtgtgttttcaaatgtaactgtcttttgttttaacagctacatttactgtaaagaaagtctgttaagctggtgtccttgatgctcctgagctcagctgaatatatacagccgactctctcagcaaaagacatccaaaacatataaagcagctgaaaacaacaacttcacacacaaaacaaatcgagtcagattctacagttttaaatgcgtaacttatttcaactttaatactatttaattctatagaactaaagttaatataaactattttgtctccagtttctctactgtattttatactgattgacaatttaaaaatagttttctattaaataatgtacataatttgatgaatagagtacaggagttccaaggccactgacttaagagattttttaatttagtatgtacagttgtcacattgtcagagacttcattgagataaagcatgtactgtgttaagaatttcaatatctcattagttcttggtgggaacattagttgggccctttacctgtaatacaattatcttacatcattgattactttctgtgaacattttattgtgtcaatagcagttctgcagtgtatgtcgttcactagtatgattcatgactatgttcctcagaaaatgaggtgaataattataaagaaacttgagataatgttatgagatccaatggatgcatttcttaaaactgttttggtgctgtttggtactacatcatcctcagagcagtgctggagagttcacgagaaagttatcaagtttcattatatgctttttctgttcctaaagtcacccagtttcttaatttgacagtaatgtctcatatggtttagattaagcattatatttttcttaaaaataatttattttgaaatgctatgttctccatgaatgtgaatcgtgcactgcatgcttaaacaacttgatgtctctgtagatctaattttggtatatttgtatctcaaataattcgccaactcaatattttggcttagcaatccaaatcaaattgtggtccaagtagcaggcactcacattggatgtacagagacttgacaagcaattagcaatgaatatttaaacgtcttcattacccttgcatgaggaatgcagatggcatttgggaagatggcaaccagagggcactactgtgaattatgtttctattatttggtcacctgactattggaagactttctctgggcttcacgccactcctatacttctactgtctggccaaaaataaagcagacattccaaatgtaaaacaggttgcttccatgaaatttctgtgcacattttgtaatttgggaaggttgtctccaaggatcccggcatatatcccttaggcataccaaacccaaacgccaagactttataggggtctatgagaatcagagttccttcaaaaatcgtgctgatcatccccttaatgacttcaggttaatgtgctgaacgtaaaaaggtgaatatatcaacattgcatcctttccaggagttaatgtattatatatgtggcccaaaaaaagaaagtcttcaaataattttaattcctagactgatctctcattataatttttttaaaggaaaaaacaacactggagagtctgactcagcaactggcagttaaacagaatgaagaaggaaaatttagccatgcaatgatggatttcaatctgagtggagattctgatggtttgtgaaaattgttcatacatattctaataatgcaagaaagtgtctaggtagtgccaattaaaactgctaaaaaatagactagacagccacctcatacctcatcattacaataagaggtcacatatactgagcagtccccatgtgccaagcactctgctgagtgctttgcagaaatcgtctcatttaattcctagtcaacctaggataagtcccattgcagagaaagagcctgagcctcaggagttttgaagcattttccccaggtcacagggctctaagtgtcagaggcaagaattaaattcgagatggcatgattctaaagcaaatgctcaaaatgcttagcttcccaggctcaagtgatcctcccactttagcctcccaagtagctgggattataggtgcatgccaacatgcccagcaattttgttttttttttttgagatgaggacttacttactatggtgtccaggctggtctcaaactcctgggctcaagtgatcctcccacctcagcctcccaaagtgctagttttataggcgtgagttactgcatgcggcctcacttccctatttcttgtacccaaaatgaactttttcagaaatttgtttctattggctcattttttaagtttctatttgtcaagccctcaccagaatacatggctcagaggacatttccacgatagtttcttacattttggaacccttctccctagtgctatgtactacatagtcaagtgtcgggcccactctctataacctaactagaaaccagctgcacagctttatgctcccttctcataggccttcagacttctgttttctgtatcatctctgaacattctaaacatccacagtgacaagaaattaaattgatactctgatttttaatagcatagcaaagagggaaaaagaaggaagtgctgttcttcttatacaataccctgaccgggaacatctctctactgtcaggtggcatccatgcattttaagcattcctttggcagtaccgccctcaactttgttactactacagggaagttccctgcatatagagaagagtgcacaaaggcaaaccagtgagatgcatactttgagagggggtccccttgaatcctccaatatacacaactgtttactctgtgccttgggccaattctacttttaagaccaggtctatactaatcaagggactaaacaaacctgaacgttgaaacacgtaattctatcaaaactgaattttactcaattggattcaatttgcatttttctgggtctaatgttgcaaacattttcttctattttcagctccacttagctaagataaacctagcctatgtacatttaaagagcttgtttagatttgatgaagacacataatgttcattttattgcttatgttgctgtaaggtgtaagaacaagaaaaggcagatgtgcaaatgatcacttgctagttacaaacccattttaggaagatgttgccatatatttgcacttattttgtcaataaaagacaattacgggtaataacacatttcataaattttaagttgtattagcatgataaaatatacccacagtaatcagcattaacacatcaaagtttttgttgctgtcattacctaaattcaatcatgcttgtatgtgaaatattttctacttttcattaaatcaaagagcatgttattaatgaaaaatattgagaaacttcaccaacaggtatgctatgttttgaatgtgctgctatagaggtcttcaagtttgggcaattttgtttgattcctgtgtctccaaatttaaaaataaagaaaagatgaggaatgaatacaaagcaagaaaagaaaagcagtgcttttgttgataatacagtctctacaagtccccaaagtatttttaaagttttggatactatcaaaatacatctacttattttgtgataatacccagtgaaaacctactgtcagagttctactggttctccttattttctctttgcctaaactcaagtatcttggaagcaatttaatctgctgaagccattctaaggggtcacataaggctggaggagtgaatgcagcttccaaagctatcgttgttaactcttgaattgtgttttatcatctgtgaatcttactgattgaaatgtgactgtccatgggactctttggataactttaaatattagggggaaaattcaaaggaaattattatttttctcatcttaaacatgtgactgtagactccttaagaaactagaggaatgtaactgttcatttgttcttttccataccagttttacatatattttggggggcagacctgtcattgctgtatcagcatatgtcatgcatttgtcagcatataatttcaaagaaaagccaattatattacagggaaatacctatattgtttttaacctcaaaatttggtcagtgtttttatttttgtaacctcggagagagaaagagaacataaggtactatatgttcagacagtctttaagtagcaaagatatatcctcccctataatcatccattctgccaaattgatttgtgcttctttacctatttaatgtttctacactactggtatgcctgttgatttaatctgactatcctctttccgaattgcatcaaaaatcacatatcggagtttattttgagctgttgaaagtaaatggtgaaacagtccattgaaagaaagagaaaacagattagaaattggttaaaaatacaaatataacatttgccaccacaaggcttatcagaaaaacttcataaacaagcatctgtcttaagaactggaagtaccattatcagaagtactttttcttttcagatatcttaatagactgaaaaataggaatgcaaggaaaagagctgacaaaagttttaacgctaacacgaagtgatgtttcctgttttcaggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggtaagaaaaccattaagaactaagtgacgtatggaataaaggtactgttctgttttctgcagttgtggaaggatcctggatttggaggccatacaggtcgtgttatttgcttatccagaaaataaacatcatcattgaggcttcttctggtgatgaagcattctatgtccattgagaaatatgccatatttctatagctcatgtagctgtttgtcttcatactaattattttaatgctttatcttcttcaaaaatctagaaatatttttactaaagctgagaaaaaagttgctttcacatgagccactagatattgctactgatcatttgtattcatttccttgcatactatagacaacttactgttaatcttaaggcctccttcctctctcatcatcctctgtaacagaaggataaggagttttatttgcggaattcatcttgttgtgggggtgagggtggaggtggggaagatgtttgttccagtgctataattgaaaatcagttttagattttcagaacacaagaagatgtagagtgtacatttttacatttatacttttagtaaccttaagtactaaaggtacttttagtcatactaaatacttttctgccattgcaacattcaattgaacagaaaacaaagtacgcatttactctacccacacagagactgtagcacacaggaaaaatggttggggagaaagggtgctgattataaagatacctattatagaccaattcaggtcccagggggaaaaagaaaaaaagaagattccattgcttttgtgccttatctgacatcattatcactgtcattgtcattcatcactgtctgatggccagatactagacaacctaagaaaattttgatgattcactctgtgacttctaagagttaagtgacaaaaatagaatagaaacattttatcagaaaatgttggttttaacaaataagtaacaaaatttgtcaaaattattaaagttttattagaattcgtaaggcacttggaattacacggagtttataaaaatagtatcacttttgattcattactgatcatctataaatggcaaacatatgcatgaggttttgttttgcagatggagtctcgctttaccgcccaggctggagtgcagtggtgtgatctcggctcactgcaacctccgcctcccgggttcaagcaattcttctgcctcagcctcctgagtagctcggatgacaggcgcgggacaccatgcccaactaacttttgtattttcgcagagagagggtttcaccattttggccaggctggcctcgaagttctgacctcaggtgatccgcccaccttggcctcccaaagtgctgggattacaggcatgagccaccacgcccggccgtatgtttttatgatcccatattctcaacaaagataatagatgccacctagtccacaaggtgcatttgtaatgggatcaaaacaaaccattagccacttaaaattgtgtctcatttttcacctaaatgttatctaaaaagacatgaacatgcaaagctttcagtagtatacatagaaaatatgaaaatctgtgtgtaaaaatatatatcatgcataatcaaaaacttgaactgatcaagaggaaatacacatttttttacatctctaccagctctgatctatttttcccttttgtgactatattttttgtgactatattctaccttccatgtgaaatttcctatctttaaaaaacaacataccagtttcatttgggaaaactctagaaaagaatactttatgtaagcatatttcatgttttaatatatcagttattcccaaattagaaatccaaaattgtcagaataaaaaccaagttaaatactaagatttcaaaactgtctttatattattcaattcttgtgtctgaataccaaaaaggtgataatcattaattaaaactatcttaactataagagaaatatcagttttgatgataagaaatgatattttaggaaatgtagcaaaagtatctatggaaaagagatgactggctatgagaattcccttctgatttgagggaaagaatattagaatgaccatatgattatattataatagacaacatgaaagagaatactgcctaatttcagtctttctgatgaaaatgtattctttaaagatataacatttatatttaggaacaaataaaacattgaggtattttgggcctcaatatttagtcacagctttaaataaataagtgatcttcaaatatccacaagatcattctaaatgacccatttcatacaaaagtacaaagaaagcttgatgttttcctctttgctgattgttttggataacagcctccgacagcatgccgctaattcattctgcttaaaacaggcgcttgagctgggttgacattttacgtagtctctggggatcctagttgacattttaaagggcttctaagcattttataataccctaaaatctggttttaataagccattctgctgaaattgttaacataaggaatcaccttttactgcttggcgctagatcaggggaagagggacatctttttctgattagatatacagtagtttagttggagtaaaatgtgcaaattcactacagaccccacggagatgacaatgttgcccagcgcaaactcttcactttcagtgtattgccagatttagaaaggaaaggaataatcgttggaccttattttttcccctattttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggccatattttaaagtgtaatttaggattcagtgatactctcaaagaaattatactatcaagagttaaactattttataattcccgttcatgccagatttggaagccaacttatctgagaatttacacatcttttattatcccatttctttacatacacgcatctttttttcctctttttttttttttttaagccagaccagctttctttaagttagtctaactcctctttccaccgaaagacctcaactattatattcttcctcaataggatgctcttctctttgtgagccccacgggagtcatttctacagcaaagccttcctgacctgcagaggattgatcttgcctcatcatattctcttaccttcctgtactttctacaactataaggaaaataataaattttgtaattagatatttaatgtatattccctgactgaatataagctgcaaagagacaggaactataactttctgtattcactcactactatatatttattaaggaatgaatgcaacattatgtacatagtaggaaatatacaaacaaacagctctcgcattccaaggcagattacttctaagcataaacattttctttcctttgagaggccaaagccttttggcgtatagatcatttaaacttagggaagaatctttggcaattccccttctaattgaaaatgcttggccaggagtggtggctcacacctgtaatcccggcactttgggaggccgaaccgggcagatcacgagatcaggagattgacaccatcctggctaacacggtgaaaccccatctccactaaaaatacaaaaaaaaaagctagccgggcgtggtggcgggcgcctgtagtcccagctactcgggaggctgaggcaggagaatggcgtgaatccgggaggtggagcttgcagtgagccgagatcacaccactgcattccagcctgggcgaaagagcaagactctgtctcaaaaaaaaaaaaaaaaaagaaaatgctggtttcgttttcgaattttgggataaagctagctaataaattttatattagatcaaccatccttgatccatttatcagtgtattcctatttgtgagttatttatggtaagctcactttccactccctgatctgaagttcaaaaaactggtataaatgcttggaagaaactcaatgaaaacggttgttctagttcaataggatcataaccatatctgtgtttatataggccctgagaataacataatggtattcaagtatcttcagagaataatgctgggccaacaaggagtttgagattgtccctacaaatgatatggcttgaccaaccaacctaatgttggatgatgctatttaaacagaagtttacgaaaggaatagaaaaagaaactctattatttgcactgtaacctgagtttatactgtaaatagaataaattcacattggctttctagatttggaaaaatctatatttatacctatgcaatacaatatctcttccaatggtaacatttctaagggaagagatattgcctctttcactgtatgctttaataaatgtaacagcccatattgaggaactctttacatgtgtaaggaagaactattcaacagtgagctatttgcatttaagatagggagttacgggtgagtaatgaactcattcgaaagattctaagatcttacttagatgacatttgaaggcaggtataaggccatttggtagggatatcctagttccagtttatcggtctttgtgcattcgcgttgagttgagatgactatttgcagataaacacacttcatctgcaaatagatttttaaatcactattaaaaaaaaaaaaacgctattactactgagggctgccagcacgctgtcacctctcaatccgaacatcagaaggaacaaactccggacacaccgcctttgagaactgtaacactcaccgcgagggtccgcagcttcattcttgaagtcagtgagatcaagaacccaccaattccggacacattaccacttctattacacatagccatactgacagaatccaagttttaaaccatatctaaaatgtgaattagcataaactatttttatttaagcttcaaacttgtcttttttaatcccagctaaattcacaccaaaattaatagtgaaaagaaagggggaaaacaatttgggttattattactaaagcagactgtatcatgggaagtgacgtctttgtatgttattgaaattgatttattaagagaaaatcgtaatacgcatttacagtaattgtgacctctgctatattttgtatagtaggtggccatatgtaggaaagggcatacattatagcacaatttaagttatatcaaatctgagtttgagtcacagatctgtacttcagtaattatgaccctggctaagttagtccatctatttgaatctcaattttctcatctatgaaaatagatagaaatgctgtctcttttataagattgaggtgaaaggtaggaaaaagacatcagtatgtcaaggtttcagcacagtgtctggcacatagtagttacccactccatgtttattaatattataattttaattataattaaatgtttaatcaaaggaatttttaattactaccattcctgtaagcttaaaatacttaaacattttggggaggatgagactacatgatatatgttgggaacttttgtagtaaaaaacatctcccacataaaaatattcaataactagataattagtctcagattcaaaatgcatgataacatatcatgtaacttttctgttcacatgtgaattatatcatgatctaatgtagaaatgagaaatgtatccattaaattatctatgagctttaagggacataatacaaaagtttggctagaatgcaaaccagaaaaaaaaaaatactgcccagtgtttatatctttaggtacaaaaccaccaccacctctgttcttgtgggatctcactaatcaaaaacaggtttatgtatttctgggttttggctaacatctcaactttagattttcttgttctcagccatatcactttctggaatgcttagaagctgtgcaaattggaatcctaacctcctttcttcataggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggtatgtaccttttagtcatttttctcatggggcaaacttcctgttatacttaatgggatgtgaaacatatttgttcagttgcaaaaagacattttgaaaaagaatctgagctcacagtattttcagagacaaatagtctcccacatgatcttgaaaaatatgtccatatgaatccactgcaagttcctagctctaccatgagatttgttaacaactggtttaaaaacaagatatctacaagcaaatgattttgaagttttctattaaaaacttagaagtataactggttcttttcttcattggtttgcattacttcctaagcttcaccatgataaattctaaaactaacaactttgttgagacaatacaaaataaaaatcatttcaaaagcaaaaatacttatttctaaatatagagaggttagtgagctatcaaggtacatgtgtggcctttgtggatcacacaagctagggattatatttagggtgtaacaaggttgggaacaggaggtttcattctgaattgagaacgcagctccgagatgttttacaatgctcccgtggcaaggttgttgacagtgctgtagatgggctacagaaatgcattgcttctatagaattctctcaaaaacccaaaataaagttgttcatatttgaaacagaagttagtttctaagagcttcttagaataataaatattgttctaaatatgggcagagaaggactcataaaacctttccaaatctgctctgtcccctccagttccttggaagaggctgcatgctctgtccagtggtctgtgattcatatgcaagcacatgactcctcacaaagctaaacacaatgcccaacagttcttgggcaaatagtaaacatacgaatgaataaaaacaagcataaatgcacatcatctattcatcctttccaataggaccacctacattatttataggaccagatgcaaaaatgaggagacagggtctcttgttaaaaagttattaagaatttcaagtctgtggcagcacaactttaaaccaagtatgggaccttagtgcagttgcacagtttgtacatccatgaagctgctcctgcttcctaccactacgaggccagaactgtttcagagactcagtggacagtgtgaatttgttcagttctggtgtgttctgggcagtaaagttttattttgagaactctaatgctttaggattttcccattaaaatttaattatctttagatttaattctagggaaaaatactatttctgcatgttataatgaaagaaaaatgaacttggaatcaaggacctgggttcttctgcttcatctttctgcacctcagttttttaataaaacagtagtaacaaacaggattaagaataagatggacaacacatgtcaatatcttgtactctataaagcactacctaaacataaggtattaggcctggtgcggtggctcacgcctgtaatcccaacactttgggaggccgaggcaggtggatcacctgaggtcaggagttcaagaccagcctggccaacatggtgaaaccccgtctgtactaaaaatacaaaagctagccaggtgtggtggcaggcgcctgtattcccagctacttggggggctgaggcaggagaatcgcttgaaccctggagggggaggttgcagtgaggcaagatcacgccattgcactgcagcctaggcaacaggagcgaaactacgtcatctcaaaaaaaaaaaaaaaaaaagaaaagaaaagaaaaacaaggtattaaagttcaagtaggatggagtttgaaaaatgttaggcaattagataaaattagtaccttagaattggacattgctgagcaaattaattatgtagtaaagtccacatctaactattcacttacccacgatgtctttttggaaattcctttcttgacaggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttttaaaaagaaaaaagttttgttttgttttttggggtttctgggttttttccttttctttttctttcctttcattttttttctttgtaatgcacctgacagaaaaaaaagaaaaatgaatttctctttacttctctccaccttctccatctctctactttaaagatggaagtctgtgcatgaggggaaagagggaaaaagagcctgtttttaacttccttgctatccaccacaaaataagcaattattttctttagaggactttatctattgcacaccacactacatctttgagcaagtgccaaatttgtactgaagtgttgaccaagttcattttttctctttactttttccttttccttcttaagttaggacagtgttaaatcttagacaatcccttgaaaaacctgaaataccagcagctggtgagatttgacttttttttttaatggaaactgtaggtgctgttctcaggtgaaaagagagagagagagagagacataagaaatttagagaaaaatattttctgatcttggatttttgtgtgtatgtatgtatgtgattatggtactaataataggaataacgttggaccattgtgagttaaacccacatctggggatgaaatcccacatcctcccaagtgactggtctagaaataatcttgaccttgactttgcacttcaaatgacaacttaaccaagtatagggctcagaaattatatttttaaatgtctgattattattggatggatcaggtggccctgtgtaatagaggtgtgcatgtataacatggaagctactagcaaactgctcccagatgtcctttctccctggtcagttggttccattaacgtttgctacttagtgatttttgtttttcctgttgatattttgagcaaaacaatcattgttttcattgaatatatttggccattttttcagacaaatagaattagcttatttcttcaacattccatcctttcccgatcaggaaatgaaactgatgattttataaggtatttttcacccctccatgaagtgaggtggaggcctttagcatttcagaagtgtgggccatatgtagttcatgccataaaaagtaggatttaattaaaagtcattgcagcccaataaaatggagcctggctgcacccagggatccttgccactgctcttcccttgctgtcagattaatccactgaagtccaactttggttcaagcagagtatttgcaaagagcaacaactgaatgtgatgggactgcttatgtagattttgccagccaaatgccaaggcagttgtagggcctgtacaaataaatgcaaaatcatttcaagtcaattgccattatttgtattgaagtatcagatagatagtaaatactgcaactagtagcttgatgtgctatagttttcactccagtcatcattttcctatctcaccccccgaaacaccaccctaaagttggatttttacatataaataaaaaaagaatcccttttatttttctctctctcagaagacttgctctggggttttgcttggaggagctgatcatatcctgcatgtcagagatttcattttgtttgtttttctgtttgtttgtttttgatgactttatttacatttgaactgcctctttttgctagtgttgtaatgatgatgatgataaaataataataataatagtaataataataataatggtcagctgttcccagattagtaagttatgtataatttattttatttctccctttctattttattctgctctgatttggaagtgcagccaataagctgttagatatttaaaacaaatttccatctccaactcatatatgtgatgtatatgtatatatatatatacatatatatacacacatatacacacacacacacacatttacccacaattttacttctc

SEQ ID NO: 17011 - DNA, 87780 bp, Human
  misc_feature (1)...(87780): n = A,T,C or G
atgcaattcagtccataccagtcatgataaaatatgcagttatttaaacccttagaataaactcaaaattcaccgccattattcactttggatgctaataacagaatgtagacatagagtagctgttgcccagtttcatggtctacttgtcccagtcaacctgaggatagtacagcataaataggtaaatttgtgcttgaccttgtgatcctacatatggcaggctgtcttagtccctttagtgttgctagaaaggaatacccaaagctggataatttagaaatagaaaaggtttttcggcttatggttctgatgtctggaaaagttcaagactgagcatctgcatctgatggtagcctaagactgcttctactcatgccagaaggcaaaggagagctggtgtgtgcagagattacatggccagagaggacgcaaaagaagaaaggaagtgcgacgttctttttaaccagctctggtggaaataaagagaactcatttaccctctccccagggaggacattaatctattcctgaaggaaccacctccatgacccaacactgcccattagtccccacctccaacattggggatcaaatttcaacaggaggtttaggggaacaaacatctaaattacagcacaggccaaccacatgcatgcattaccaatcacgtaaataattttgaagttaaatgcagaaaactgcaaacttttgaggctgatatccagggccaggattaaaataaaaagtattaatgccttaaacagtatttactgaccatctaccctactgcaaggccctagggagaaactgaacagacatggttactgattcaacggagtttacaatctaggtagacatacaggcaaaccatttcaatagctcggatggagaaaacacctgtgctccaaggaaggtacctaactgagcaagcttccctgaggagcgatcctaaactgtgccacaaagatggttaagaagagatgaggcggctgggcgtggtggctcacgcctgtaatcccagcactttgggaggccgaggctggcgaatcacgaggtcaagagatcgagaccatcctggtgaaaccccgtcactgctaaaaatacaaaaacattagctgggcgtggtggtacatgcctgtaatcccagctactcgggaggctgaggcaggagaatagcttgaacccggaggcggaggttgcagtgagccgagatcgtgccactgcactccaccctggcgacagagcgaaactcgtttcaaaaaaaaaaaaaaaagaggcaggttacggcgcgggggcggggaagggggcctgcagcaccggcgaggggaagaaccaacttactgatgcctcagccagtggctggagccctaagaatggacagacctggctccgaaggtcctcttcataacactactgccgccaagaatgtaagctgcccaagcacgaggacacttttagagggccctcagactcagcttcttttggtctgtgcctcaaattaagcacatgtcttacatttctcccaggtcccaattttcaggtctgcttttctttgtttttctttgtcgctccccgctcctaagaaccttcggctgggatgacattcttcaggtgcagaaaccagggggaagctcccagagcagtgggggctgaactcaggacacagtcatttttgctgttaagtctctcctgcggcgctgaggaggcaggctcaaagtaaccaaccagagcagccgcagagggaaaagctaagacagttctggtccggcccagcgcttctcaccctctagctctctactctccgccgcgcagcctccgctccctccacatcaggcacggcgcttgattgacatgagggcccgcccaatcccagtgcggcagagaccgttgtcgcgtcagggaccggggaagggggcgactgaacctatcagattgggtccagagtgggtttcctgcccgcgcggatccgcctgcccaccgcgcgtgccccgcctctctcccaagagctacgcggcggcggcggagcgcaggcctcgtgccgttacggccatcacggcggccgcagtggcgtcctggagccctcctcaggtgagctggagctgcccggctcggcagcgggaaggtgagacggccttgttggcaggcagacacacacacaccccccttcagtccgctgtccgtccatacagcctgttactcgctgcgtcgcttcctcttctcgcgctgagttagccccgggggcgccgtctgcaggctcggagccgagccggagggggcgcggaggctgctcggagggtccagacttctgcaccgggattccgcgagaccctcgggccgttgccccagggagcgtgaccccgcggcctccttgtcagcccctggagcgctgtgtcgggctgagagcccgggcggccgcccgtgcgagcctgggaggtcgagtgtgcggcgcgctggttgacttgtctgttttctcatgaaaaagtccttttgccagctgtggcgtaatccgaggccgggaaggtagggacgtggtaggaggaagggcgctctcacctccagcccgagaggaggggaggcgtcagcctgcgcggtgctgcgggtggacatcttcgggacgcgccctctcccctccccccacccaccggccgttttctagtctggggctgtgactttaatggtctggacctgcttcagattcgtacgcgagttgctggggctgtgaacttttgacttgagttgtaatatgtttggtaaaacaaaaaaccatttcgataggttttgtaacctttcttctgtattaacatacaagttaaattcgccgttagaagctcaggaagctgggttttgttcaggggtgaggacgtaaccgtaggaacgctctcggtgtcaaactgatggacccggagtcacctgaaaataattatgcacgttagattaggtaagaagccctagaaattaggaaagaattaggttaaagagaatttcctaactcctctttgggtagggagcaaagcagctcaatgtcctcccaaaacgggtgttgccaaaaggtactcatttttaaaattttactttgatagacgtatgacaaaccaactataacgatttcttcagcacctggaaaccagtgtgcctagactctcagccttcggcgaggtcacacagtaaacggagaaataacctaagaagaaagttttgtttggtaattgtcaataatattcgttcttttctttttaaaacacttaattttcttgtggggggtggagtctgtgatattcttaaataggcatcccattcacaacttgatagtaatatgcactggttgataaatggtgctttcttttcatcttgaccacaaactctgagacttctttgggaaaattgtgatctgtggaaattggctgtaatatccataaacatagtttgcagagtgttcacatctactcagctgttggctcatgtattaaattttaaaatgtgtacttatttttctaggcattatcttttgtccaggttttgacagtgctttcaggtccatctaaataaaatttgaaacctacgtgtaatgttttgttcgatactgagggagtccaggcggggtagctcaaacctgtaatcccagcactttgggaggctgaggcgggcggatcacgaggtcaggagattgaaaccaccctagcagacacggtgaaaccccgtctctactaaaaatacaaaaaagtagccgggcgtggtggcgggcgcctatagtcccagctactcgggaggctgaggcaggagaatggcgtgaacccgggaggcggagcttgcagtgagccgagatcgcgccactgcactccagcctgggcgacagagcgagactccgtctcaaaaaaataaataaaatgtgtatttatttttctaggcattatcctttgtccaggtttctgcagtgctttcaggtccatctaaataaaatttgaaacctacgtgtaatgttggccgggctcggtggctcacgcctgtaatcccagcactttgggaggccgaggcaggcggatcacgaggtcaggagatcgagaccagcctggccaacacggtgaaaccgcgtctctactgaaaatacaaaaattatccgggcgtggtggcacgcacctgtaatcccagctactcgggagtctgaggcaggagaattgcatgaacccgggagtcggaggttgcagtgagccaagatcgccactgcactccagcctggcaacagagcaagattccgtcacacacacacaaaaaaaaaacagaaacaaaaaaaacctatgtgtaatgttttgttagatactgagggagaccaggcggggtagttcaagcctgtaatcccagcactgggaggccaaggcgggaggatagctggaggccaggagtttgagatcagcctaagcaatgtagtgatacccgtaaataatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttggcaaggctggtctcgaactcctgacctcaagcaatctgcccacctccgcctcccaaagtgctgagattacaggtgtgcgccactgtgcctggcctatattcatttttcaaaaattttctagagttttacattttcattgctttgtacttttactttgtcttattttactttttcaccatgtgtttttcaaagctgaaggtatatttgatgtgattattataaatcacttgtcaggaagacttgacttaatgaatacagatacagttcatttttaaaatcatggtttaataatttttagaatttacctttataatatagaaaaataccaaatgttctttatctgcactagaaaattaaatgattatttcattaataagtaaaattgaagggaacttttgaaatcactgagcagttaacaaattctctataaatactgtgatgttaggaagacaacaaggctaaatatgacatttaaagatttaaggaaactttatgtctggctgatcctcaccttaaactctaatgaagatagaatttatagtcttcccttcaaaactgattccatatgctgactttgttttggtgacattaccatgctttcaattacccagacacaaactttggttttatctctatgcgcgtaacaatattggctgatttttgccagccatttttatctttgaactactcactagcctttaattgggttttttgcttgatttttctctctacttagtatgtcttcctaaatcttagaattatgcttcaaacacatccttcacttttcggaaaccagtgataactctctgttatcttcagagtatagttcagaattcatagcctaataacagtctgctcaaacctgtttttctggggccagcactatttctttctttttttttaatcagtgccagcactatttctttataggagctgtccactctaaccaaaccaatctctgattcttatttactctttgtatttttgtaccttcgtatcattcctttttctttctttctttctttttttttttttgagacagagtctcgctctgttgcccaggctggagtgcaatggtgcgatctcggctccccgtaacctctgcctcccgggttcaagcgattctcctacctcagcctccctagtagctgggactacaggcatgcgccaccatgcctggctaattttgtatttttagtagagacggggtttctccgtgttggtcaggccagtcttaaactcctcacttcaggtgatctacacatctcagcctgccaaagtgctgggattacaggtgtgagccactgtgcctggcctctttctttcttctttttttttttctttgaggcgtctcactctgtcacccaggctggagtgcagtggcaccatcttggctcactgcaacctccgtctccttggttcaagtgattctcctgtgtcagtcttccgagtagctaggattacaggtgcatgccaccacgcctggctaattttgtatttttagtagagatggggtttcaccatgttggccaggctggtcttgaactcccgacctcaggtgatccacatgcgtcggcttcccaaagtgttgggattacaggcgtgagccactgtgcccgtccagtttgcctagtctttaaaattttttttttctcctaaattaccaagtagcaaatgaagtaaaatttgttgaattttcgcttttggtcctttggtgcagtcttccaaatgtttttcctgttccctatgttgcttgcttttctttctttctttctttctttctttctttctttctttctttctttctttctttctttctttctttctttctttctttcctttccttccttccttccttccttccttccttccttccttccttctttctttcttttctttcttttcccttccttccttccttccttccgtccatccatccgtctgtccgtccgtctgtctctctctctctttctttctttcttctttcttttttgacaggatctcgctctgttgctcaggctggagtacagtggcctgatcacagctcctcattgtaacttgaacctcccaaaggccaggattacaggtgtgcatcaatgtctggctaatttttttttttttttttttttgtagagatagggtctcactgtgttgttcagactggttttgaattcctggcctcaaacgatcctcccaccttggcttctcaacgtgctgggattataggggtgagccactgtgcctggtctgttgctttcctttaaacccataccccttattattttagtattcccttggtttttaatgttgtgtggacttgaatcatagaattatagagcattattgctggaatgttggaatccaaccttgtgttttacagataaggaaactgaaatacaaatagactagatgcaccaaaattcaaacatttagtgatgggggcagaacaaagactcaacccttgatcttctgacgcaagttctgtgtgtttatgaaaccatactacttctcatctcttgtaattttgccttatttgcctcacattattttgcattttgtgtatttatgccttctcatagattgaaaacttcagggcaggggaaccttcatatttacattgtaaatttttttttttttgagacagagtttcgcagtttttgccctggctggagtgcagcagcatgatctcggctcactgcaacctccgcctctcgggttcaagcaattctcttgcctcagcctcctgaggagctgggatcacaggcacctgccaccacacctggctaattttgtatttttagtagagatgggtttcaccatgttggccaggctggtctcaaactcctgacctcaggtgatccgctcaccttggcttcccaaagttctggaattacaggcatgagccaccatgcccagccttacattgtaaattatttaaacaatgatataaagtctatatacagtttctttcccctatgcttgttaggtgtattaacaccattaacaaaaataatattgtcatgtttaccattgagttttttttttcttgagacggagtcctgctctgtcactcaggatggagtgcagtggggcaatctcggatcactgtaccctctgcatcccaggttcaagggattctcctgcctcagcctcctaagtagctggaattacaggtgcctgccaccatgcctggctaatttttgtatttttagcagagacagggtttcaccatgttggccaggctgatctccaactcctaacttcagttaatcagcctgctttggcctcccaaagtgctgggattacagggatgagccaccgcacctggccagtgtttaccattgaattctatcatctgctaaaaaatgaatctcttacaggttttactgctgcaatttagtttgtcttttcgaatctcttgataatgccaattaatctttggaggccttgaatgtggatacagaacaatgtaatgatttagaggaaacctggagggcttatcatataactaaatgcagtgatctagctgtaatgttctttttctcttttgagtgttagaactgtaacaccttcacattttgctactttttgtcctcttgttcatctgtcaggaaccatcacttcttgttgagcaagacaagacaaaatatcttgttgaggccgggcgcggtggctcacgtctgtaatcccagcactttgggaggctgaggcatgcggagcccctgagtccaggagtttgagaccagcctggccggcatggtgaaaccccatctctactaaagatataaaaaaatgagcccactgtggtggtgcatgcctgtagtcccagctacccgggaggcagaggcaggagaatggcttgaaccccagaggcagaggttacagtgagccaagatcatgccattccactccggcctgggtaacagagcaagactctgtctcaaaaaaaaaaaaattttatttgttccgctaggcctgatggctcactcctgtaatcccagcgctttgggaggctgaggtgggcggataacttgatcccaggagttcgagaccagcttggccaacatggtgaaaccctgtctctactaaatacaaaaattagctgagtgtgatggcgaatgcctgtaatctcagctactcaagaggttgagacaggagaatcacttaaacccgggaggcaggggttgcggggttgtgagatcccgccactgcactttagcctgggtgacagagcgagattgtctcaaaagaaaaaaaagaaagaaagaaaaatcatttgttccatttggtgagttagagtgcttttatatgtttgttcttcatgtttatttttcctcttaactctaaagtttctgtaacagaaaccatgtatggttgctttcgtatttttcttatgtgtacgtaacaatagttgaatgctgtaagacagcatagaagactatcaggtaaaatctctctgtggagggaaaggaatgcttattctcttggtctgtttttcatttattttttggttgttaatagttgctttttctatttgtttaaattatcagttaaaaaaacctgttaaaacactgattctcttgtttctattcctgaaattgtaagtaatgattgctgaattggacatgaatatggtatggataatttttgcttttgttcaaacagccagttgaataaaacaagcagtgaaaatatgtggaaatatttaaaagaatggatgtttctcaaaagttttttttttttttttttttttaaaagaatcatcctggcccagcgcagtggctcatgcctgtaatcccattgggaggccgaggcaggtggatcgcttgaggtcaggagttcgagaccagcctggccaacatggtgaaaccctgtctctactaataatacaaaatttagctgggcgtggtggtgcatgcctgtaatcccagctacttgggaggctgctgcaggagaatcatttgaacccaggagccagaggttgcagtgagccgagatcatgccactgcactccagcctgggtgacaaggagagacttaatctcaaaaaaaaaaaaattcatccttttcttccaaaaattttagcacgtattttcatatgttagtgtgtagatcaattcaaataatagatacaacaaatactgtaatatgttgtgtaccttgtaattattccagctgtatcgcagaaatattttataaatttaatagggctgggcagttttttttggaaatgcttgatcatttgcaagtactacatgctcttgaataatatattttcatttttagaaacatttagaatatttagtgtacaacccctgtctcccagtaattctgctgcccaaggaaatcagttactttattttttcttttcatttcttagctatagtctttaaaaaaaaaaaaaaaaaaatggcctgtgaggtcttgcatgatttggcttttgtctacgtctcacttcatctcttgcttttgtctctttcctctttcagccttgaatagcttagcccttttttgctttggtgtctgtgatcatgctcttcctcagggcagatggctcctttaggttaatcagcattaagtttggctactagtatcagacagatgccaaatattaatttctctcacaccagagaaatccagggttggcatggcattcatttattaaatgttatttccaggtgtgtgtatgtgttttgctattgtaaattctgcaataaagatctttgtgtataaggctttacattttttttccttttgattaattcctgttgtggatccaactaaaaagcttactaatttttttttaaaaaattgtttagtctgggcatggtggcttatgcttgtaatcctgcactttgggaggctgaggtgggaggatgccttgagggtaggagttagagatcagcctgggcaatatagcaagagccggcctttacaaaagtaaaaaaaaaaaattagccaggtttggctgtgagcgtctgtagtcctagctacttgcaaggctggcgggaggattgcttgagtccaagaggtcgaggctgcagtgagctatgatcgcgccactgtactctagcttgggggacagagcgagacgctgtctaaaaaaaacaaaattaaaaatttgtttagagaaagtatctttaaatgtttattgaaaactgcacaaatttaaatgtatagaatgtttatatttgtagatatctgtgtagtcatcactcaaatccagatgtggaacatttttagtgttcgaaaaggctctcttgcgccccctccaatcagtgtctctttccctctcaaaggtaatcactattctgtcctctatcgccataaactatttttgcctgtttttgaactttatataaatgtaactgatatggtttggctgtgtccccactcaaatctcatcttgaattgttactcccacaattcccacgtgtggttggcagaacctggtgggaggtaattgaaccatgggggtgggcctttctcgtgctgttcttgtgatagtgaataggtcttgtgggatctgatggttttaaaaacgggagtttccctgcacaaactctcttctcttatctgccgccatgtgagaagacatgcctttaaccttgtgccatgattgtgaggcctctcctgccatgtggaactgtaagcccattaaacctctttattttgtaaattgcccagtctcaggtatgtctttatcagcagcatgaaaacagattaatacagtaaattggtaccagtagagtagagtgctcctgaaaagatacccgaaaatgtggaagcaactttggaactgggtaacaggcagaggttggaacagtttgaagggatcagaagaggacaggaaaatgtgggaaagtttggaactttctagacttgttgaatgactttgcccaaaatgctgattgcgatatggaccataaagtccaggctgaggtggtttcagatggagatggggaacttgttgggaactggagcaaaggtgactcttgttatgttttagcaaagaaactggcaacattttgcccctgccctagagatctgtggaactttgaacttgggagagatgatttagggtgtctggtagaaaaaatttctaagcagcaaagcattcaagaagtgacttgggtgctgttaaaggcattcagttttacaagggaggcagagcataagtttggaaaatttgcagcttgacagcgtgatagaaaagaaaatccccttttctgaggagaaattcaagctggctacagaaatttgcataggtaatgaggagctgaatatgaatccccaagacaatggggaaaatgtctgcagggcgtgtcggaggtcttcatggcagcccctcccatcacaggcgtggaagccttggaggaaaaagtggttttgtgagccagacccaatgtccctgtgctatgtgcagcctagggacttggtacccagcattccagctgctccagccgtggctgaaaggggccagcgtagagcttgggctgtggcttcagagggtgcaagccccaagccttggtgttgatgctgcaatgtggtgttgatgctgcaagtgcacagaagtcaagaattggggtttgggaacctccacctgcatttcagaagatgtatggaaatgcttggatgcccaggcagaagtttgcagcaggggtagagcattcgtggagaacctctgctagggcagtgcagaagggaaatgtggggtcagagcccccacacagagttcctactcgggtaccgcctagtggagctgtgagaagagggccaccatcctccagcctccagaatgatagatccactgacagcttgcaccatgcgcctggaaaagctgcagacactcaatgcaagcctgtgaaagcagccaggagagaggctgtactctgcaaaaccacagagtcagaggtgcccaagaccatggaaatccacttcttggatcagcatgacctggatgtgagacatggagtcaaaggagatcattttggagctttaagatttgactgccctgctgtattttggatttgctagaggcctttaacacctttgttctgggcaatttctcccatttggaatggctgtatttacccaattcctgtacccccatcttatctaggaagtaactaccttgcttttgattttacaggctcataggcagaaggggcttgccttgttttggatgagactttggactgtgaacttctaagttaatgctgaaatgagttaagacttcgggggactgttgggaaggcatgattggttttgaaatgtgaagacatgatatttgggaggggccgggggcggaataatatggtttggctgtgtccccacccatatttcatcttgaattgtagctcccacaattcctgtgtgtggtgggaggaacctggtgggaggtaattgaatcgtgggagtgggcctttcctgtgcttttcttgtgatagtgaataagtcttttgagaactgatgatttttaaaaacgggagtttccctgcacaagctctcttgtctgccgccacgtgagacatgcctttcactatgcgccatgattgtgaggcctctccagccacatggaactgtaagtccattaaacctctttcttttgtaaattgttcagtcttcatcagcagcatgaaagtggactaatacagtaaccatatagcttgtatacctttttgtggatggctacttttgcttaacattgtgtttgtgagattcatttatgatgtagagtgcagcagtagttccttttcagtgatagtagtattccattggatgaatataatgtaattttaaaaaattggacatttgattttcagttttttggctattgtgaataaagctattgtcaacattcatttacagttttttacattttttatactttttttgagatagagtcttgctctgtcacccaggctggagtgcagtggtgcgatctcagctcactgcaacttctgcctcccaggttcaagtgattgtcctgcctcagcctcccaagtaggtgagattacaggcacttgccactacacctggctaatttttatatttttagtagagatggggtttcactatgttggctgggcaggctggtctcgaagtcctgacctcaggtgacccgcccaccttggccacccaaagtgctgggattacaggcgtgagccaccacgcccggcccgtttacaggtctttaatgaacttatacactcatttctcctggctgtatatacacattggagtagaattgtgctgtctttatctagcagtttttgaatctgcttgatctggccctctatggctgatacatagtagtttcctggcatttcttcctttctgataaaactagcgactccctttgtctttctcctgtgttaaatcttttttttccctttccatgaatcatatagtgtttttgtttgttttgttttttgtttaacctctccatttgatggagtatatcatacaatagattcctgtggaagactgaaatcttgcattaatgaaaactttttttcatgttcatgcttgatttggttggctaaggattctaggttggaaataatttgccttcagaattctgaaggccttgctgcattgttttctagcttgtcatccttttgagaagtctgaagacattctgattcttgattgtaaaaatgttttgcttttctggaattttgtgtttcctatattctgaaatttcataaggttgtagcttggtgttacgtctatttttaacaatttttcttggatatttgtgtaccttctgaatctgtaaaattcattagttctgggacattttctttaattattttattgacagatgtattagtctttgaggactgtcataacaataccacagtctgctctctgtttgtctgttattggtgtataagaatgcttgtgatttttgcccattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaaatggaaaacaaaaaaaggcagggattgcaatcctagtctctgataaaacagactttaaaccaacaaagatcaaaagagacaaagaaggccattatgtaatggtaaagggatcaattcaacacgaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacatttttttcagcaccacaccacacctattccaaaattgaccacatagttggaagtaaagctctcctcagcaaatataaaagaacagaaattataacaaactatctctcaggccacagtgcaatcaaactagaactcaggattaagaatctcactcaaaaccgctcaactacatggaaactgaacaacctgctcctgaatgactactgggtacataacgaaatgaaggcagaagtaaagatgttctttgaaaccaacgagaacaaagacacaacataccagaatctctgggacgcattcaaagcagtgtgtagagggaaatttatagcactaaatgcccaaaagagaaagcaggaaagatccaaaattgacaccctaacatcacaattaaaagaactagaaaagcaagagcaaacacattcaaaagctagcagaaggcaagaaataactaaaatcagagcagaactgaaagaaatagagacacaaaaaacccttcaaaaaatcaatgaatccaggagctggttttttgaaaggatcaacaaaattgatagaccgctagcaagactaataaagaaaaagagaagaatcaaatagacacaataaaaaatgataaaggggatatcaccaccgatcccacagaaatacaaactaccatactttgttttctagcttggcttttatgaacatccttccgtgtcagtgtatatataaatctaaaggttttttgttttttttttaaaccaaaaaactttgcctattttgtctctgttataaagttcctgattttctttaatagagctgtttctacttttattcctacaaagaatatacgtattttttttaggtggctaaaaacttcatttttttctcatctctagtatgagagtaatacttagtcaaaggatagctgtaaggctacagtgagaatttacgaatcagtgtaactgctaagcagtgtttggtatccatgaagagcctgtctggatctcccttcctgcctaagatcaatttctaaatgtaaaataactggtttcaaagatacagatgtttatttaaaatgttgctgactgttgccaaactgctatttagaaaagacattccaatttacacctttaccacagtgttttttaactctgtgttatcattctttctaatctttgccagcatggtaggcaaaaaatggacaaaactaaaaggagaattagacaaatccataagcataatatgagatatttcagcttgcctctctgagtaattagaataatgagacaaaaatacataaaagatttaaacactataattatcaaatgaatctaattgacatgcattgaatatttcacctaatacctacagaatgcagattgtttttaagtgcctatgaaagtttttcccaaattgacacatgctggacaataaaaaagatcaaaataatcaattcttgagtgttttctgacgtgttggaattaagcaagaaatggattaccaaaaaaactagaaaattgtcagctgtttgaagataagcaatatatttctgagaaattcggggattagagaagaaataacattaaactatttagaacagaaccatgaaaatatagtataacttaaaggatgtgtatagagccatgcttagaggaagagttatagccttcaaatctatacatgagaaagaatgaaggctaaaaataattgaaaggacttctaaataaagatggctgagtgaaagacacatttacttttactccctttgatagcccagcaaggtgacagtaaaggatacttttagaagatttgaactacacaggtaaagagaataaagaaaagacggcaacaataaaatctggaaactggaaagcgagtgaactgatgggaaacttcttagtggacttaaaaatgttcaatcctaagtggcgggagcaaaagtagaaaatacttcttaggctcaggaattggcagcatcaggtatttttggcagggaggaggtgagggtggtgctaaaaacaggaggatttcttgaaaatctgtttaagaagcagctcagtcataatagccccaaagtagaagcaactcagatgtccatcagctgataaatggttacatgtaatgtatatccacacaattaaatactatttggcagtaaaaaggaatatagaactgatacatgttataacatgatgaaccttgaaagcattatgctgtgaaagaagccagtcacaaacgaccacagtattgtatgatacatgctataacacagataaacctttaaaacatgctaagtaggccggacatggtggctcacacctgtaatcccagcactttgggaggccaagacgggcagatcacttgaggtcaggagtttgagaccagcctggccaacatggtgaaaccccatctcaactataaacacacaaattagccggatgtggtggcaggcacctataatcccagttacatgggaggctgaagcaggagagtcgtttgaactggggaggtggaggttacagtgagccaagatagcaacacagcactctagccagggcgacagagtgggattctgtctcaaaaacaaacaaacaaatgtgctaagtatactaaagaccacattgtatgattccatttgtatgaagtatccagaaattgtgtatttgtagagatagagtggttgcataggactgggagtaggggaggttagagggaaatgggaagtgactctagggtatggagtttctttttggggtgacaaaaattttctaaaattcattgtggtaatagttgcacaactctgaatagactaaaacattgaattgtatactttaaatgagtgagttttatgataatctgagttgtatctcaataaagctatttttttttaagaaaggttgagtctagattcctttgttagtttgtatcactaagttactgccttcttgagtaccccagcaagaagactgactattgtttctgacactgagggtgggccctagacacaattggaggtcaagcgttctacagaaaacactgaattaagttaaaatgctcaatattgagaccgttactgaggcctcttctctttggcttccagaattctggcaatcaagtaggaatttggaggatggttctcttactaacccaagaagagaatctgtgttatttacaatagcttttatggccctccttttaaatatgagaagataatcaaggatcaccagacatgtgaagaaagcttctcatataagaaacctcttaaaagaaatagaaaacaaactgggaacaatcagaacaacaaaaaaaaaggctcagtagaacagtcaatagaaaagttgaagttagagtaaaggagttctttcataaagtagaggaaaagatggaaaataaatgagaaaagaaaattaaaaggtccgtcagaggtcaacttccaaataacagaagtactagtagacatcagagaaaagaaggaattatcagtaaaatattcaagaaaaattcccagaatcaaggaacgtgattttgcagaatgagaggctctatgggtatcctggaaaaatgaaagaaaatagatatacgctttcaattaaagcctagtcaggaaaatggagaccacaccaattactgtaacagaatctaaaataaagagttgtttagccagatattatgggttgagttatatcttcctcaaaaagatattttgaattcttaatccctagtacttaagaatgtgaccttatgtgcactattcacaatagcaaagacttggaaccaacccaaatgtccatcaacaatagtctggataaagaaaatgtggcacatgtacaccatggaatactatgcagccataaaaaagaatgagttcatgtcctttgcagggacatggatgaagctggaagccaccattctcagcaaaatatcacaaggacggaaaaccaaacactgcatgagttgaacaatgagaacacatggacacagggaggggaacatcacacattggggcctgttggcgggtgaggggctgggggagggatagcattaggagaaatacttaatgtaaatgacaagttgatgggtgcagcaaaccaacgtggcacgtgtatacctctaacaaacctgcacgttgtgcacatgtaccctagaacttaaagaatattaaaaaaaaaaaaaggctgggcacagtggctcacgcctgtaatcccagcactttgggaggctgagatgggtggatcacgaggtcaggagaatgagaccatcctggctaacacggtgaaaccccgactctactaaaaatacaaaaaaattagccgggtgtggtggtgggcgcctgtagtcccagctagttaggaggctgaggcaggagaatggcgtgaacccgggaggtggagcttgcagtgagccgagatcatgccactgcactccagccggggtgacagagcgagactccgtctcaaaaaaaaaaaaagaatgtgaccttatttcgaagtggggtctttacagaggtaaacaagttaaaatgaggttattagggtggaccctaatccaccatgacttcgggccttttaaaaaagggagagattttgacacagagacagaacaccagggagaagatgactatctacaagccaactaggagggagcctagagcagattcttcctagcatcttcagaaggaacacgttcctgctgaaataccttgatttcagacttctggcctccagaacagtgagaatgtgtttccttgatgttgccacttgatatctcatggatcttgaacttaagacaatcaacaaactttgtttgtttgtttttttgaggcaggttcttgctctgtgacccatgctagagtgcagcctcaatctcctaggttcaagggatcctcatgtttcaacctcccatgtagctaggaccacctaggtgtgtgtgccaccatactagctaattttttgaccctttgtggagatggggttctcacttctttgccctggctggtcttgaactcctggtctcaagcagtccttccacctcagcctcccaaagtgtggggattacgggtgttaggctaccacacccagccaacaaactcttgatcccttcattcttaaagtacactccaggtctgctttctgcgctctaccctacatttgttcattcctgtctttctcatttcattaaatgatattgccatccactcagtagctagaagccaaggtgtcatacttgatacctttcttttcctcattctaactcacatacttccagtccatcagcaaatcctgtcttttctacctccaaatacatcttgaagtcttctgttctttatctgcatcaccatactactcaagtcaagcagccatcatctcttcacttacactattggcctcttattttatttaattttttttgagatggagtctcactctgtcacccaggctggagtgcagtggtgcaatcttggctcactgcaacctctgcctcctgggttcaagcagttcttcttcctcagcctccttagtagctgggactacaggtgcacgccactacgcccggctaatttttgtatttttagtggagacgggatttcaccatattggccaggctggtcttgaactcctgacctcatgatctgcccgcctcggcctcccaagtgctgggattggaggcatgagccaccacgcccagcttctattttttattgtggtaaactgcataagcataaagttgaacatcttaaccattttaagtatacagttcagtattaagtatattcacattgttgtacaaccagtccccagaactttttcatcttgtaaaactgaaactgtatacatactaacaactccccaagtcttccctcctcctagcccctggcaaccactattcttcatgtttctcctttatgtttgtataaatttgtttgctctatgtacctcatataaatggaatcatattgtctttccgtggctggcttatttcacttaatgtcttgaaggttcatccgttttgtagcacatgtcaaaattttcttccttgttaaggctgaataatattccattgcttatatataccacattttgtttatccattcatttgttgatgaacagcttgggttgcttccacattttagctgttaagaatagtgtttccatgaacatgggtgtagaaatatctgttcaggttcctgctttcagttttttgatgtacacccagaagttgaattgctggattatatggtaaactattttttatcttttgaggaaccaccataccattttccatagcagctgcaccattttacattaccaccaaccgtgcataagagttccaatatcattacattttcactaacacttgtttcctgcatgtttttttaaaaatagtagctatcttaatggtgatatctctgtggttttgatttgcatttccataatggctagtgatgatgagcatcttttcatatgcttgttggctatttgtatatatttcgagaaatgtctattttgttcgtttgcccatttttcatttgggttatgtttttgttgagtctgaacaggtctttttatttttacttttgtctgtccatttaactcattcttcacacagcagcacacaacagccagagaaatgtttttaagatttctgcattaatgatacaacaatacctcttacttggcagcataatacaatgaaagtttacattactttcccacatcactgtgtgtgtgtgtgtgtgtgtgtgtgtgtgtgtgtgtgtgtgttgaggggcacctttgctttatgcagtcacttggagcacaggcacctgtatcttatgtcaccaccataatcagctttggcttctcagattgttttggaaggggaagtgtgtgtggagaaagattttagggtccaggctagaagtggcatatatcacttttacccattcagttccattggtcagaactgagtcatgtgatcttatctaattgcaggggtggctgggaagtgtagtatagcagtgtcttaatgaagagaacacagtcattagtgaatactagcagtctctttcacagcgtgtgttggattataatttccttgcttaaaacccttattacatgacttttttaaagacagtctcattctgttgcccaggctggagtgcagtggtgtgatctcagctcactgcaacctccgcctcctgggttcaagcaattcttgtgcctcagcctcccaagtagctgggattacaggcatgcgccaccacacccagctaattttttgtgttttttagtagacacagggtttaccatgttggctaaggctggtctcgtactactggcgtcatgtgatctgtccaccttggcctcccaaagtgctgggattacaggcatgagcccccatgcccagcctacttcttattacatgtagaataaaattggcctgtgtctctcccaacctcacattgtaccacttttgcccttgttctctggccacatctctagccatacggtcattttctgtaacgtgagacttttttttcccctcctggaacctatgtactttgcagtttcttttgcttggagcactctactttaaatatttacatgactgcctcctcttcatccttaaaatgcccacttaaatttttttttctctaactaaaagctgtaattagagtagcactcatattctctgtcctttatggtagcactgtgttaatctttgtcacagcattttttgcaacctataattattttatttgaaaaaatttaatttcctctgctagaaagaggtgtctgtcgtgctcactgttgtatccctgcattaattggccagtgcttaggatacattagtcattcagtagatatgttgttggagggaatctattatatagaaccgactgaaatggagatagttgaattttaaccaagggctcttatgataatttaggtgagttgctgaaggcttgagttttagtgatgtcagtgtaaatggaacagaaaaggatggatgagagacatttcaagagaaaaaccaacacaaattgatgtgtgacttaaggggagcctgggtgaattggaagataatgatttacaattataattaatagattggtaaagaggatagaagagctggatttttggagatgatgcatattcaatttttggagattgatgcatattcaatttgaggtgatagcaagatatttaagtagaaatgttgaggaacagtagcttggattagagaacacaattcaaattacagagtctaggccagaggtgatacgatgaagtcataataatgaacgagctatctagagagagggtatatgtgagaagagcagatggctcagtggaaggaaaatgaggagccagaaatggaaaccagaagcaggtggcgtggagggagggaaaccaatttaatataggggtaaggaaaccagcagtttcaagaaagagggatgattaagttggctgcatccagtagagctatcccttgtcatatgcatttgaaagttctgaaatgttaccttttattaagtagtttgagatcagagggtaccttgggttttatttattctataagaaagtatagcttaatgagaatgatagagtacagctttgagttcttgtcttttctttttttttgaaacacggtcctgctctgtggcccaagctggagtgcagtggtgcaggcttgctcaccgcaacctccgcttcctgggttcaggcgattcttgtgcctcagcctccagagtagctgggattagaggcgtgtggcactatgcccggctaatttctgtatttttagtagagatggggtttcatcatgttggccaggctggtcttgaggtgatccttctgccttggcctcccaaagtgcaggcttgagccaccatgcctgagcttttttttttttctttttttgagagggagtctcactctgttgcccaggttggagtgcagtggcctgatctcagctcactgcaacctctgcctcttgagttcaagggattctcctgcctcagcctcccaagtagctgggattacaggcacctgccaccacaactggctaatttttgtatttttagtagagatggtttttcaccacgttggtcaggctggtcttgaactcctgacctcaagtgatctgcccacctcggcctcccaaagtgttgagattataggtgtgagccactgcgcctgctgaagttcttatgttttagagatatttacttaaatatttatggatgaaaatattttttcaggtatacactgaaatatttacataaatttttagaggtatacaccgaaatatttacagacaaaagttttttgcttcaaaatacttaagcaaggaaacaggaatgggtgagaatatggatattgtggccgtggacaagtggccatgagttgatgattttagctacatgatgggtttaaggggtttgttctcttctttaatgtatgtttgaaattttacataatagaaattataaaaggagggaattgtcttttccagctgtaatctagggcacattacttaacttttttgagacagggtcttgctctgtcacctaggctggagtacagtggcctgataactcttcagctccttacgtagctggaactataggtgcatgccaccatggctggttaatttttgaattttttgtagagacaggattttgccatgttgcccaggctggcctccaactcctgggctcaagtgattcgtctaccttggcctctgaaagtgctgcaattacaggtgtgagccacagcacccagcgtacttaaacctttgaagccttagtttcttcagttaaaaatggtgatattaatactgattgtatcagtttgctgtggtgattaatgacagtgtattaaaactacttagcatacttactctgtgcactcattgtccagtaaatatttctgaagtgaaatacagtgagataatacagttaggcatcaaggttaaggggtttgtagagggagaaaaggttctgggctctttatagcaacctttcataagagatacgttctttttagaatgttataaagttggaatggctaacttaaaagcttccatagacataatatttatttattttggcatgtttttaataggagttttctgatctgaacgtgtacaaaagcagcagtacagtggtatttcatctgttctaaaccacatccttttactgaatgttattccggaagcatttataaggcaggtgcccctttgaaagacattgtcctttaaagtagtttgaaactaaattttcatttaacattaaagtcaaatgagggaatacttaagatggaagcatgggttaataaaattgtattaacactaatttcttagagcacctgacttaaagtatatattttttggtagtaacttggctataggtagtatatagttatccttttttttttcttttgcagtaaaacttggttatggatagtatatacttgtcctttggtatccatgaggtgttggttccaagactccttgcagataccaaaatttgaggatgcttgagtctcttgtgtaaaatggggtactatttacatataacctatgcacattctcctgtatactcgaactcatctctagattacctaatacattgtaaatggtatttaggtagttaatgctatattgtttagggaataatgacaaggaaaaaacgtctgtatatgtttagtacaggtgcttttttttttcctgaatgttttaaatccacggctggttgaattcatagatgcggaacccatagatacagagggccaactgtactaagaaattgctgtcacagtctgtagatgtcatacagttttgtctccagataaatgagagacctgtgaacacaaaggaaactttcttgtatgccttttcattctcatgtttttaaagttcgttcattttttgtttagggaactttaatgagttacttaggcagagtttggaactgtcctgtagttacatgatcagtcttttttttttttttttttcctatctttctttttctttttttctgagacggagttttgctcttattgcccaggctggaatgcaatggcacaatctcatctcactgcaacctccgcctcccaggttcaagcgattcttatgcctcagcctcccaagtagctgggactacaggcaggtgccaccatgcccggctaatttttgtgttattagtagagacggggtttcattatgttggccaggctggtctcgaactcctgacctcaggtgatccacctgctttggcctcccaaagtgctgggattacaggtgtgagccactgcacccagcccctatcttttatattgtgttttatttctttagaaatgaggtttcactgtgttttccagactggagtacagtggctgttcacaggcaccatcataatgctgtgtggcctccaactcttggcctcaaacgatcttcccaccttatcctcttgagtagcggggactacaggagtgcaccgccatgctcagcattttttttctatcttaacataaaatggaaaagttactgttgccttttctcctgataaatagcagcctaagtaagactggtagtttggaataaaggataagttaaaagggcaggaaggtgaggaaagaagtgtttaaaaatgaaggcgagaaggagaaaaagaagttgagagataaagtttatattttcctgtgccttagtatcgacttgcagtgaattagttgaaagttgccttgccagttacatataattggtgacttttaagttatttgtcacctggaacagacataacttctttagcatacaattcagatacaactgtcattgaatttatgtttccataaaattggtggtagaatttttagcattaggtaggagaagaggacagggaaagacagctgtgtctcaggcactgtactgttttacctattttgttaaatcctcacagcaaccctgtaggtaggtgttaactgaagcagagaggttagataacttgctcagtgttacacactgatgataaatgacagagcaagaattcaaactgtaatgtttcggttcttgttatcttttattcatcgcctttattgtttcttttctttctttctttctttctttttttttttttcttttgagatggagtcttgctcttgtcgcccaggctggagtgcaatggcatgatctctgctcactgtaacctccgactcctaggttcaagctattctcctgcctcagcctcccaagttgctgggattacaggcgtctgccagcacgcctggctaatttttgtatttttagtagagacagggtttcgccatgttggccaggctggtctcaaactcctgacctcgtgatctgcctgcctcggcctcccaaagtgctgagattacaggtgtgagccaccgtgcctggccctccttgctttattttatgattccattcagtcattagtcttgtcggtttttaaaaaaaggttttattgagatatgattcacatactatacagttcactcattaaaagtatacaattcagcttttagtatattcagagttgtgcaaccatcaccacaatatcagaattttttttttttttgagacggagtctcgctgtgtcaccagggtggagtgcagtggcaaaatcttggctgactgcaacctctgcctcccaggtttaagtgattctcctgcctcagcctccgcagtagctgggactacagaagcttgccaccatgcccggctaattttttgtatttttagtagagacggggtttcaccatgttggccaggatggtcttgatctcttgacctcgcgagccaccgcacccagccatattggaacactttaatcacctcccaaagcaatgccatactcattagttgtcacccctaacctcccctctccgtgtcctaggaaaccattaatctgccttctgtctctatacatttgctcattctgaacctttcatatacatggaatcatatagtatgtggtcctttgtaaccgctttctttcacttagttcaatgttttttttgttgtttgttttgtttttttcttttttgaggcaaggtttgctctgttgcttggactgtagtgcagtgcttgatcacagctcactgcaacctctgccatccaggcacaagtgatcctcctgcctcagtctcctgagtagctgggactgcaggcatgtgccaccatgccaggctaattttttgattttttttttttttttttttttttttttttgtagagacagtctcactgtgttgcccaggctggttttgaactcctgcgctcaagtgatcttcccatctctgcctcccaaagagctaggattacaggagtgagccactgcacccagcagcttgatgtttctaaggttcatccatgttatagcacatactggtactgtgtctggaattggtgggttcttggtctctctgacttcaagaatgaagccgcggaccctcgcggtgagtgttacagctgttaaggtggcgcgtctggagtttgctccttctgatgttcagatgtgttcggagtttcttccttctggtggaatcgtgatctcgctggtttcaggagtgaagctgtagaccttcgcggcgagtgttacagctcataaaggcagtgtggacccaaagagtaagcagtagcaagatttattgcaaagagcgaaagaacaaagcttccacagtgtggaaggggacccgagcgggttgccactgctggctcgggcagcctgcttttattctcttatctggccccacccacatgctgctgattggtagagctgagtggtctgttttgacagggcactgattggtgcgtttacaatccctgagctaggcccaaagttctccacctccccaccagattagctagatacagaatgttgacacaaaggttctccaagtccccaccagagtagctagctacggagtgtcgattggtgcattcacaaaccctgagctagacgcagggtgctgattggtgtgtttacaaaccttgagctagagacagagtgcccattggtgtatttacaatccctgagctagacataaagattctccaaggccccaccagactcaggagcccagctggcttcacccagtggatcccgcacaggggttgcaggtggagctgcctgccagtcctgcgctgtgtgcccgcactcctgagcccttgggtggtcaatgggattgggcgccctggagcagagggtggtccttgttggggaggctcgggcggcacagcagcccatggggcggggaggctcaggcatggcgggctgcaggtcccgagccctgccccacggggaggcagctgaggcccggcaagaaatcgagcgcagcgctggtgggctggcattgctgggggacccagtacaccctcttcagttgctggcccgggtgctaagccccccactgtccggccggcagggccggccggctgctctgagtgcgtgcggggcctgccaagcccacgcccacccggaactccagctggcccgccagcgttgcacgcagccccagttcccgctggcgcctctccctctacacctccccccaagctgagggagcaggctctgcccttggccagcccagaaaggggctcccacagtgcagtggtgggctgaagggctcctcaagtgctgccaaagtgggagcccaggcagaggaggtgccaagagcgagcgagggctttgaggactgccagcacgctgtcacctctcagtacttcattcctttttattgctgaataatatgtaattttacagttaataccacattttatgcattcatcagtttacaggcatttgagttttttctcccttatgcctattacgagtaatatggctactggcattcatgtacatgtttttaaaaagttattgtggtaagatatgtgtaacataaaatttaccattttaaccatttttaagtgtacagtgataagtatattcacattgttatgcagccatcaccaccacctgtttgcataagtttttcatttttgccacctgaaactctgtacccattaaacaacaactcccaagtctgccatccccccaacctctggcaatcaccattctactttctatctctatgaatttgacaactcctggaaccatgtgtaagtgaaataaatcatacaatatttgtcctttatgactggcttatttcactgagtatagtgtcttcaaggtttattcacattgtagcatgtgtctaaagttcctccccgaccaaaggctggtactgttccgttgaatctatatttaccacatgttgtttactcattcaactgatgacagacactgaggtggagttttgctcttgttgcccaggctggagtgcagtggcacgatctcggctcatttgcaacctccgcctcctgggttcaagtaattctcctgcctcagcctcccaagtagctggaattccaggcatgggccaccatgcctggttaattttgtatttttaatagagatgggggtttcgccatgttggtcaggctggtcttgaactcctgacctcaggtgatctacccgcctcagcctcccaaagtgctgggattacaggcatgagccaccacgcctggcctgatcatggacactttggttgcttccactttttggctgttgtgaataatgccaatatgaacatgggtgtacaagtatctatttgagttctcacttttacttcttttgggtttgtatccataagtgaaattgctggattgtatggtaattttgtttctaattttttgaagaactgccatatgggtttccacagtggctgtaccatcttatcttcccaccagcagtgcacaagggttctaattttctacattttcaccaacacttgttattttctgtcatcatcatttttttaataataaccatggtgatggttgtgaggtggtattattgtggttttgatttggatttttctaagggatggtgatatgatcatcttttcatgtgcttattcactgtttgcatatcttctttggagaagtgtctattcaattcctactccatttttgtgttggatttttattttattctttttagagacaaagtctcactgtatcactcaggctggaatagagtgacataatcatggctcattgcaatctcatcctcctgggctcaagggatcctcctgtctcagcctcctgagtagctaggactataggtgcatgccactgcttggctcatttatttattttttgtagagatggggatctcactatgttgcccaagcaggtcttgaacttttagcctcaagggatcctcctgtctcagcctcccaaagtgttgggattataggtgtgagtcaccacacccagctggattttgttgttgttgttgttgttgtttttgacttgtaagagttctttatatattctgaatatcagtgtcctatcagatgtgatttccaaatattcctttctgtgggttaccttttcactgtattaatttagtgtcctttcatatacaaagtatgttaaaaagatcttaattttgatgaagtccagtttgactcttttcggttgcctgtgctactgatgtcctggattatctgagtgggctctggtaatcacaagagtccttatcagagggaatcaattagtccaggaaagggatgtgatgctgaaagcagaaatcttgatgatgtggccaagtgcaaaggaatataagcagcttctaggagctggaatagacaaagaacagattcttctctagagccttctgaaggaatgcaggctttgattgtagctttgtaatctactccatccaggctgctgcaaatgccaaacaggcctgtaagacctgttttagacttaatgacctctagaactgtgagatcacaaatttgtgttgttttaagccactattgttacacagcattaggcaattaatacaactagaatcaaaggagagactgagagcatgaagattatacatgagacttttaaaatactttatttcagtaggtttttggggaaccgatggtgtttgattacatgagtaagttctttagtggtgatttctgagattggtacaaccatcacccaacagcaatgtacactgtacccaatgtgtagtcttttatccctcacgccaccacccttatcattcatatgcttttgcgtcctcatagctttgctcccacttatgaatggagaatatacgatgtttggttttccattcctgagttacttcagttagaataatggtctccagttccatccaggctgctgcaaatgccattattttgtttctttttatggctaagtaatattccatagtgtgtgtgtgtgtgtgtgtgtgtgtgtgtgtgtgtgtatatatatatatacacacatgtgcaagtatctttttcgtataataacttcttctcctctgggtagatacccaggagtgggattgctcgatctactttcagttctttaaggaatctgcgccatccacgtcaacatctattttttgattttttgattgtggccattcttgcaggagtaaggtggtactgcattgtggttttgatttgcatttccctggtaattagtgatgttgaacattttttcatatgttggccatttgtgtatcttcgtttgagaattgtctattcacgtccttaggctgttttttgatgggattgtttttttcttgctgatctgagttccttgtagattctggatattagtcctttgtcagatgtatagatggtgaagattttctcccactctgtgggttgtttactctgctgattgtgtcttttgctgtgcagaagctttttagtttaagtcccatctctttatctttgtttttgaggcatgagacttttgatagaatctacatcttgctttgctcagattggcttaaaccctacattgattctaatccatcaccaagtcttgacatcttccatggaaatttgagaagggttagtgatataagccagtggtacctgctactgcaactggtattgaggcaggaattactattcatcattaccttcttttactacctattctagatttcctttatgctgggccagcatttaagctggtttaagttgcttctgtcctttaggctttcatccttgtgggacttgagcctttagttgccttgcctgttttgagccatggttgctgtaatttcctgtttaccctattagcaagcatggaaataccctgcattccagacagattgctccctaatctcattgtgtacaacaggtcctaataatcagggtcatttatcactgctagtatatttattcctttctttgcctgctcgttcatcagtatgagaagcccatagtgaccaagtggtggttgtggctttaggctccgtgaacccctactgtggaagcattaccctcaggatctctagtacagcagagattttaaattgtggggataggaaatccacatgccataagtgagttactgggagtgatggtgaagagtcaatctaacttctctaccccttggtttctaaacccgtgcatctcaggtagtagggatataataccctagccattggttcagtgcatatgctgcatcccaaatgaccagcagaatgacttcttaatcgagcttttaatttaatgcaccactttatgattttgttagccggacagtttctaggtgatgtggtatgtggtgtaggaccagtggatgccatggtcatgtgcttaatgttgtatcttcttcaccattaaacgagtcctttagtttgaggtgatgttaaagtgaatcccagattggcaaagcaaacattttgaaaccattgaggtactgtaaatgtccagagacactcagggcaggaaaggcaaactcatttctacagtaagtgtaaatcctacttcccctggaatgcaaaggttccaattccatcctgccacctgctcagttctgtgtctgataagttgtttcctgcattctgctgtgatcctaaattttgctagattttttaaatcttattagtacttttaattatatttttcagaaataagctgatttttttgttttgttttgttttttttttgagatggagtttcactcttgttgcccaggctagagtgcagtggcactactatctcggctcactgcaacctccacctcctgggttcaagcagttctcctgcctcagcctcccaagtagctgggattacaggcatgtgccaccaagcccagctaattttgtatttttagtaaagacagggtttctccatcttggtcaggctggtctcgaactcctgacctcaggttatccacccgcctcggcctcccaaagtgctaggattataggcatgagccactgcgcccagcaagctgattttttttgataatagggatgtgataaacagttttcactttaacgtagtcaactatatgattccatttgtatggaattcaagaaaaggcaaactgatgatagatgtgtataaggctttggtatgtttttggtttattttattatatatatatatcatgtttccgtaccttttaatgttgcaataaaattgttttgtctgacattaaaattgccataccaccttttttaaaaaattgccataccaccttttttaaaaaattgccataccacctttttaaaaaaaaggtttgtcagaatttatttttttcatcttttctctgttaatgttttagttcacttttataaacagctttagttgaatttgtatgttgtttttattttattttatattatttattttttgagatggagtcccactctgttgcccaggctggagtgcagtggcacaatctcggctcactgcaacctctgcttcctgtgttcaagtggttcttgtgccacagcctcccgggtagctgggattacaggtgcgtaccaccacaccccgctaatttttgcatttttagtagagacagggttttgctatgttgaccaggctgatctctaactcctgacctcaggtgatcctcccaccttggcctcccaaagtgctgggattacaggtatgagccaccatgcccagtctgtatgttatttttgttattttctgttacaaatgagttaaattcattcacatctattttaattatgatatatctggatttttgtcatcttgctttgtttgccatcctttttctttgcttctcttctcctttcctgttttttgttttttattgatatataatattttacatatttacgaggcacatgtgacattttgttacataggatgtgtaatgatcaagtcagggtatttgggatatctatcaccttgagtatttatcatttctatgtgttgggaacatttaaagtcctctcttctatctactttgaaatacacagttttgctagctatagtcaccttagtctgctatagaatattagaatttttatactttttctttaacaatatgtttgtgtacattgagcaacctcttttcattacctaccacccatgtacccttctcagattttggtgtctgtcattctactgtctacctccatgagatcatcttttaaacccactgaatgagttagaacatactatatttgtctttctagtcctggcttatttcacttaacatagtgacctccaggtccatccatgttgctgcaaatgacatgatttcattattttttaatggccaaatagtatcccattgtgtatatatgccacatatgtccattaatctgtttttgttttgttttgtttttaaaggcagggtctcactctgtcacccaggctggagtgcagtggtgcaatcatggctcactgcagtgagtagccgggaccacaagcataccccaccacacctggctaattaaaaaagaattttttttgtagaaatgggggtctcactatgttgcccaaactggtctcaaattcctgggctcaagcagtcctcctgcctcggcctcccagagtgctaggattacagacctagcactgtgcctggccccatacatctgttgatgaacacttaggttgattacatatatttgctattgtgaatagtgctacagtaaacatgcaagtgcaggtatccctttgatatactgatttcttttcctatggataactacccagtagtgggattgctggatcttgtggtagttctgttttcaattttttgagaaatttttgtaggtttccaaaaagtatgtactaatttacattcttaccaacactgtataagagttccctttttttctacatccttaccagtgtctttttttcttttgttttacttttatttattattttgagacagaatctcactccctgtcacctaggctggagtgcagtggtgtgatcttagctcactgcaacctctgcctcccaggttcaagtgattctcctgtctcagcctcccaagtagctgggattacaggtatgtgccaccatgctcggctaattttttgtatttttagtagagatggggttttgcaaagtgttggccaggttggtctgaaactcctgacctcaagtgatctgcctgccttggcctcccagagtgctgagattacagacatgagctaccacacctggccttttttgttatttaaataacagccattttaacttggctgaaatgatatttcatgtggtttttatttgcatttccttaatgattagtgatgttgagcattttttcatatacttgtttgccatttgtatgcctttctttgaaaaatatctattcatgtccttagcctacttttaaatgggattattggtggggtttttgtttttgttgtttgagttccttgtatattctaggtattagtcacttgttgaatagttcgcacatattttctcccattcagcagattgtctcttcaccctttttttagacaaatgctcactttaatcacagttctaaattaattattttcacgttaacatagatgttcccataaactgagaagaactgagctaagtattatacatttttaatggttaatatgatttgaaaattttttataaaaattgatcagaagctagttgaaattctcaccataaatataaaatattgattacaattgtttttcacagtaaattgagatctgagcttcctaaaaagctgtattatctaatatcataatagggatgactaaatacttgacaactactttctgaagactggcttaacaaaaagttactatttgaagaaacagctttcccttgtttatatttacaagaaaaaggctaacatttttgcagaactctcattttatcatgaagtgtggacagtcagaagcaggtggctgttggtggggtgcagtggctcacacctgtaatcccagcactttgggaggccaaggcaggcagatcacttgaggtcaggagttcaagaccagcctggccaacatggtgaaaccctgtctctactaaaaatacaaaaactagctgggtatggtggtgattgcctgtgatcccacctattcggggaggctgaggcatgagaatcacttgaacccgggaggcggaggttccagtgagctgagatcgtgccagcctgggtgataggcaagactccctctcaaaaaaaaaaaaaaaaaaaggtggatgcagtggtatcaagaaaaaagcatttcaaaacatttccacttttattaaaggttttgacaatgaagatatcactaaatgtcttcaaattctatttgttatagaataaccatctaaataggagacacatgccataatacagcaaccattttagtgtgtaaaatacttctgaactcttactatgaaaaaatttggctaaaatacaaaacatctttgcaataaaactgataatatagcttaagtagcttataagatttcagaaatgtcttatgaaagaaatgagaatgtttccctgtgcgagataaaactgaacggttaacgttaaggtgctataaactagacaaagctggaaaggcacatcatgtaactagaaaagaacggcatgtgatgtggacttcctccatgtcaaactgacaggaaaatagaatatgctcttcagaaggaaaggcatgagaagataattcttacaaagctctcattgagatcttgaagagctttacagagaacataatcataaaatggctagagatcatttataggacatggtaatggattcctttgtattacaatacctgcctcagatataaacacaaatcaaatataaacacccttgtaaagctgtgcttctttcagccaaacatttctctggtaccacagtcagcctctagtagcatttggatgcaaaggtttaactggtgctgatctggacaagccacagcagagactctgatttggagacttcatggacactcctgccagtgcgctgctgctattgctgctacttccagatgctggtagaaccatttaggtctcttgctttcagctgaaggactgcatatttgtaatggtttcctagtggcatctgaagaaagataaatctcttttggcgaggactgagattctgatttgatggcagccagagcagtctaccaaagtcactaaagcattacatttggatttaggttccttctctttcttttctactggggattttaccttcatttcttttcttttttttttttttaaatttctttaactttactttttctcatagaggagtctttgtcattatcctcactctcaccaaaatcagaatcatcctcagaatcttcaccagttgccaagtctggtttggtgttattagcactattgccatcactgccttccagaaaaattttcctctgttgtaccgcagctttagatgctgcttttcttttcccttgaataccaccattgtctttcttagtaatcttatccaaatctaaataatcactggctacactgcaattagagatacgaggagacttactcactgtttctgttctactattgccatgtttttcaactcttttatcttgagacttctgcacattagtggtgactgttgaaagttccttcactgataaagctagtgcaacttctaagtctctctggtagagcttatcatctaaagccatccttttttttttaggggttttctcttctagtgggatttcttctttctggagattgttcaaattaggttttggtttatcttgttttaactcctttgatgttctggattgcttgtttaaaggtacagttgcagaaacaaaatcatcatcactgtcagagtcgccaaactgtgagtaattgattggtttcttacatctcacaggctgcaccatggtccctttcagggcttgatatttacacttcccaagttcttgttggctgtagtggtggtttcagttcccacccaaaaccagacattggcgctctcccttcactcttcattgtttcctttgctgtgcagaagccttttttgttgttgttgttgtttaatataatcagttggctttaaatatgtggatttatttctgaattatctgttttattccattagtctatgtgtctgtcttataccagtaccatgctgttttggttactgtaaccttgtaatgtattttgaagtcaggtagttttattctttttgcttaagattgttttggttgtttgggctcctttttggtttcatatgaattttaagattgcttcttctatttctgtgaaaaaagacattggtattttgatagccattgcattgaaaatgtagattgcttatggcagtatggtcattttaatgatgttaattcttattcttgagcatgggatgtctttccatttgtttgtgccctctttattttatctagtgttttgtagtttttatagctattgtaaaaagggaatgccttcttgatttctttctcagctagtttgttttattggtatatagaaacaggttttgtatgttgatttttttttaacactccctgcttcacagatggatgcatattgatttatgtgtgttgattttgtcctgcaactttactgaatttatttagcagaactaagttttttggtggagtctaggtttctctagatataaaatcatatcatcagcaaagagggacagtttgacttcctcttttctaatttggatgccttttctttttttccctcttgcctgattggtctggctaggacttgcagtactatgttgaataggagtgattaaagtgggcatcctcgtcttgttccagttcttagaagaaagggtttcaacttttccccattcagtatgatgttagctgttgtcatatatgacctttgttatgttgaagtatgtttcttttatgcctagtttgttaagagtttttatcacgaagggacactgaattttatcaagtgctttttctgtgtctgttgagatgaacatatggttttgtcctttattctgttgaggttatgaatcatatttgttgatttgtgtaaccatccttgcctctctgggataaatctcacttcattgtggtgtatttttttttttttaatgttgttggattcagtttgccagtattttgagaatttttatctctgtgttcattagggatattggcctgtagttttctttctttttttttttaaatattttttattgcatccttgtctggttttggtgttaaggtaatgttggccttgtagaatgagttggggagaattgatgttagttcttctatgagtgtttggtagaatttggcagtgaagccatccagtcccggacttctgtttgttgggagactttattactgattaaatgtctttactcattatcagtctgttcaggtttcgtatttcttcctgattcaatcttggtagattgtatatgtctatgtctaggaatgcatccatttcctctcaattttccagtatgttagtgtatcgttgtttgtaatagtttttaatgttcttttgtatttctgtggaattagttgtaatgtctcttttcattttctgattttacttgggtcctctctttttatgttgattagtctagcaagtggtttattgatttaccttttcaaaaaatcagctttttgttgttcttttgtgctttttaaaaaagtcgtttcatttagttctgctctgatctttattatttctttccttctactaatttggggtttggttctagttccttaaggtgcattgctagattgtttctttaaaatcttactacttttttgatgtaggcatttgttgatataaatttccctctttgcactgtttttgctgtatctcatagattttcggtatgttgtattagattttcatttgtttcaataatttttttgatttcttccttaatgtcttccttgacccagtggtcattcagaagcatgttgtttaacttctgtgtatttatatagtttccagagttcttcttaactctttgttttttttttttttttttgtttttgttttttgagacagagttttgcttagtcacccaggctggagtgcagtggcactatctcagcttactgcaacctccgcctcctgggttcaagcagttcttgtgcctcagcctcctgagtagctgggactacaggtgcacgccaccatgcctggctgatttgtattttagtaaaaacggggtttcagcatgctgcccaggctggtctcgagctcctgagctcaggcaatctgcccacctcggcctcccagagtgctaagattacaggcgcgagctatcccacctggcctattattcttgatttctagttttattccattcttatctgaggagatacttgatacgatttcaatttttaaaaatttgttgacacttgttttgtgtcctaacttgatctatcctggagaatgttctatatgctgatgaaaagaatgtgttcacagtggggtgctggtgcccactttaatcactcctatttaacacagtactgcaagtcctaaccagaccaatcaggcaagagggaaaaaaagaaaaggcatccaaattagaaaagaggaagtcaaactgtccccctttgctgatgatatgatcttatatttagaaaaacctagactccaccaaaaaacttagttctgctaaataaattcagtaaagttgcaggacaaaatcaacacacataaatcaatatgcatccacctgtgaagtagggagtgttaagatgttagatgaaatgttctgtaaatgtctgttaggtctatttggtctgatatgcagtttaaatccagtgtggctttcttaatttttgtatctacatgatccatttaatgctcacagtggggtgctggtgtccctaactattatcgtagtggaatctatctctccttacagatctaataatacttgctttatatatctgggtgctacagtgttgggtgccttatatgtttggaattgttaaatcctcctcctgaatttttccctttaccattatataatgaccttctttgtctctttttactgtttttgacttaaagtttgttttgtttgatacaagtatagctacttctagtcactgttggtttctgtttgcatggaatatctttttccatcccttaatttcagcctatatgtctttacaggtgagatgagtttattgtaggtagtatataggtgggtcatgctttaaaaacattttaaaaaatctattcaatcagtatctatcttatttatttaattgagatggagttttgctcttgttgcccagactggagtacaatggtgcggtcttggcttactgcaacctctgcctcctgggttcaagcgattctcctgcctcagcttcctgagtagctgggattacaggcacctgccaccacgcctggctaatttttgtattttcagtggagatggggtttcaccgtgtaggccagcctggtcttgaacccctgacctcaggtgatccacctgcctcagcctcccaaagtgctgggattgtaggtgagagccacaccgcgcctggccaaattagtctgtatcttttaagtggaaagtttgatcagtttacattcagagttattgatgtgtgaaggcttatttctgtcattttattaactgatttatggctgttcagtatatcatctattccctctgtctcttattaattattattttggcttggtggttttctgtagttgtgagtctcttccttgtttgtgtttggtctatcagtggtttttatatttttttgtgtttttgtgatggtagatagtgttcttttgcttctggatgtaggactttcttaagcatttcttctagggccagtctagtggtgatatattccctcagcttttgcttgtttgtgaaatactttatttcttactcatttatgaaggataactttgctgggtatagtatccttgactgacagtttttttttcattgagcactttttaaaaaaattatttttttagacagtctcgctctgccacctaggctggagtgcagtggtgcagtctcagctcactgcagcctctgcctcctgggttcaagtgattcttctactttggcctcctgaatagctgggattacaggaatgtatcaccgtgcccagctaatttttgtatttttagtagagatagggtttcactatgttggccaggctggtcttgaactcctggcctcaagtgatccacctgcctcagcctcccaaagtgctaggattacaggcgtgagccaccgtacctggccttctttcagcattttgaatatatcatttcattctctactggcctataaggtttctgctgagaattccactgttagtttgatgggcgttcctttataagtgactagatgcttttcttgccatttttagaattctgtgtatttgattttttgacagtttgaagataatgtgctgtgaagaagacctttttgatttgtatttactgagagatccctgaacttggtgtatctgatgtgtaaatctgttgctagacttggaaaatttttacctattattttattgaacaggttttctaacatttttgttttctcttctcctgagacactgaaaatttgaatatttggttacttaatggtgttccatatgtcacacaggcttttctcatttttttttttttaattattactttttgtctcactggctcatttccaagggcctttcttaatgttctgagaatcttttatctgcttaatctagtctgttgttgacactttccaacgtagtttgtatttcattcagtgaaatcttcagttctggaattcctgtttggtttttcctttttttttttttttttctttttgagatggagtctcgctctgtttcccaggctagagtgctatggcacgatctcagctaactgcaaccttcacctcccaggttcaagtgattcttctgcctcagcctccgaagtagctgggactacaggtgcctgccaccacacctggtgtggcggcaatttttttgtattctttgcagagacagggtttcactgtgttagccagtcttgtcttgaactcctgacctccagtgatttgccttccttggcctcccaaagtgctgggattgattacaggcatcagccattgtgcccaacctggttttcctttgtgatatctagttcctttagtaaatttctccctcatatcctgaattgtttttctgaattttttgtattgtttttcagaattctcttgtatctttttttttttgagacagagatggggttctgccaggttggtcttgaactcctggcctcaggtgatctgcctgcctcagccttccaaagtgctgggattacagacaagggtcacagtgtctggcctcagaattctcttgtatcttactgggcttctttaaaatcagtatttgagttatttttctgggatttcataaatttctttttttcccccctgagacagggtctcactctgttgcccaggctggagtgcaatggtgtgatcatggctcagtgcagcctcgacctccctgggctcaggtaatccctcaacctcagcttctgagtagctgggactacaggtgcatgccaccacacctggttaatttttgtattttttttagagatggggtctcactatgttgccctggctggtcttgaacccctaggctcaagcagtctgcctgcctcagtctcccaaagtgctagaattacaagtctgagctactgcacctggccagatttttttgattgggatgtattgcccgtgaattattgtggtcttttggcggtgtcatatttccttgctttttcatgtttcctgtgtccttacactggtatctgtgcctctggtgtaacagttgctccttctaattttttgaattgtctttcataggggaggacattttcctgaagatgtatttgtggtgttggttgaatatggcactttggctttgattctaggtatgtgtcatagtgtagtctctgtgtgttttctttcaatgtgaatgctgtcagtggtgtctgtgatttcttaggtggcttagattgtggttgttagtggaggctgtgataaagttttttataaaagaaaattttaactttcaataaaagaggtctcactctgttgcccaggctggtctcgaactcctgagctcaagtgatcctcccgcctcagcctcccaaagtgctaggattacaggtatgagccaccatgcctggcctgtgataaggttttgctgaggtctgggttgccaagtaggccagctctcaggccccagtggtggcaccagtgggttgaaattgcctgtccttgggcttcagggcagtgtatgctggcaccagtgttagcaggttcaggtaagccaatctttgagcctccaggtgtcttgcttgggtaccaggagtggcacaggtgagccaggcaggttgacaggtttttaaacctctgtgcagtgggcatggtgtggatgatggcagtagcagtggtgggataacctttaggacccaagctgtctgtgctggtgtaggcagtggctgtgatggactggacaggccaatcccccaggcttgcaggtggcacgtgtggttagttgccagctgtggtggtagaggcaggttgaataggtccaatctcagaccctgggaggagtgcttaggtgccaacagtggtggtctatgctaggtgatcgccaggcccacggattgcatgcttggttactgagagggatggagccaggttgtaggagcctgtccttaggctccccactggtacgtgcaggtactggctgtggtaggcaggggagagtgatcctcagactgccatcagaatgctctggtggcaacagcagggcttgtgctgtggccttgttaccgggaagggtggggttgctgtcagtgggagcattcataggcaggtggcttgcagggtcacatactttgcttgtgccttgctcctgctgctgcagcagctattgcaggcagtggaatttttcctcagtgcatgaaaatgcacgggtccccctctgctgcagtgtagggagacagttgctgccagtggctttggtcttggaccctgtggagcagctataggtggagaatgtcaatggggtctccagggatgtggagatgcagggtctgttgggttcccgggcatgacaaagtctggtgggggctgggctctcaaaatgaaggtacactgtacctgcttaggtttgtgggacttagcgtgagctctctctggaataatgttgttgcatggtttctaggcacctctttatgttagactcagggcctgcagcacttgagggcttctcccatggctaggattgtaagagtctggtgggactgtggaccagtggaggtctctcagctctccgctgatcctggttgagcaggctgtcttgcctcctcctcctttcttgctttcagtgcttctcgtcaccaccctgctgaattccagtgttctctcttaggtgatctatttgaagtgtgattatctcctcactattttgttcccttttcatggaagaggcaagtaccaaatgcatgtagtcagccatcttgaagttcctccctttcctgtttttttgatgaattgataattgaatactgtccatgactcagactgtaacaaagtgagaacatagaatcttacctattgtcctcagtgctacaggtattatatccttatatatgtggcgtcagcctcagtccccagatctttttgtacctaataagctaggaaccggtaatatcatggtcagcaagagagagaacatccttaacctaatatttgatcacttactctctttgggaatattttttcaatcttagtagtgatggtgtttctgaaagtccagtagttaaaggtagaattgaaagtgtttaccattcaaaagtacttcagtattttagtaaaaacatacattatagtaaacaatgataaatatgattttcagggaggaaaaaaagcatgagattctttataatagcaaaatagtctgtttacttagggtacataggtccgcaaccgtatcacttcgtcatattaacattccttcaccagtagctgcagggacccatatagtcttaataattaaagtacttttaaattagtttttaaaaatattagaacagatcatgtatgcctggtttaaatacaaaggaatgatagagggttttaaaagataaagccttgttcaaaaaatgaggtaaatttatctgtagaattagtggactagatgtacagcttgcaaagtgagggtgaggccacagtgccagcatttggatatggaaacagggttgacgtggttctgaattcatgtccttataagatcatcagggctgaaagagtcacacatgaaactggagaccaaatctgtggatactgagtaaaacaagaaacagggataggttgtcccacctgttaaaggaggcgaactgcgactgattactgccaatgtggtgacatctaactccaaaggagactgacaatatatattttttactgtggttgccatgtcccttactcaaaattggtagctcttaggaagaagagaaaagatattaaaagtagacagctaatggtttctgcatgtgaaggtacaaaaattataagaccattacaagagaatttcagattcagtgggatatatacagtatagtgctgtggtttgaatgtgtaccccaaagttaatgtgttggaaagttgatgcagtggtgttgggaggtggggcataatgggaggtgtttgggtcttggggacactacactcatgaatgaattaatgctgttattttaggaatgggatccatgactcttcccccactcacccccagatatttgatgccttcctccttgttgttatgtagtaggaaggccttcaccagatgctagtgtcttgatcttgaacttcccacccttcagaactatgaggaaataaatttctgtcctttataaatcacccaatctcagatattctgttatagcagcacaaaatggactaagacagtaagagagaggcagaagttaggtagaatcacagagaagggagtcactgactactcagagatatctaggcaaatggtgcaaagaaaatatgtgaattgggtcttaaaaatacgtagaagtttgctgagaggggaagggcatgctagactgaggactgaaacaccgtgtgaaaggagctgaaactcataatttgtaaatgctaaaaaccacgtgtatgatattctgttgaggtgccagggatacaaaatgaaacaaggctgtttcctctaagagcttgctctgagagacaattatttaaacaaccaatttcaatggcagaatgtcgagtgctgtaataatataaatgtcccatgtgcacttgagaagaatatgatttgtgttgttggatagtgttctctgatacagctaattggtttatagtattaagtcctctttcctcttttgtctgattattctacccattattgagagtcaggtattgaagtttccaatgattactgtagaactgtcttgtttctcccttaaattctgttagtttttgctttatatattttgatgggctgtcattacatgttaaatgtttatcatagtatcttcttgctatattaaactttttattaatgtatagtatccttccttgtctcttacaccttcttgttttatagtctatgttgtctgatgttaatacagcccacctcacttctcttacggttcctatgtgcatggactagcctttccctccttacacgttttacctatttgtgtctttggatctaaagtgagtctcttacggatagcatatatttagaattttttttctattcatcttgccaatctctgtcttttgattggagagtttatttacattagagtagttactgattaggagagactgctgttattttgctatttgttttctttatgccttacagctttcttgtcactcatttgctgcattactgtcttttgtgctgaatttaatagaataattccattctaatttccttttgtgtctattcagtagctactttttgtagttaccatggggattacatttaacattctgaagataaaacactccaatttaaatttataccagcttaacttcagtaacatagagtaacttcctgtacagctccatccctacccccttttggttattttatgcatttgtctcttatgtagaaaataaaatgtgtagtaacaaactaaagttacaattattctagcttttagagtaatgtttttgttgtgtagtaaagttatgtttaaaaaattacaaactgaataaacctcagagttacaaactaaagttacagtaatactagcttttatacttgcccatgcatttacttttactttatatagcttcaaattactgtctagcatcctttcctttcaacctgtttgactcctcttagcatttatttattccagttttaaatttaatgttgttaattgacaaatcataattttatacttttctggggtacaatgggatgttctgacacatgtatacaatgtgaaatgattaaatcaagctaattaacatatccataaccttgtttacatatcattttcataacgagacatttaaaatgtactcttagttattttgaaatatataatacattaatactgactggaatcactgtgctgtgcaataggcctcaaagcttattcctcctctctgaaacttgatatcctttgaccaacaccttcccatcctggcttctccccagtctctggtaagcatcattctactctctacttctatgagttcaacttttttagattccacatgtatgtgagaccatgtctttctgtgccggcttatttaatttagcataaagtcctctaggttcatttatgttgttgcaaatgaaagaatttacttcttttttaaggctgaatttcattgtgtatatacaccacattttttcttcattaatccattgatggacacttaagttgattccatatcctggctattgtgaataatgctgcaatgaacatgggaatatagatgtccctttgccatattgattttagttcctttggatatatacccagaagtgggattgctggatcatatggtagctctaatttagttttttgaggaccctccatactctttttcataatggctgtactaatttaatttacatccccaccagcaatgtacaaatgtttgcttttctctgcatcctcatcaacctttttattgttctttttgataaaagccatgctaacggatcttagtgttttaaattgcatttccctaatgattagtgatgctgagcattttcttatgtatctgttgccattttcatgtctttttttgagaaatgtttgttcaagtcttttgcctattctaaaaccaggttgctttcttgctaccgaattgtctggagttccttatatattttggatattaaccccttatcagttgtatggtttgcaaatattttctcccattctgtgtgctgtctcttcgctttgttaattgtttgctgtgcagttgctttttagtttgctcttttagcatttcttgcacagaagttctagtggtaatgaatttccttaacttttgtttattttggaaagtcataatttttccctcacttttgaaggagagttttgccagtataggattcttagctgacagttttttttttattctcccctttggtagttaattagactattagactatattagcccactgtgttttggcctacagagctgctgatgagaaatctgcttataatatcattgaggatcccttatatgtgacagattactcttactcctttcaagagtctctgtttctttttggatagattataatgtgtcttgctgtgcatctccttgtgttcatgctacttggagtctgttgagtttattgaatatgtatatttatgtctttcatcaaatttgggaagtttttagctattattttttcttttttttttttttttttgagaccgagtctcgctctgtcacccaggctggagtgcagtggtgtgatcttggctcactgcaacctctgccttccaggttcaagcaattctcctgcctcagcctcccacgtagctggaactacaggcacatgccaccacgcctggctgatttttgtgtttttagtagagatggggtttcgccacgtttggccaggctggtagccattagtttttcaaataatctctttgcccctctacttttggcattcccacaatgtgtgtgttcgttctcttgatagtgtctgtttgcctcttttgacttttcttcagtcttttttttttttttatgttgccctatcatcacacttgttgattctttcttctgcctgctcaagtctttattcaaatccctgtagtgaattttccattttagttattgccctcaggagctccacagtttgtttttagtttcctttgagatttttccctcctcttttttttttttaagacagggtctcagtttgtcacccaggttggagtttggctgtgtgatcacggttcatgggctcactgcagcctcaaactcctgggctcaagcagtccccctgcttcagcttcctgagtagctggaactacttgcgctgctgtgcttggctaatttttaaattttttttgtagaagcagggtcttgctgtttcccaaactggtcttggtcttgatatcctggactcaagtgatccttctgcctcagcctcctaaaatacaaggattacaggtgtgagccactgcacccagcctcctttgaggttttctatctctttactcattttcctactttctttctacattgttttcttgcctttctctgtgtcttcttttagttctttgaacacctttaaggtagctttttaaaagtctttgtctattaggcccgtcttctgatctttctctgggaaggtttctgttggtttatttttttttctttcatataggccatactttcccatttctttgtatccctttttgttgttgaaaactggacatttaaatctgctaatgtgataactctggaaatcagattgtctcctttcctcaggatttgctgggtttttgtgtgtgcttgtttttctttttgtttttagagtcttgctttgtcacccaggctggagtgcagtggcatgatcatggctcactgtagccttgacctcctgggctcaaaggatcctccttcctgaggagctgggactgcaagtgtgcaccactatgcctgcctaatgttttattttttgtagagacagggtctcattatgttgcccaagcttgtctagaactcctaggctcaagcagtcctcccgctttggcctctcaaagtcttggaattacaagtttgagacactgcacccagccctttttattttttgattgttgtaggctatctcagatcttttctgagcctttgccttttcctggacatgcacagtgattttcttttgttttgttttttgtttgttttgttttgtttttttgagacggaatctcactctttcgcccaggctggagtgcagtggcgcgatctcggcccactgcaagctccgcctcccgggttcacgccattctcctgcctcagcctcctgagtagctgggactacaggcgcccgccaccgcgcccaactaattttgtgtatttttattagagacggggtttcaccgtgttagccaggatggtctcgatctcctgaccttgtgatcctggcctcccaaagtgctgggattacaggcgtgagccaccacgcccagccgcacagtgattttctaaattccccatttatatggttgcttctgaatgtcctagtcctttaatgtctggcttccaaaaagggagaaagagaaaaatgaagaaataaaaataaaaggccctggtcttttaaatcccctttagcctgactgcggggagcagtggcctctagctattgggagggaggtgaaacaatagctgcctgcttctgtgtctgtatctcagtgatcagaaagcgcaattagctgtcagagcatagatacctgatagttggaggacaggtcttattgcccgaaagctgtggaacacatgcgtgtctgcctggagattggggaatgggtagtcactgctgaactaagagctgaaattgactaaaagtaacagcagtttattttcaggccctttccctggaacttgcaagccttagaatgtgctccagagttccaaaatacttaaataagacagattatactagtacaattgttgtctaggtggagagaagattcttgttgcttcctactctgctttctccccagaatcctctaatgttttttaaaggtttcattagagttagaagagttctttttctccttaattttgaggaactcaagaatagtaagttcattataactcaaagaaaatccattggagaccttttatttagcttttatcttcagttagcaaacatttatagaaggaatttgtgtttcagatcttttttgcgccctaatgtgacaactaatgtgacaacttctggcttccagccagaagatattgggacttgaaattgggagatcgcttgctatggtttgaatgttctctccaaatctcatgttgaaatttgatccccatgttggaagtggggcctaatgggaggtgtttgggtcgtgggagtggatccctcataatatattactgccatccctcttgagtaagtgagttctcactatattagttcctgtgggagccagttgttaaaaagagcctgacacctccccattctctctcttgcttcatctctcgtcatgtgatctgtgtacatgctggcttctctttgccatctttcatgggtggaagcatactgaggttctcaccagatgaagatgcccaatcttgaactttctagccatgagaattttgagccaaataagccttttttctttatagattagcctcaggcattcctttgtagcaacacagacagactaatacgtaccttaaggaggcttcatcaagtagatcacattactactaaggggtagtagtagtgagaatggagatacatggattcatttgagtcctattgagaagataaaagggacatgatttggtctgtggggggttgacgtagtagcattaattaatccagacagctggatttatggtggtactttttcttgaattataggtcacagaagcacaaagtattgtagggaaaggtgtatgaagatgtgcctatgcaataatattgtagaagttgcaaagttcttttatacccaggatttttaagtaagaatgtacggagtgtactggttccctgtaactccagtaggtcttatggcttgcataggccaaaatgataatgggaggcatgataaactttaatagggctgtattagtctgctctcacgttgctataaataactacttgagactgggtaatttataaagaaaagaggtttaaaaggttcacagtttcctcaggctgtataggaagcatggccagagcagaaggaagagagtgaaggtgaaggtgccaaacacttttgcttttgtttttttttttttgagatggagtctcactccgtcatccaggctggagtgcagtggagccatcttggctcactgcaacctccacctcccaggttcaagcaattctcctgtctcagcctcccgagtagctgggattacaggtgtgcatcaccacgcctggctaacttttgtattattagtagagacagggtttcaccacgttggccatgctggtctcgaactcctgagcccgggtgatctgcccacctcggcctcctaaagtgctgggattacaggtgtgagccactgggcccggcctagccaaacacttttaaacaaccaggtctcatgagaattcatcatggaacaacagctatcacagaacaacaaggggggaaatctgtccccatgatccagtcacctcgcagtcacctccagtcacctggagattacaattcgacatgagatttgggtggatacacaaatccaaactgtatcaagggctaagtggtagagtcctaaaaccattttgtgattaaaaatgacataagctcatggaaggcatgagggggaattggaattaagtgcagcaattaatatgaaaaattctcaaatgttatgattagtcataagttaaatacgtctgatatttcaggttaacacaggttttatgtatgtgaactcactcaagagggatggcagtaatgtattcatgaggtatccactcccacaacccaaacacctcccattaggccccatttccaacatggggatcaaatttcaacatgagatttggagagaaccttcaagtaagcatattcaggttttatgaatatgcttactagaagagatgacacaatctaaaccttattaataatgtaaagcatggggaaattatagtcagtgttctctgtgttagtttgtgtatgttgttttggaaatatgtataacttggagtgacactgaaatataataattagattagaagggtaaggatcagaatgagggtttagtgtaatgaaaaacttagaaaataaaacagtttgtttagttcaaaaaattgaaattgtaattttgatactcaataaaagagacttttttatattatccagttcaattcccttattttgtagataaggaaatggagtttctgggaggttggtatgacaggccctgagtgatcactaacggcagagcagtggctacaacccaagtgtgtggctaggagggaaattaaatatattataagcatattttgcttataggggcagccaaacagggctgaaaactagggtaagataaacaagttgcctaaggtgaaatattgtacatttgtaatttatcaaatgtattcatatgtaatatgtaaacatagtataaaatgtggagcattggttcagtttatgtgagaacaatgtggcatgttctgtgtcaagcttgtccatcctatgggctgcatgcagcccaggacagctttaaatgtggcccaacacaaatttgtaaactttcttaaaacattatgagcttttttttttttttttgcttaatcagctatcgttagtgtattttatgtgtggcctgagacaattcttcttccagtatgatccagggaaaccaaaagattggacacctctgtccatgttaagcctcatagatctttctcaggcctggcctggttcctattctcattttttccttgaatcagatctcagagactatattttactttgcatctttaaagttgttttaaccttcacaatcctttgggggtttttctccagcttttgaaaaattggagaatctagaccatcttcctagtgccctccaccttatagcccatgtaaccaaatatgaaagcaatttagagataatagtaaaagggaaataaaggatagttcatatcttacacttttcctgtcatgcctctggtttctagtttgtgactcccattttacttttgagggtcaagttacctaggtcagttctctctccttaggtaaaggtcacgtttctttatttataacagttctttcccacagcacttacgagttagaggtggtttaggttgagtaaaatctctgcttccatgtctcaggaagataattcccagaaccttcgcaatggatgacaaatacatcagtaagctctcaccaaatattagtgcttccctttttggcatcaccctttgtgaggagaataagaccagaatccatagtctctatcttacaaccagtgggtgtaaatttcttgtgttgcttctctggatctgtcctgttttatacctgacacctggcctgtccccaggatcattattctttttgttctttacacccttagagttcaaggcaggccgtttgtttttatattacatttaaaaataaattgtttatgtggagcattctgggagcttagagtttgtaaagtgaaaagatgggtggttttattgatccagcaagagttggctaaatgtatagctaggtttcttctgatattctttatagatacatatctaaataatatatacatattatctcttagttcatttctattaagataaatgaagatacagtcagccctccacatctctgggttctgcatccacagattcaaccaaccacaggtaaaaaatattctggaaaaaaaaatacactaattaaaatatacaaacaaaaaacccaatacagtgaaacaactattcacattttattatattaggtattacaagtaatctagagatgacttaacgtatacaggaggttgtgcataggttatgtacaagtactaggccattttcatataagagacttgagcatctctggattttggtattggggaggaggaaactggcactgatttcccttagattaaccttatccaacctgtggcctgcgggctgcatgcagcccaggatggctttgaatgcagcccaacacaaattcacaaacgttcttaaaacatgatgagattttttggtgattattttaagctcatcagctatcgttagtttagtgtattttatgtgtggcccaagacaattcttccattgtggcccaggaaagccaaaagattggacactcctgccttagatactgagggccaactgtattcattcatgtaacctttcttggcctcattgtcttgataaagtgatatatattcagtgttttcactaatgaccgtgtaaccatgtgagtattgttcattactggctcacctcctatgattaaatttattttcttgtttaacttagtttttcttgaaatttataaagttctcattaaataaatgatggttcgtccgtacaatggactactcagcactaaaaaggagtgaactactgatttacacaacacaaatgaaacaaatgcattatgttaactggaaaagccagactcagcgtctgcataaaacattctggaaaaggcaaaactacatagggacagaaaatagatcaatagttgtcacaaattaatggttggggatgggtttgaatacaaagcataaagcaatttttttttttcttgagggggagtgatagaactgttcttattttcttatttagattgtggcagtgattacataactcttaaatgtttgtcaaattttattcacaacaaacagtgaaaatcttactgtatgtaaaataaacagcaaaaaaatatatggccctatttttatccatctattatgtatcattcctcaatatatattgacagttttgtagatcttacaaatactgacaatgtaattgaatttcatgtagcctctggaatctctagtgaaaagggaaattaacatcctagtattatgaaaatagttttggctccgtagaccccttaagagatccactttagtaaccctttcttagagaactgctaatgtaaatacatgaataatgctagacaaaacacctgaaaacatgttctttcccaaactacttttataaattctataggtatagctatatattaatgacacaaagtttgtcaaatcatttaatcagtcatattgtgtataatttgtaaactgaggaagggtactgttggctgtgtatataggtcatgataaatatgaccttttttggcaagtcagtagttataccctaaggaaaatgtaaggaaccagctagcaataaaataaaattctaaagggaaatctcttgttcagttttagattctgttgtactttaacacataacttgacaatttcctgcttctgataagaatcagctaagtaacaatacccaagtgactaagtccggaagtttggttggggtacagatctcacagtaaacaatgaagggggagaaagtccccaattaactaacttggatatgctgtaagtaatgcaaaaagacaaggcaattcataagatgattttattctcttcagctttttaaaccctagtatctcatcaagtaattttaattggtaaatactcttactaatgaaacaactaatgaaacagatcccaccactgggaaaacaaaaaattacaggctagtcagaaataaaggctacttaaaaattaagtttttcttcttttttttttaaaaatagtgtaggtcaaataaaattccatctaattctgtccacttttggaaatatcactttgaaatcatccccaatatgagaaggcacaaaataatgacaaaggcaaaagtgctgtgcatagcacaattcattcacgtattcactcaacaaatgtttattgagtagttagtggagactaggagacagagcaaaggaatgagaataaagaaagataagcaaaaagtttgctcttaaaaaaacctcaactataattctgtttctttgacaaacttataaatatcttaggtatataagacattactgtctatatgattattttgttaggcattacagaatattacttattacccctctgaactataataaactgatccaagatcagtatcatcatcctataatctgaagattattacattttatctaaagaaagaagccattatgtgactacaaacgtaagagcaataatcttgctaaattatgagcaattagatataaaccaccaattatgaaaacgtgtaacataatgaatttattgtcataattaacacagcaaacatgtaagtacattaattgatctaagtcttatatactatatgggaattaaacataaatggccttatagttgattgtaatcatatttttaaatttctaaaaaattgtggtaaaaacaaatgttatgaactgaattttgtcccttcaaaaattcacacattgaagtcctaacccccagtagttcataatgtgactatatttggatatagtgtctttaaagaggtaactgaggtaaaatgaggtcgttaagatggaccttaatcccttatgactcctcttcctggttcacctggctagaaatattggcattaagtacattcacattgttgtacaaccatctatttccagaataatcttcatcttgcaaaacttaaactctgtacccattaaacagtaactcccctgtatatagatagccaaactaccagtcatgtatgagagaacaaaatcactttcagatatgcattctaaaaaatttaattccaatatatttttaactcaggaaacaactagaggacgtgctccagcaaaatgaagggtaaagcaagaaaaagtaagacataggatctaggaagcggaggaactgtgggcagtagttccaatattggtttcattttctaaacttttgctgtggtatttgcatctttgctttatgcagggatgtgtggggcttgagtggtgtttatattgtacttcatttcttagtgcctttgtgatgcttctttggatattctatgcatgtccaatttgggagagcccagtacttgtgttggtccataactagaattatagatgtcgaagataaactggacactagttaaaatggtaaggacagattttattcagtaactattgcagtagggaagagtgtccagtgtgaactcaactcacttttgccaaaacaaaaggggaagagacttttttaaaggttgagtatgctaagggaaagacactgctaagggaaagaaagatggtttttttgttttgttttgagacggagtctgtctctgtcaccaggctggagtgcagtggcgtgatctcagctcactgcagtctccgcctcccagactcaagcaattcccctgcctcagtctcctgagtagctgggactacaggcacgcaccaccacgcccagctaattttattgtattttagtagagacggggtttcaccatgttggccaggatggtcttagtttcctgacctcgtgatctgcctgcctcggcctcccaaagtgctgggattacaggcgtgagccaccgcgcccggccactgagtggtttttaagggcaataggtggtccatgtgagtaggccatctgggtttgttattggcatttatctggaagagaaacaaacttattatttatgacaggaggtggtggtacaaattaggcccaccaatgtttggcccttaccctctcgccagggactgggaacaaaagtgaaagttatctttttgattgtttgcattccaaagaggtagttctcaggtccttgggaagatagttcttgatggtagaagatttaagtcacaaagggacagagaaaggatttataatttcaagctttctaaggtaactgctctaaatgggggttcaggtgaccatctgcctatcaccaggttttggctggaacaaacggtaaattctggccatgtggagccttttcaggtaaggaacttgatggagttggagtcattattctaggatatggggaaaagatatgaacaagcactttacacagaaaaacaaatgtaaatgtcccttaaatatgggaaaagaaatcactgtaataagagaaatacaaattacaactctgaaatactatttctcccctattagattggcaaaaatccaaaagattgacaacatagtttgttggcaaggctgtggggaaataatcactgatatattgttaggagtttttaaaaatagtttatgaatacagaatttagcagtatctcacaaaattatacaaactttagctgtaactcagcattcttctatgattctaacccaaaggtacactaacagaaaatcaaaatgacacatgtatgaggctgttcattgcagcactatttaatcccagaaaattacaaacaacccattgaccatcagtaaggtctagttgaagaaagtgctacttacataatgatgacgcactctgcaattgttagaagtagtagatgtattagtaaaggaagtctcatgtgctgctgtggaatgatcttaaggatagattgttaaactgaaaatgaaaagattcaggcaatatagtctatgcctatgtgtatgtgtgtgtgtgtgtgcgcgcctgtgtgcatgtgtgtgtgtatgttttgttgtgggggtagataaaaattagaattttcaattttcttatatatttttcttgaatactttccttaaattatttaaaaaaaaatagaaacataaaccaaaacaaataaatagctgtccaggccgggcgcggtggctcacgcctgtaatcccagcactttgggaggccgaggcaggcggatcacgaggtcaggagatcgaaaccatcctggctaacacagtgaaaccccgtctccactaaaaatacaaaaaaattagccgggcatggtggcgggcacctgtagtcccggctactcggaggctgaggcaggagaatgccatgaacctgggaggcggaggttgcagtgagccagggtcgctccactgcactccagcctgggtgacagtgcagtgcgagactccgtctcaaataaataaataaataaataaataaataaataaatggctgtccagtggggtggatgggagaggggagagaaaagagaaggtatgggaagaagacctctctaaatgttttaaatatgtttgatatttaagcatatttaatgtttaaacattcatataaacaatattaaacataatgttcaaacatgtttgatatttaaacatctaccttgcttgatagtttagcttttagaaccatccaaatgttttacataattatgaaacaattacattttaaaaagggaaaataaagtgatcttcaaaaaatgaaaacaagtgagcctaactctacgtccagttggtgtcataaccacacagaagtatatattctaccttttctgtaaggttttatgttttagggtaatagaacaataagcaaaattttcctttgagaataatcacagtttctgaaagcaggtagagctagcacatcatcattattgaaatagttgatctaggcagtgatcatcagtggcaggtaaaaccattgggtagaggtttgatgggggaactttataataatggataaatcagttcagtgctacaaatctaccattcagtcttaacatcacagaaaatggttcaggcagacataatgtgcctcctaataaatggcaataacaagtacacaagaatacttaacgaattattcttgcaacaatgacaaaacaacctagaaaaagtaaagcctctagaaataattaccagtttataggagataggggggatagaggaacaccatgaaaatatacactagccaaattcacgatgtgggaaatgctacaggacaagtgaagccagcttcttaaataaatgacatagagtggggaaagagaacagtgtcagagacttaaaacatgttagcttaagtgcaatatatcgacttagtttggatcccagttcacaccaactgtaagaatgtttaaaaaaatacacttagcaaaaattgaatattagcattagatgaaataagtgttgcaggagttcttaataaaggaacaccttttcaaaatgagcttttgaaaatatactgataatttaattttagtataattgacttgtttgcaatcttatatatttttatgcatcagaaacattgtgagtagaggttctatgtttcaccacactgccattaggcaggaggaggggaggtccatggcttaacccatttgtgcctagtgttccattattggaacgctaagcttgtgagagttatttatatcatgctcaaggtcgtcaccaaggtctgatttttcacacaagaaattgcaacctccggcatatatgggttaaaaaggggaaaaggtcaggagcccttgatttgttcatttttgaggggtatgggtttttaatctgttagtgcttaatgaaatcatgggattccagttcccccaccaaaaattagggggatagctgaaccacaaggcataatattgataaaattgggtgataggtataggattcattatactattctcttctgtaaatgttgaaaagtgccataattataaaacttaaaagcattatataaatttttagttattataccagtaatgtagtagaatgctatttttgtacattctggggaggactagataatattggtaatacttttgtcaccctgataggtaaagtgtggtatttcagtttagttttcatttctttaattataaagatattcaggatcttttgaatactttttgactatttgtgttttctctttcagtttttattttaattaaactttttattttgagatcattatagatccacatgcaattctgagaaactttagaacttattgcgagatccagtgtatgctttcctccagtggcaatacatctggcagaagtatagtacaatatcacaataatattacaaaatttcttcatattgcccttttatagtcatacttacttccctcctgttcctgctgccccgttaaccctggcaactactaatctgtttctaatttccatattttgtcattttgagagtgttatataaatggagtcatatagttaacctttgagattggcttttttcactgagcagttataattccctggagattcatccaggtcgttttgtgcatcaattgttctttttggtatgaacgtaccagtttgtttaattatttgcctgttgaaggacatctgggtggtttccggtttttgactgttagaaataaagttgctgttaacattcatgtaaaatgtgaacataaattttcatttctctgggataaatacccaggggtgcagttgctagcttgtatggtagttgcatgtttagttttatgagaaactgtcagacaattttgcggagtatctgtaccattttacattctcatcagcagtatacgtgtgatccaatttcaacttacccttgtcagcatttggtattaccactcttagccattctgacaagcgtatgtagtgacatctcagtgtggttttaatttgcatttctttaatagctaatgatgaataccttttcatctgcttatttgccatctgtaaatcttcagtgaatgcctcttcatgtttttttgctcattttctagttggatttgtttttctaatgtttctttaacttttctaactgcttaagatagatactcagttcattaatttatttttagctctttttaaaattttattttaaattttattattattattattattattttttgatacagagtctcgctctgcggcccaggctggagtgcagtggcgcgatctcggctcactgcaagccccgcctcccgggttcaagccattctcctgcctcagcgtcccaagtagctgggactacaggcacccgccaccacgcctgtctaatttttttgtatttttagtagagacagggttttaccgtgttagccaggatggtctcgatctcctgaacttgtgattcacccgcctcagcctcctgaagtgctgggattacaggcatgagccaccgcgcccggccactctttttgttttttaatgttactatttaaaactaaaaatctgtctatatacactcctcttgctacatcccacagagttcgatgtatagtttttaaaattatttacttctaagtattttcaaaattcaatatgatttcttcttagattcattagtttttagaagtttccaaacgtggtatttcaaaagttatctttttgttatggttgttggagaatatggttgtaggatatcagttacgtgaacattgagacattctttatggcctggcatttgattgctttttgtatgtgtttcatttgttttctatttggaagcaatattctgtatatgtctattaaatcagacttgctggttgtgatatgagttcttctctagccttaataatgtttttatttatttatttatttttttgagaccaagtctggctgtgtcacccaggcctggagtgcagtggcacgatcttggctaactgcaacctccgcctcccaggttcaagggattctcctgcctcagcctcctgagtagctgggattccaagtgtgcgccaccatacctagctaatttttgtatttttagtagagatggggtttcaccatgttggccaggctggtcttgcattcctgacctcaggtgatccaccagcctcggcctcccgaagtgctgggattacaggtgtgtgccaccaggcctggccgtttttatttctttgttttgttactctgataatatgttaaaaattgtcctctgtggtaatgggtttgtcaagatctccttgtggttctgtcaacatattttgaaactatcttgttactaggtacatagaagtttagatattgtaattgagtagaacatttttcattgggtagtgaactttattgctagtaatggtttttgccctttaagttttgtttgatactaatagagcaacaccagtctctttattgattggttgattgattgattgagacagattctccctctgtcgccaggctggagtgcagtggtgcgatatcggctcactgcaaccttcgcctcccaggttcaagctattcccatgcctcagcctcctgagtagctgggactacgggtgtgcaccatcacgcccagctaatttttgtattttagtacagatggggtttcaccatgttggccaagctggtctcgaactcaacctcaagtgatctgcctgccttggcctcccaaagtgctgggattacaggcatgagccactgcgcacggccatacagtcacagtctctttaaattactatttgcctcatgtatttttttccatattttttacttttcatctttatgtctttagatttttaggtgtgtctcttttgaaaagcatgtgaactaatactacctcaaccttacataaaaatattttccatgtgtttacagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggtaagatattttttaaaagaaaagcaactttgttttaaatgaaacctgcaacttagttctttgtacataattctggcagcagtgtgcataattgacttgaaaaggcaagggctaggtaagtttgagtcatagcaggtggtcaacccagaagaccagtgaaggtcataagtgttaacgtgcagtttctgtaaatctaggcccatgctccaagtcaaggcagagtgataccaatgagtagaactaactctcaccttctagcaggggctttttgaaccatgaatcactgttggagtttagacttataggcagaattgcctctttggcaccaaggcaacttatgtacatggcacataatgaattttaacatctaatgaccttatgttttgaacttcacttaaaaccctccattttgtttttctatttgataagagaactgtggatcattactgtacattagcacctacagagctcttttctattttgtttctctttttccctttatttctccaaagtttttgttttttatttttactggccctccattagggcctgagacagtggagcccacttcacactggacttggctaagctgataggaaggaaatatgcatgggcaaggaatggcctcttctttaaaaaaaaaaaaaaaaaaaaaaaattaaactctccttagctgacaggaaggaattgggagggacagaatttcatttttggtgttcaggcaaacatgctatttgcgtaattgttctttgtctaggtgtagaagaaaagtacaatttctccttgtgcagacagtttgggagcaatatagcatgactgacaaatatgaaatactgttgactcactactttacattagtttttatttatttattttttatggttttgtagagatggagtcttgctctgttgtccaggccaaacttgaactcctgggctcaagcaaccctcccacctcagcttcctgagtagctgggactacagatgcttactaccatacccagcttagtttttattcttattcaacattattgttattctagaatgttcttctaattatcaataaaatacaaatatttaatgtttttaaccattgtaaaactgcaaaaactaaaatatagtacaatttggagtaagatataaagtagtggattatcagtttctgagataaaaatatttccagtgttctaaaggtaattaagtagatataatgtgatgtttaactgctgaggtaactttttaaatacttttgggttttgtgattaagaccattatttttagtttttcaatggaagacaaatcagaaagagattttccttcagtagcagaagagaccagggttagaatcagcaatactggttttgtaaatactggaatttatttaaagcatgatgattagagatattgggagaaattaaggtaatttctgtcaagaaagtatgcctcatagtgatacgtgcacagggtactaagacatacccagttagacttttttgttccattttaagaggacactggtatcttgggattagagtgaatgtgacagtaattaacaaaatatagtgaaaaaactattatcatagagcaaaggggggaagtagtccagtattaggtattactgtatgtaaatctaaaatcccatttaaatataatttttatttgttaatactccaggatgcattccgtactacagtattctgatgttattgagacagttttatcaagattttatctctatttaagtcttaggaaatctctgttaactttattactgtattacagttattgctacctttattccagggtgcttggaaacattgttttgagttagtgatctgtagttaacctgtaaagagatataagtccagcttttacattagataaacttttcccttttctcataatttctgtatccctttttggtaacttaaatatccggtgtaattaatggatttgtttcgcaatggttgtgctggtggagacattgtttgaaagttgagaaggaaaaggggaaaacaaaaggattaattcatgaatatattttaactataaaaaatatatatgctttaaagcatcttccaaaataagtctgaataataaggtcatatttttggccatgattatttacttgttatacaggctgtgttataatttagaggaaaaaaaagttttggaaagagaagcctcagaaaaattttctattgcctgggtgtgggccaggtcacatggattgggtgtgggaagtttcagtgttgcagaacagacgaggaagctcactgagaattatcctgagctgtgttaacaaactgacagaacacagaatttttactcaaaatggattggttaaacgtctttaaagattttttcagtaagttaatctgtttattaaatccactgttttcttgaagttgtgaattagattttctgcttttgtaaatttaaaggaaaactcttatttggtgggtttatgtaagctactacattatgtgtatgtaatataaaccaaatgattggtgatatatccaaaaattgtagtttcgacttggtaagtaaaataattttaaaatgttttagcatgaatgtttaacaagtagagaaaggatataaatggtttgagtttgatgcagttctaattcagtaattttcaacttagcacagacatttgaagtgaattaaataaattgtaaacattaaaaacattagataaaaaggattaggtgaacaaatttcttcatcctcaactttggaattaacttttttttttttaactactttttgcttactttttttttagcggaacagtgtaaagataatctttaataaaaacactagtaaagagaatatttttatttaattaatgtagtattgctagaaattgatgttttgattaatgtgagatttgatattttgatatgagttatgagaacagctatacaaccaagaggaaaatagtgaattcttgactgttattgagtttgggtcatgaagtaaaactaataataatttataagagcctaattctgctgattctgctagtggcctccttatgatcttatagtgaacttaatttgatctccttgaacatttgcttggtgtttctagaaaaatgaacagaggaattattatagaagtctcttatgcacaacaagcctaaggaaacaaagagtaacctgacaagagattccagagaaaagggcaaaagagaaaaggaataagcactttgttgaaaaagaatgttgtaattgtaatgtgaagactcatttgttagctttagtgactccctctggaatatgtctcttctgtttactttttggggagttactaaaatttcagatctttgcatttttcattttttgggtaagttttacctttgaagaacttacttatttgctcattcatttgtttatcaacacattcttattgagagcctactccaagccaggcagaaatcatagggtgaaaaactaatactaactctagcaaatcttacattctggtggagaggtatatgatgattgttattaataatacagtggatttcatatctagatttagtcataagtgatgttgaccataaagcaaccagaaatgacataaaaagaatccattgtggctaggcgtggcagctcaagcctgtaatctcagcactttgggaggccgaagtgggtggatcacttgaggtcaggagtttgagaccagcctggtcaacatggtgaaacactgtctctactaaaaatgcaaacattagctgggcgtggtggcgggtgcctgtaatcccagctacttgggaagctgaggcaggagaatcacttgaaaccagaggtagaggctgcagtgagccaagattgtgccactgcatgccagcctgggcaacagagcgagactccatctcaaaaaaaaaaaaaaaaaaagaatccattgtatcattgatacagtgattcaatatatatcatcaatacagtggtaaaattattctttttgctgagtcttaggaagttgatagttaatgcatttgcagactgggagtcaggatttgaaatttgtaaccaaaatgtttctttgctcaatccctgcagcaaccccagatttttatttattttgccaggcagtttgtcagagtagagacaggctattcatctacttcctacctgaatgggcttataaagtagaagaaacagagtattatgtgctttttgtgtggcagccagagtatctttgaaaacaaaaattgtacaatgttttaaataaaacaataaaaaataatttatttcatgtagatgaagtgaacagatggacatataaaaatttaaataaaaacctgtaatggaaggaataccatatatttatatgtggtatttcttagttctgttcccagacatatcacttacaagccatgtggcctgcaaaatataactgaacttctctgattttctgttccttgtaaaagacagagttgggcaagactaaatgatcctggaaagtcccttctaactctaaaagtcttacatcctggtaaacaactaagcagtcttaggtgtgtcataggaattgagcgaaagcaatgagtgagaaattggttttgaagaagtagaaacatgggaacagaattgtagttgactaaggaattagaagaaacagaaaaactttctttggccccattctcaacacttactcagtgatacaggtgaaggaaaaacaacatgcttaaactaaagaatactgaaatcactaataagtacactgggttcagaaatatatttggaaactaaaatcaagatagaaataaacaagatgaataggaacagacagtattgtaaaactctacattaaaattttaaaaggaattgtatagattggtgagaacctagcctggcagcagcttacatgagtaaaaaacttagtaagagctgctgtggtaatgtaggtactaaaactctcaacacagtccatggtgacattgattcgagtctgagaggtgcttaggtggaggtatgctcccttatgtgtgtgttggccaaataaaacatgatgtaattaatccacttttgatagatattctttaacaatggtattgagaaacttggatgcttccaaatgctggcatccagtatatcaaggatttgcaaaccaggtcacataaggaatagttatgggtacaaagacttgcctcagggagcacagctgtcatatgaagaaggaatgttcacagtgcttaaccaggttcttaagaattcttgtggagtttataatgcattgttctggttaagaaacagtgctataggaaaagagaagtaaagaccagtgggtggtagtgagggaaagatcagaaattatctttacactttttttttttaatttaagcaaagctaacaataaaaaactgcctcagaatggtacacttcctcagtgcttagatctgagcagtttccttccaactacagccaggtccagctatataatgcaagaataaagatttaagtaatctttttttttttcttgagacagtcttgctctgccacccaggctggagtgcactggtgccatctcagctcactgccacttctgtctctcaagttcaaacgattctcgtccctcagcctcccaagcagctgggactacaggtgcatgccaccacacctggctaattttttttgtatttttagtagagatggggtttccccatgttggccaggcatgtctcgaactcctggcctcaagttatctgcctgcctcagcctcccaaagtgctgggattacatgcctgagccaccttgcccggccaagtttaagtaattttgaaaattaaacaccataagcactagaaggtaggaaaatagtaaccaccattgatggagttcctgctatgtactgtaagtgctttacacatagacttctaaaaattttttacaagcattttatgaatttatttttttacacaccaccattgtacaaacaaggatactggaggtttttttttttaacttttagggttgggggtacatgtgaaggtttgttacataggtaaatacatgtcatgggggtttgctgttcatattatttctttctttcttttttctgagaccaagtctcactctgttgcccaggttggagtgcagtggtgtgatctcggctcactgcaacctctgccttccaggttcaagtgattctcctgcctcagcctcccgagtagctgggattacaggtgcctgccaccacgcctggctaatttttgtgtttttagtagagatggggtttcaccatgttggccaggctggtctcgaactcccaacctcatgtgatccatccgcctcagtctcccaaagtgctgggattacaggtgtgcaccaccgcgcctgtcctgttgtacatattatttcatcacccaggtattaagcccagtatccaatcattatcttttctcctactctcctttgcccacccttccccttcaagggggaagcatttggttttctgttcctgtgttagaaataaaaaagattaaataacttgaccaagatcacacaaccagtagcggaactaaaatttaaacttgtatctcctattaaagttctcatagtagatattttattactaaagagtagagaattggagtcggttaagcaatgggttagaagggtttgatgcaaaaaggactagtcaaggttaagaagattgtggtgaactgtgaggtcaggaagtgctatgacctgagtgtttgtgtcccccaaaactccgcatgatcttggctcactgcaacctccgcctcctgggttcaaatgattctcatgccacagccacccaagtagctggaattacaggtgtgcgccaccatgactggctaatttttgtatttttagtactgacagggtttcgcatgttggccaggctggtcttgaactcctggcctcaggtgatctgcctgcctcggcctcccaaaatgctgggattacagtgtgagcccccgtgctgggccattctttttttgacaatgtgtaattagtcttagacataatgtttttaaatataagcttccagagagaatcattctaggttttactgatcttttgcatttcttttaccatacaaaactgtgcaaattctgaattttcaaaaatatcatttgaaacttagtctgtattttcaggtttaactttttttttttgtatgtgcctcatatcattattcacttttactcaatttgacatttattgagaatctgctatgtgaaacagccactgttggcttttgagcagtgatgtcatgtgattgcagctttatttataggaagatcagactggttgatatggatgatgggtcgactgagggagaaactgaattaataaggaaactagtttagtggggtcacgaaacctctggtacaacataataggcctgaagaagagtgaccatagtgagaagggaaagtgttggcaataaggagataggattgtgaggatttgatgtaagactcttaaaaatttttttatgaggtaaaatttgtataacataaaattaaccattttaaagtatgtaattcagtagtattgagtacattaacagtgttgtgcagccatcacttctgattccaaaatgtttccatcaccccaaaaatagtcactctcaatcagtccctggcaattactaatctgctttctgtctctatggatttacctattctggataatttatataaatggaatcatacagtatgtgaccttttgtgtctggcttctttcatttagtataatatcttcaagttttgtccatgttgtagcatatatcagtaattcatcccttttatgtctaaataacttttttttttttttttttctgagacagagtctcgccctgtcacacaggctggagtgcagtgacgtgatctcagctcactgcaacctctgcctcttgggttcaagtgattctcctgcctcagcctcccaagtagctgggattacaggcacatgccaccacgcctggctaatttgtgtatttttagtagagatggggtttcaccatgttggccaggctggtcacgaactccttacctcaagtcatctgcccgcctcggcctcccaaagtgctgggattacagacgtgagccactgtgcccggctggctgaataactattatatgtatatatcacattttgtttatccactcatctgttcatagatggacatttgaattgtttccatattttggttattgtgaacagcgttgtgataaacattcatgtacagttattgtttgaatatctattttcagttaagtgtatacctaaaagtggaattgctggatcgtatggtaattctttgctttttgagaaaccatctgtttttcacatggtggcaccattttacattccaaccagtattgtaagggggattccagtttctccatatccttgccaacacctattttctttctttctttgcttatatccattgtagttggtgtgaggtagggtcattgtggttttgatttacatttctctaatgactaatgatattgaggatcttttcatgtgcctgttggccattcgtataccgtagttggaacaatctttattcaagtcctttgcccatttttgaagtagttgtttttgttgttgggttctaagagttgtttatatgttctggatactagacccttatcagaattatgatttgcaaatattctcttctaattctgtaggttgtcttttcacttcttgatagtgtgttatacacaaatgttttcaattttaatgaagtataatggatcttgtttttttggttgcttatgcttttagtgtcagtatctaagaatccattgctaaatccaaggtcacagatatttgctcctatgttttcttctaagagttttatagttttagctctgacatttggtcatttcgagttaatttttatatatgatgtgaagttggagtccagtttcattcttttgtttatagatatccatttgttccagtaccctttgttgaagaaactattctttcttcccattgagtgatcttggcaccattgatgaaaatcaattgaccatagatccatgggtttattttaggactctcgattctatttcattgctgtatatgtctgtccttattccaataccacactgttttgattactgtggctttgtagtaagttttgaaatcagaaagggagagtcctcccacttgattttcctttttcaagattgttttggttgcttagggtccaccttgcagttctgtgtgaatattagaatcagccttttcatttctgtggaaaaaacaaaatggttgaactttagtaagaattgcattgaatctgtggattgttttggatactgttgccatcttacacagaatatctttccgtttatttaagtcttctttaatttctttcagcggtgttttgcagtgtttagtatatgagtctgatacttggttaaaattattcctatgtatcttattcttcttaatgctgttataaatggattattttcttaattttgtctttgaattgttcattgttaacgtatagaaatacaactgattttgtgtgttgatcttgcagctttgctgaatttttttattctcactctgtgtgagtgtgtgggtgtgtgtgtattctttaggattttctatttataagatcatgtcatctgtggatactttttcccctccctaattgctttgactagcacttccaatacaatgttaaataaaagtggtggaaggagagcatccttgttcttgtcttgttcctgttcttacggtggaaaactttgtctttcaccattgagtgtgatgtcagctccacagttttttgcagatgccctttattatattgaggaaattcccttctaatcctagtttgctgagcattgttatcatgaaacggttttggattttgtccaatactttttctgcatcaattgagatagtcatttgttttttcccctttgttttactaatatgaggtgtcttatattgattttcatatgttgaaccacccttgcataaatcccacttactcatatacagtccttttaatatgcttgctggatttggttttcctagtacaaatgatccttatttttcacagattctgtatttgtgaattcacttattggctaaaatttatttataagcccaaagttgataattgcagtgttttgtggacatgtgcagtgtggcaaaaatgtgagtcatctgatgtgcacattcccagttgaggcaatgttcttccttcttatttcagctttcatactataaaccagtgtcctttgtgcagtctatttagtgccacattttttgcatttttgtgcttgttgatgattttgctgtttaaaatggcccccaagcatagtgatgaagtgttgcctagagttcataaacacaagaaagctgtgaatttgcttatggaaaaaatgtgtgttagataagcttcatttaggcatgagttatagtgatgttgtgaattctatgttaatcacaatttatattaaagtgtctttaaagagaaacacacataaaacagggttgtgtagtgattggttaacaaaaacatgattggagcctaaccctgtttttcccttaggagctgtggttcagtatttgctaattcagtatttatggtaactttatagaacataactactgcaaacaatgaaaatcaactgaattttgttgaggatttttgcatctatatttctaagtgatattagccagttgtcttgtgatagctttggtattctgggtaatattggcctcatagaatgagttaataagtattctctccttttttctttttagagatgttttagaagcattgatgttaattcctctttaaacgtttagtaaaatccaccagtgaaaccatctggtccagagcacatttttgatgcgagatgttttgttactgattgaatcttttacttgttatatgtctgttcagattttctattttttcctgagtcagctttggtagtttgtgtgtttcttggaattgatgtttttcttctaggttttttaatttattggcatacagttgttcatagtatttgtttataatcctttttaaaatatctgtaaggtctgtagaaatgttatttctgattttatttatttgagtgtctctcttgttggtctagctaaagagttttcaattttactgatattttcaaataaccacattttggttttgttgatttcctctgtttttctgttctcttttgtgtatatctctgctctgatttttattatttccttctttttgctttgagtttagtttttcttttccagttccttaagattaaatttaagttggtaattcgagatctttcttcttttttatgcaagcttttagggctataaatttccctctgagcattgcctttgctgcctcccataggtttttgtatgttgtgttttcattttcatttgtctcacagtagtgtctaatcttgtgaaatttcttggtgacctattggtttaagagagtgttagttgccacacacttgttaattttccagttttcctttctgttattgatttctaggttcattccattgtggtcagaaaagatactttgtatgacttcaatctcaaatttattgaggcctttttttttttttttttttttttaaaatagagacagggtctctctttgttacctaggctggagtgcagtagcatgatcatggctcactgtagcctttgaactcctgggttcaagcaatcctcccaactcagcctcctgagtagctggaactacaggaatgcaccaccacacctggctaattattttattttactttttatttttgtagagacaaggtctcaccatcttgcccaggctgccgtcagactcctgggctcaagtgatcccccgaccttggactcccaaagtgttggaattacaggcttgagccactgtgcctggcctattgagccttgttttgtgtcctaatatatggtctatcttgcagaatattccatgtatacttgagaaaaatgtgtgatatattctgcttttgtttgatgggatattctctatatgtctattaggtctagttggtttatagtactgctcaaggcctctatttccttaatgatttttcatttagttctgtcccttacagaaagtggggtattgatgtctccaagtatattgaactatttttctccctcaattctgtcattttttgctttatatgccttgaggctctcttgttaggtatgcatatatttgtaactgttacacttcttgatggactgattcttttatcaatatatgctgtcctttgtctttaagtctgtgttgtgtgatatatatttatttatttttagacagtctcgctctgttgcccaggctggagtgcagtggcgtgacctcggctcactgcaacctccgcctcccaggttcaagcgattcttctgtctcagcctcctgagtagctgggattacaggcacctgacatcatgcctaactaatttttgtatttttggtagagacggagtttcaccatgttggccaggctagtcttgaactcctgagctcaagtgatccacccgcctcggcttcctaaagtgcagggattacaggcatgagacaccgcgccgggcctatgctgtgtgatatttatatagccaccccactctcttagttatcctttacatgggatatcttcttccatcctttcattttcaaacctatttgcatctttgtttggatctaaagtgagtgtcttgcagataacagttgcatcatgttatttttaatctatttacatttaaagttatatctgataaggaaggatttctgctattttgctgttttcatttacttttttttctttcaattcttctattactgtcttcttttgtgatttctttttcttttttttttttttttttggagggtgggggtcagggtctcactctgtcacccaggctggagtgcagtggtggaatctctgctcactgcaacctctgcctcccaggttcaagcgacacttatatgtcagcctctcgagtagctgggactacaggtgcatgccacgatgcctggctaattttttggtatttttttggtagagacgaggtctcagcatgttggccaggctgatcttgaacttctgacctcaagtgatccgcccaccttggcctcccaaagtgctgggattacaggtgtgagcctctgtgactggactattttctctaatatattgttttattacccttcttgtttctctttctgtatttttgtttttccttagtggttaccctggggattaacatcttaggtttttaacaatcatgtttgaattaataccaacttagtttcagtactatgcataactctgctcctttgcagctccatctttgtatattacatctttacacattaaaatatatgcccattaacctagaattgaaatttttgttttatgcatttgtattttaaattgtgtaggaaagaaaaggagaatttacaaaaaaaaactgcaatactactgacttttatatttacttatgtagctacctttaccattgttctttatttcttcatatgacttcaaattactgtccagtgttttttcattttagcctggaggattctctttagcacttcttttttgagacagtcttgctctgtctcccaggctggagtacagtggtgcggtcttggctcactacaacctccacctcccgggttcaagcaattctcctgcctcagcttcccgagtagctgggactacaagcgtgtgccaccacgcccggctaattttttgtatttttagtagagacggggtttcaccatgttggccaggctggtttcgatctcctgacctcgtgatccacccaccgctgtctcccaaagtgctgggattacaggtgtgagcccctgtgcccagcctctctttagcatttcttagcacaggtctggtagtgatgaattcctttagtttttgtttatctgggaatgtcttatgttctccttcatttttgaaggacagttttgctaaatatagaattctttgttggctcttttgctttcagcatcagatcagattctatcccctccccagggcttattactgctgcttattgtgagtggttgttgtttgcttgtttagtgactttactaaactacttttataagctctatattcctggtcatgtggggccgctgaagtctattccatttgcttagtaatcagctagggttttaacagagtttcgttaaacacctggagccaaaagaaaaaacaaacaaacaaaagaaaacctctccccatctttacagatggctttatgttggggcagtttttgaccacttagtgatgccatttataattctgccttagcctttgcttactgtttgctcaaagcctgaagatcagccagggtgaaagcttagggtcttcttgggcctttcctgaatgtgcatccagccctggccatgtgcacgtccttcttgattggtatacacaccccttattaccccatgtatattctttcccatcccctttctgtccaggcttttccatctgtctgttccttgtcccagttgttgtcccttgccccaggctgctgcatccattaaatgatttttgcaaaaaccacccaggaagactccctatgcctgggaatgattcaagtcaggcaaagccaaggcaagccattgctcaggtccttcagggagctgccagacaagttgaaacccacaatcacaattgtttaagaatgagatctgtattgcttcctctggcattaggagtgcaggttactgtccacacagccatcactgacttggggtgtgggggatggtgggcaggcaacttaggatgcgatagcactctctttaccacaaagcagcaacttctttctttaccaagccttgccctagattttataagttttttttttttactagattccagagttctgcaaaagttgagtctgacagtatttaccagctcattaattgcattcattgctttttgcagggacagtgccttggagttccttactctactatttttggtggtatcaccccaaatgtagggatttctccgaaggctatcattaaccggaagtaagaaaattaggaaggaagaagttgatttaggggtatagactggattatttttatttggacatgagtgttgggtttgaggtactgatggcacaatctgtgggtgtctagtgacagttggaattgtaatgcctgaattccagaaaggtcttagagctgcaaagagatctgggaaccttctgcacagaaattatagaaaatgaaagtgtatgatttccttggaatagagaggaaggtcaagtatgtcatcttgtgaaacactttcagctaaggaattcttcatttattcattcagcatgtttgctgactgctgaatacataattttgtttttcctttgttcctactactgatgtatgtactgctaagcgttggagacagaaacgaataagatctcgttttctgccctcaggaagttcactcatattgaggaagacagacaaataaacaagtacaatgcagtgttataataacaaggttagaggagcctagacagaggtaaacaagaatatgtaaacaggttgggagggaaaataagaaattcggggaagtcaaagaagaagaaaacataatggagagagtgggctgtgatcttggttgctgcatatagagtttgagaaggctgaggactttaaaagttactgatttgacagtaaggagagatgacataagaatggtattcataagaatggttttaattgagtagttttgttagaatgttggagacaaaggatcagataataaagagttgggagtgtgagtggtgaaaaagtcgagggaaaaggaaaaacaactttttttttttttttttttttttttgagacagagtcttgccctgtcgccaggctggagtatagtgacgtgatcttggctcactgcaacctccgcctgccaggttcaaacgattctcctgcctcagcctcctgagtagctgggactacaggtgcacaccactgcacccagctaatttttgtatttttagtagagacggggtttcaccatgtttggccaggatggtctcgatctcttgagcttgtgatctgcccgcctcagcctcccagaatgctgggattactggcatgagccaccgtgcccagccgggaaagacaacttttaaaagagtggtatagtttattctataggaaaattggaccagttagagaaaaaataaataaattaccaaaatgttacggtttaaaagttgtagcagagttaaagtaacttcattttggagtagaaaagatatgagtgtgtttttagacaattgaagggactaaataggaaggaaaacaaggatgtcgagagtcccaagagagtcaggaaagatagtattaagatcctagaaggatcaggatttggagacttgagtgaagaacgagagtgaggataatgagagttttgagacaaaaggaatttgagaagttttacctagggaagcctcagttttctaggtaaagtagagcataaaatcacacgctaagaaatgggcagcagtgaaaatgcctgactgaagttgatgtagcgtacatttgtattgatagtaccatttggtgattttctcatttctttcaacacatatgtgttaagcatttactgtgtactaagcactatacaagatccttgggattctatctgtaaacaaacaaaactccctgtccttttggaggttacatatgactggggtaaggggagaaaaacaaataatattttaaaataaacatatgaggtaaatagagctacctgggtctgggaaccaagaaagcaaatgggaagattagccagacataactgcaattttatattgcatatcatattctgatttaagatagaaataattttatttttatacagctcattgtagaatctagcttgcttaaactaagacaagaagagtatgggtgtggtggagcctttgtgtacttagattgtagctatgaaagaaatctatatttacatttaagagggaattcattaatttaggacaactttataattatgttatatagttatttcagggcctttgacaagagaaaagatggtgaactgtcatataataacaaattaaatatttatttggttaagaaaaagaaaatttgcatcttatttccaaaaagatgatttttaactacatagaaatttgttatatttaaaagctttaaagatctatatagagttgaagatctctttttaataatgaataagttcattcttttggtaatcatttttttatattctcctctcatggccctttttaatttcaacaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcggtaagttgattttcggaggtaaatacaaatagagctctgggtattttaaaaaaaagagagagagaaatggagaggttaagtggcttccctaaagttaaccaggtaacaagctgggacgtaacataagcataaatgttccaaagctaaagtccgcattctttctagctatctattttgaataaaagagagctgtggcagtgttgctacacactgaattatttcgtcttgtctagttctgttgattttgcattcctgatatattttctgtttctgttgcattaaactaaatggagaaaatggaacactggcctcttcattgagagtagaataatactatagattaaactgggaaacatttaaaaaattgctatgagcaatgtgtaagaaggtagtcactgtagtccttatgacataggaaatccctgaatttaaaaaattgatattaagtttcttcataaattggttacttggaaattggaatgcacttttattataacctcaaaaaacctattttagcagtgtttgaaatgcatttgcaataaaagataaattatattgcaatactagtaaacaataaaactataaaaccataaaagttgaaaaataatatggtttcatggtctcttttagatactgcttaggatattagaatttgatgacactcattttccttaaaaatggcctttctttttccttgatgaaagatatcactacttttccatttattaaatcatggttaatcttggctttgcgtgagtatatttgtacaaaagggaatgtgtaattgcacaaaattttgaaagaaaatgtgtggaagtggggtgtggtggggagagagattaattgaacttcctgatgtgaagttcaggaaaatggggcctgtgcctaatccctcagaaaagcagttggttggcagtagggaagagtgatgacatccattttctgttagttgcctgatctggctcactgtttgaaactttgggagtaactgtagaaaaagaggctttgggggttgatatagactgtaacaacaacaacaaaactaattaaaaagaagatagcttgaatgcagaattgtatgtattttcttgtgggtaattgagtgtagatattagacaaaatgcaatatataccattatttttagcagtatactttttaaggttagaggtctcaagtaggcatattttgtttagccttcacagtgttttttaaacatttaaattcattgccgatatttaaatattaggatatttattataaaaattcagactttagaccatttaaaattggaagaactaccaacattgagacctggttcctgcaaggcaacaatcacagctgagaagtcaccacttgtttagattggtgatacactgtcatttcctctgcccatctacctttccactctgacacttatttacattattcttttggctcttgtaggcatttgagtttgtggcctctccttaaagtttagattaattctcatttgtgtattcttcatttttgggaattcagcatgttatctctaagacagctactgttagctacacattgaaaaggggttgggtgggtatcttagactttctcatgtgtttctctgactggagagaagatagctcttgttcttcaaatatttaactaaaggatttgctgtgggt

SEQ ID NO: 17012 - DNA, 89625 bp, Human
  misc_feature (1)...(89625): n = A,T,C or G
ctttagtaaatttctttaatctttcagatttctgctcaaggatcacttgctgaaagcctttccaggcctttctgagtcaatacaatccattattagaggctcttagagcacaggcagcacttgttataattttacatctgtctgtgggattccttaacactttctaacacaattaacacttttctctctggctgggggcaatgcatgataacaggatgatggtatgctctcaaccctcccccagcaactagcccagtgcttcgaacatggtggatagatacaccgtttttattttagacagatttttgagtagcaagtacctactgctcaggagacagatggactgaaaaaatatatttgggagtcatcagcacataggtgcagccatgaaaatgcacgagaagcaaaaccattggcaggaacaaaatgaaggctattagagaccttatttaggtggaataattggacagaagcccttaatggggaggaaatagaagcagttaatacagatggaggccgggcgccgtggctcacgcctgtaatcctagcactttgggaggctgagataggtgggtggcttgagtccaggagtttgagaccagcctgggcaacatagcaaaacccggtctctacaaaaaatacaaaaattagcccggcgtggtggcgcaggcctgtagtcccggctactggggaggctgagatgggagaattgcttgaaccggggaggcggatgttgcaattagacgagatcgcgccactgcactccagcctgggcgacagagcgagactccgtctcaaaacaacaaggacaaaacttatcttataagcgaccctggacttccagggacactcgccgctctatggtggtacgtgacctgcctggactctgtggtctttggagcttgggaccccaccccagcgtaagaggcctttctgtgccttgtataaaggagaggaaaagtgtaggttttctgagttgataagattagagctacagtatattatcagtagcgttgtatgaaaccatttaaaaaaccaaaccggatttaaccgctttcacccagaataaactgccctccccctctttccaagatcaagtcagccccagttaccacttcctattaatttaaaaaccaggaaggctcataatttaggctgacgttgccccaggcgaacactgcatataagacaatagctattccaatcctcctttccctttctaaaccgaatagtacttctaacatcacttttccagtcctctttctaaatattgcgatcacgagcctacatcggaaaactatgaaaacagtatgattggagctcttgatggtctgctttgcctgaaaacgatgaaaggcattgagatctttgggcagaaatggcccttagggaatgcgagcctggtagccccataacaccccgagttacaaattcggtttgggtaggtggcgcagggaaatctaaaagctggattcacgttctcccccttcagtttgcacatagcggtcagtggcagacaagagcagacgcacaaatgtcaatccccgcccgcaaactctcgagggcagaaactgctttttgtcagttggatttggagtcggtggaaaagctgccctaatgtagtttctccgaggtttccttagccttgaccgaggggcgcttcccggccattcacctagaggttgtttaataaacaaggatgctcgcgaaatatctgcgcttggaaaggcgctcgttcgtggcgcgcattctcgggcctccgcaagcgaccccggtgacagggacaaccgcttcggttttagcgactgcagacagactgggacgagacggttggaggctcctccccaagggatgctggaggggttgcgtcgtaccctgcgcctggccctggcgcgcggccccaggtcgtggtacccagcgccctatgggccgtgcgccggggcttggccacaccgcctgctttcgcttccagccgcgcgctccgtgccactgccgctctctgcagccccgcgtccccgcagcctccccatggccagcccgcttcgctccgctgcggcccttgcccgccaggtacctcgaacccgggcgtttgcggaaggggggaggattggaacccgggtctcggtagctcgcgggcctggccgggcgccttgtcgccgtttcctgcaccatcctccttcgccttgccctccattccgcctccagcgaggcgtcttcccttccccgcatccctgcccgaaatctggagtcccagcctgcaatctccacctcttcgaggttcccgctgcccaggtctagcaccctcatgggtaacccgctccggagcgtggcgaggaccgccacgggggacgtgagggtagctatggactcgctctgagggaggaggcgggagctgaatctctgggctgccagaacccacagccacatcctacgtgactctgccaccccaaaatattttgaccgcagccttctgcctccttggatctcttccttccccacccccacccccgtagttatttagcagattacgcattaaaacaaatgtctgcaggttttcccaattagtcccgcttccctgtgtctttatcttttaaattgcccactaataccatgaggtttaaggtgtggggtggatgctgcggcatcggaggaccctgctggtggaggaaatggttcacgcccgtccccgttccctttgcaggcttgctattgtgcgtctgtgattgacaagaccacgaggctgagcgcgccctggagatttttctataaatggcttaacaccccagtctagactatttgctcggatataagggagacaattgtttttttgttctttgccggcgaaccctggctctgtagggctgacctggaatttaaccagtcttccctgagccggcggaggaggacaaaaaccgccgcgaccccggcagggtgggaagtgcagggcagcgctcccaagacacgcttgttggaggttcgggcctgggtgcttggttgtctgagcctccttttttgtgtttgcctgggtcctggagaggagcgcacggtatcatggtgagtgtcacgtaggttaccccgggtcccgcttacccacctgcatttacttaatggtggtttaattcttctttaaggattgcagtaacggatgctccgcagagtgtaccggagaaggaggatcaaaagaggtggtggggacttttaaggtaagttgcttgccagaggcttagtgtctaaagcaacgttcaactgaataaatccatttcttgttgagattcggggaaattttcactgtgtgggttacccagttcctaggttgtgttgccagacttttaaaattccactcttagaggaaaaaaagccatttagagagtgacagtacattcatcacaacaaaaattatctagcagctaattgctgattttattttgagtcatatatttttcttgaaaaatagtcaatgcgtaaatattaaactagttgtttatcagattccataatacgtacaaaccttcagtctacttgtagaaaaagttaaactgtgatttttctctttcagtagcacataacactctacagtgaaagtgttgcattttcttcttttctatctgaattgcggggtttatatagtaaatagctcatacttcaaacagtgagaaacaaagcacgttgaaaactgtacaaatacaaatgtaagatgtaatattattttttctataagtctatctcctaccctccctcctcgtggaggttttagcttcttctttttatgcctagtgctgctcttctgcctgtttgagtcactgtcaattgtcatcagacaattgacacagagtgtcctaatgatctcacatcctggcggttcagagagggaaggaaacttgactcatcagtttctcacacattgagctctctcacagtgtgctggagactgtgccatgcattggacatccaaaggtgaattcaagattaggtctctacttgcaaggaatttttattttatttttctttttccttctcttgctgtcatcttagcaaggattttttaaaaagcaaaattagaatattgcaatttcttttctgttttttgagacagggtctcgctctgtcacccaggctggagtgcagtggcacgatctcagctcactgcaatctctgcctcccaggttcaagtgattctcctgcctcagcctcctgagtagctgagattacaggcatgtgccatcacgcccagctaattttgtatttttagtagagatggggttatcaccatgttagccaggctggtctcgaactcctggcctcatgcaatccacctcccaaagtgctgggattgcaggcgtgagccaccaagcctagcctgaagaattctttgcaaagaaaaatatcaactcaaatttaaataatcttttcctttctttttcttttttttgagacagagtcttgttctgttgcccagactgaagtgcagtggcaccatcaattaggtatcactttcagccttgatctctcagactcaagtgatcctcttagcctctcaagtacctgagactatcggcttgcatgccatcaggcccaactaatttcgtcattttttgtagagatgggatctccctgtgttgcccagactgatctccaactcctgggcttgtgcaaccctcccacctcggcctcccaaaatgctgggtcacaggcataagccacaatgcctggccataaataatcttttttatttgttaatttagatttctgtatattaggttttatttaggggaattgcctgtttacactcatgtatttacacatcaaaacatgagttatggtggatgtattcacagcacatatgtaataaggcatgtgtaaaaatgatattgataatttagggaataaaaatggtagattttatagaccatctttgtttttgatatacttttctctgtctcaaaaaacaaaaacaaaaacaaacaaacaaacaaaatatatatatatagcctacattgttgttaactataatcaccctactctgctatgaacagtagactttatcgcttctatctaactgtatgtttgtactcattaaccaacctctcttcctccacctacacccttcccaccccctgccatcttctgatatctatcattctatgagtactctcttcctccatgagatcaacttttttttttagctctcacgtatgagtgagaacatgcaatatttgtttttctgggtttttttgtttttctgtgtttggcttatttcgcttaccataatgacttccagttccatccatgttgctacaaatgacacgattttactcttttttaatggctgagtagtattccattgtgtatatgcaccacattttatttgttcattgatggacacttaggtgattccatgtcttgactattgtgaatagtgctgtaataaacatgggactgcagatatccctttgatatactgatttcctttcctttggaaaatacccagtagtaggattgttggtttatatggtcattctacttttagttttttttttggaaagcttcataccattttccacagtagataaactaatttacattcttaccaacagtgtataagcgttctcttttctctgtatcctcatcagcatctgttattttttgtctttctaataataaccattctaactgtggttgcttttgacatatttctctacctttttgttaatctacatcatttataacatttcatatggccttttgggtctctcttgggtagttttcgtatttcttctcccctccccatttatgatgcagtcatattacatgaggatgcagttttgcagcagggcctagcaatgagatacgttgttacacatcctggcgaatctttctgtggactctaggatcctcttcatttgcaagaggtcagccatctatttcttccaattcctccagcttcacatatctccacagaatgcaacactgcaaatctgcagttctcttcatgatcctctttattagattttaaaagagtatctccaaaagatgaacatagtgcctaaggctttccaaatggagtaagaataatgcacaagaacctagaataaagttattaaatgtctgatacagttgtaatacagacttgatttttgaaaaatgtggccaatgaagagaagagcaaatgtgctatacgatggtgagcaaaaggtgttgacaggcctggcatggtgactcacccctgtaatcccagcactttgggaggctgaggtgggtggatcatttgaggtcaggagtttgagactagcctggccaacatggtgaaaccctgtttgtattaaaaatacaaaaattagccaggtgcgatgacacatgcctgtaatcccagctacctgggaggctgaggcttgagacttgcttgaaccggggaggcggaggttgcagcgagccgagattgtgccactgcactccagcctgggcaacagagcaaaaaaaaaaaaaaaaaaaaaaaaaaaaagtgttgactgaaccctggctgaaacagttttcaggtgctttcaacaaatttacacttccctgccctgagcctccctatttcagaacaaatgattacccaactgcaaactttgaattaggaagttgtttttaatatgccctgtttttctcaatatttcttgccatttcacaatcagttattgtggcattccaattcttccacaaacatatgatgtgaaacatcctgacttcgatgtcatcagggaatgtggagcattggaaagagacagattaattatgcagaagaaagtatcatttgacaaaatattatttttatttatctttggaaaggaaatctagaaaaagaaaatactttttaaagaacactgataaaaattgtttataaaatttgtttcctttaggaaacaaatcgttcccttaaaactacatttcatatctgccccaaacgagtcacatgtcttcagctaatattgcttgtttacgtttgaactttattcaattctatcacctagtaatttagtattcttaggtaatttctctttgagctcaggttaaaagttgttatttttagttttcagagttgcagaatttttttttcaagtagagaaaagttcatgatgagattctgaagccacctaatcgtatattactttgaaaaactggatatatgccgggcgcggtagctcacacctgtaatcccagcactttcagaggccgaggtgggtgggtcacctgaggtcaggagttcgagaccagcctggtcaacatggtgaaaccccatctctaccaaaaatacaaaacttagccgggtgttgtggcacatgcctgtagtcccagctactcaggaggctgaagcaggagaatcacttgaacctgggaggcggaggttgcagtgagcccagatcacatcactgctcttccgcctgggtgacagagtgagactccatctaaaagaaaaagcaaaacaaaacaaaactggatacagggcagtgcttaggtacaaatcagaaagttagaggttgctattcatatcattaagaaataatgtgtcttacgaaagaatgtagcagtttactgaaatagaagtcatacctagaaatgtaataatttatctttaattgtcagaaatttaactgatattatgaagttctaattataagaacacttatttgaggttaaaaattaccttattctatccctgctttgccgctaatttgatctctctggattagtgggttattgtgggtcctatgggtattttaaggagaggtctcagaaaactaaaaattatatatactggatcataatcattcttgtcacccactctcatctttctgtttttgttttgtgttttactacccttccccttttactaagtagtcttagtagaagaaaatttgcattaagtttgtcgtactgtattgatatggctccaaatgtttcttagcccagggtcctccccattcactgataaaagctaactaaggtaaatcacaggtgtttattgtgcaagaatactgtgaaactattcatgtaataaaaagtttgtgttagaatttcactctctttaaatcctggacatcttctgtgagtgtatctgaaagcagccagacatcttcagtatttaagaaaccctttactattctgtgtgctaggcactgtgttagctttggaattcaactgtgaatactctagccagacttcttgtctaaatagtccagaataggggttgctaaactttctttctttttttttgagatggagttccactcttattgcccaggctggagtgcactggtgtgtctctgctgactgcaacctctgcctcccaggttcaagcagttctcctgcctcagcctcccaagtagctgggattacaggcgcccaccactacactcagttaatttttgtatttttagtagagacagggttgtgctgtttgccaggttgatctcaaactcctgacctttggtgatccacccgcctcggcctcccaaagtgttgggattcagggtgtgccactgtgcccggcctgctaaactttcttaaatggctagatgataaatattttaggcttgagggccatcaggtttctgttacaactagttggctgtgctgccactgaagatacaagaatggcgtgactatgttccaataacattttaatttcaaaacaggccagctggctgcatttggtctgcaagtaaagtctgcctgaccccctacctagtccagaggacaacgggagagaaaagggattcaaagataaaaataatttagctggaatatatttctttaaataaacttattatacttagtaaaaagtcttaaattaacgtttttacttgaattaaatagtggtaaaacaggctgggcacagtggctcatgcctgtaatcttagaactttgggaggtcgaggcaggcagattgcttaagcccaggagttcgagaccagcctgggcaacatagtgagtccctatctctaaaaaaaatacaaaataataataataatggtagaacaaagtcaattttttattgaaacttggcattttattggcatattacaaagtagcattactagactagcctgaacattacagtaatattctgtccttaatgccttttgtgtcactgtaatatgagctttctgtttgttttggaatatgttttcagcctgaatattattctaaaaatacaatttactatcattcataatatatcaaatgactcacgtagctgcaaggcagtgaattaaacagaattagatcattttaaaaataatgataagagctgatgatgtaaagtgaaggtctgtatttaatttgggagggaaaagactttttttgtatattcaaagagatggagtttgacatcccttcacaacctgttacaggttgaacttgcccctgtttttttaactgatcaaaaagttccttctcttgtgtttctttttttcttctcttttctcttcttttcttttcttttttttttttctgagacagagtcttgctctgtctcccaggctggagtgcagtggtgcgatcttgactctctgcaacctccgcctcccgggttcaagtgattttcctgcctcagcctcctgagtagctgcgactacaggtgcatgccaccacgcctggctaatttttagtatttttagtagagacggggtttcaccatgttagctaggatggtctcaatctccaaatcttgtgatctgcatgcctcggcttcccaaagtgctggtctcctgtgtttttgtcagcattccacagatgctataaagttagtggtggtatcgcatgcaatttgtacgcttaatgtttggccatttgcagtgggcaaactggctatgtcgggagctggtgagatgctgcttgtggggagttgtttcctattactctgatttatctttgtttaaataagagttcctttgttcactgtttcctccacacagaacagaggatttatatcttagtgttcattctcaactttcctgttttcaaagaggaaaacatttgcttcactttgctcatttcttctccagtgcacccagaggattttgaaggcttatgccaacaattctttggggcagttggagtgtaaccattgctaaatagcagttcagtacttaatgacattcattttagtttaacaaatcattgtgagtgttgccattttttattagggaaaacatctctttcatctttcccaaatactcaacatgagtcctatggtgagagtgaaaaagggttgtattctttttttgcatcatcttaccccatctgctattttgtccctcttctatatatcactgaaatttggttctgatattctattaggcagtgtacattgcagagattatgaataactggccgaattctgaatgcaggcatgatttgttcagctcagagtgttaaatttctgtgttagctgctaacctttaaaagtcaattgatttcctttttttttttcccctctgtataatctagccagcgaatgctcagtagcttttctgtaaatagtgatgatttttcttccccaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaagtaagtacatgggaattaaagagagtgacatgcttgcacttcactgtgggtactaagtagcttctcctgctaaaatagctcttgggcagtatgggctttatcatatttaccagaggaagccgaaaatgtctttaaaagttttcctatagacagttggattgaagataaatcttagcagctaatttttcagataatcttgcattttctgtgacgtcaataaaaaaattatttaaagcaaatagaaaggacagctggtgggaaaattggcaattaaaaagccagcactgttgataatttaataagtcacctttcttcttagatcttctaataattgagaaagggtcattgagaacaatattatgatttgattttaatgctaactccacatttttatgaccagtaataatgtctagttatgcatgttaagggacatgtaattaaatgtcctccttcagccatgagttgaaataattttaagcataaaatgtttaaagaattctttctctggtccttttcagggtgcacaattaaccagatgcacagtatacttcccattgtcttgattctcattgtattttacttttgaatgatttggacatctttcccagaataataggggtgctggaaataataatagtcttcctattaagtgctaaaatatggtaatagtaaaatattaatagattaatgataaaataacaacttttgtttactgaattcctgcaatacgttctgtattatgttccatatatgaatcatctcatttaattaccttaagtgagaaggcatgtgattaagcattcaggctttgaagtcagacatcctgggctcaaattcggtctcatttgctccataggaacctttatgacttgaggaatttaatcatttgtgctttaatttctttatctataaaattggggtagttataatatctatcttacagtgatctcataagtataaaataaagtaatttatctaagcatatagagtcatatctggtgcatagcgagagcccagttgttagcaataataattaactcttgaagcagtggtctcatccattataaaaggaggctcagaagagttgtttcttgactaatattacacagcagtaagggtggagctaaggttccaatgagaagcttctttctgttatatagcccctacatgtatacaccaaaattactaggatgcttttgcaattaactccttcaaaattataaattcatataattttggaaagatattcactgtccatatgtatccacaaaatgttgaatttaggaatctaagtttctgttcccagctcttcctgttatgtcaatttgaatgagttctttcattatttgccacaagccctcaccatgtcataaggtataataaagaacaggtgaaatgaagtgcttttatttatttatttatttttcagacagattcttgctctgtcacccaggctggagtgcagtggcacgatcgtggctcactgcagcctcaaactcctgggctcaagcaatcctcgtacctcagcctcctgagtagctgggaccacagacacatgtcaccatgtctggctaatttttacatattttgttgagactgggttttgccatgttgcccaggctggtctcaaactcctgggctcaagcaatcctcttgccttggcttcttcaagtgctgggatgacagccatgagccactgctcctggctatgtgcttttaaatttgaaaggaataatatgcccaagcccaggtcactggttctcaaacttaatgtgcatcagaatcagctggctacatctccagagtttctcatttctaacaagtgtccagatcatgttaattttgtcgctccagggaccacattttgggaattgctggcctatgggaagtaaatgagaaatgatttaatgtcatttttggaagttaaaaaagattttggtggtcactggtttttgaaaactctttgaaggctgggtggggtggttcacatctgtaatttcagcagtttcggggagatggggttcttgggaaatgagccctccacccatgggatctgatgctatttccacgtagataatgtcagagtcgttcaaaccagagtgactccatcctgaataggggctgggtaaaataaggctgagacctactgggctgcaacatgatgagaccctgactctattgaaacaaaacaaaacaaaacaaaacaaaacaaaacaaaaaacggccaggcgaggtggctcacgcctgtaataccagcactttgggaggccaaggcgggcggatcacgaggtcaggagatcgagaccatcctggctaacacggtgaaaccccatctctactaaaaatagaaaaaaaaaaaaaattagccgggcgtggtggcaggcgcctgtagtccaagctacttaggaggctgaggcaggaaaatgacgtgaacccaggaggcggagtttgcagtgagccgagatcacgccgctgcactccacactgggtgacagagcaagactccatctcaaaaaaaaaaaacaaaaacctctttggccatctatttagatgagttggaatgctactttgattggttttgccaatttagatttttgtaattagggtagtttaaaaaaactctcaaattactgttatcctttgttaaaaaccaaaatcttttattattagtcttctgcttacaatataagtaaaataaatgttttgtattaataactggattgtatattgcatggttaccactatgtaacaaaattaatagcttaaaattacaagcgtcattttaaaattatttttcatgtttctggggttgactaggatggctaagtggtttttgcttggggtccgtcacacggttgctgtcagtggctggggttagagtcagctcacaggcttcctaactcatatggtgctggagggagtgtctcttagcatgctaatgcttcataatttgtgtataatgaacagtgaggatgaccagaggtcactttcattgccatctgggctgcaaaactcaaggagttgaaggctcttccggcattacttgttctccatgtggtctcctcaggatggcagtcacagagtaggcagccttcttatgtgctgacctagggcccaaaatctgtatgtgtcagttgactgagcccagatggaagctctattgctgtttacgccctagcctcaaaactactctttcaagaaaaattctccaaccgagtttttcctctactctcacaccaccacaacaatagtcaacataggagacttctatgatcaaaggtgtagggatttctccccaccaccaagcagtgaaccccagctgggtgtcctccaattcaattctcacactgttattacgggaaaggtgtcccaatccagtccccaagaggttcttggatgttgcacaagaaagaatttggggagagtccacaaagtaaaataaaatttattaagaaagtaaaggaaaaaaagaatggctactccgtagacagaggagctccgagggctgctggttggctattttaatggttatttcttgatcatttgctaaagaaggggtagattattcataaattttccagaaaagggatgggcaattcctggaactgagggttcctcccctttttagaccttgtaggttaacttcccaccattgccatggcctctgtaaattgtcgtgacactggtaggagtgtctgttagcatgctaatgcattataattagcttataatgagcagcgaggacggccagacatccctttcattgccatatgggatttggcaggttttggctggcttctttaccacatcttgttttatcagtggggtctttgtaacctgtatgttgtgccgacctcctatctcatcctgtgacctagaatactaacctcctgagaatgcagcccagtaggtttcagccttattttacccagcccctaatcaggatggagtcgctctggtccaaacacctctgacattatccacctggaaatagtgtcagatcccatgggttaagggctcattccccaagaccctaaccaccctcacctggcccagacacaagtcacaagtcctgtcctctggaatgtctgactgagaggcatcaagttggagttcccatgaccccctcttctggtttgattaatttactggagcagctcacaaaactcagggaaacacttaggtttagtggtttattataaaggatactgcaaagtgtatagatgaagcgatgtgtagggtgaggtatcgggggatggagtgcagggcttccatgccctcccggggtgtgccaccctttaggaaccttcatgtgttctgctatccggaagctcactgaactcattcttttgggtttttatggaagcttcacgtcaatattccttcccctggggtatgaggcaggaccttcaccggagagggtcttttattttatttcattatttttaaaatataagatggggtcttgctatgtagcctagggtggtattgaattcctgggcccaagtaagcctcccgcctctgcctccgaaagtgctgggactacaggcatgagccacccagcccctttggagaggatcttaagactcacagttagaaaggagggcaggagaaggtcagagagattctgcttcctgcccctgaggcctaacacacccagcattataacaaaagactgtaacaagggctatgggagttaccagccaggaactgtaaatcacacagtattatttctgccttactcttatcagtcttgatggttacaaaggcctgtccaagttcaaaaggaggaaaaaagcactccacttcttgatgaggaaggtcagggttctggaagagcatgggggactggaaatattgttcggccatttcatggaaaatacagtctgtaatagacatcagtgataaatggggagatatggtggatgtattgttttcctctgagtgccaaattgggttctaagatttcacaggccagatattattgaagtggctacgttgtctggggtatataccttggggttcgtcattttgtgccaggaaaatttaggacaaggactcacacgaggagtttaggagtggaggtttaataggcagaagagaaacagaaacagttctttctgtagggagagagggatcttcgagggaaaagaccatccagcagcagatgagctggattttatagtcaggtttgaggaggaagtgtctgatttacttagggctaacaggttggtttgatcaggtatgacgtttacatagcacaccgggaagtctggttgccccaccctaatccttttatgcaaatggactttcctagttgattggagctatcttgtctgctccttactgtacaggtggctgacaaagagaagggaagatggagccgccatcttgaacatgattgacgcagctgtggatatctatgtctgcagcttgattttacaggctgctcttctttagaaaggggctgcttttcattaaaacaaaaaccttactgaggactcttgtaccctcactatctgcaggtgatttcttaactcctgtatcattattatagtgtcataggaatctaggaagtgtgattgccttctggagagaacttcagggtccctggattttctcactaatcatattcatttcattccctgtttacctgtttaataaatgttgagtggctactatgtgcccagggctgtgcaaggtgcctggaataggacggcaagcaaaccaaccatgaccttgctctcaaagaattgttttctttctttcttttttttctgagacaaggtcttgctctgtcgcccaggctggagtgcagtggcctgatctcagctcactgcaacttccacctcctggcttcaacagattctcctccctcagcctcccaggtagctgggattataggtgcccaccaccatgcccggctaatttttgtatttttagtagagacagggtttcatcatgttggccaggctagtctcaaactcctgacctcaagtgatccgcctgcctcagtgccgagattacaggcatgagccactgcacctggcctgttttctgtcttttttttttaacccccacatggaaagttaggcagggatttaatttcaaagagtttcttcccaaatattgtggtgaaacatctagtccatttatgtttcaggctttttcatagatattactgtttctcttagactgacagacttaggacatcacatgattgaatgtcaacctgacttttaagttcaataatagtttcattttttaaatgcaaaattaaataggagtaatatccttgaacatgtttctccttcactcatcggacctattgagtctagaatccattttattttgagagctccaactacatgtggtttctgttaatatctgaaagtaatttttaatatctgaaagtttcaaatagtgataatatttgaaggtttcaaatagtggaggagagacgcaaactgcgagtagggaacgcggattgaaggaaatgaaaagttgataataggcacttcattttcagattataacaaatatttagtgaaataaagcataattttaaaaaatggataagacatgtatgtactatttaatgtgtactaataaatgaatgctcatatttgccatccagataaagaaatagaacagttgaacatcacagaagccctcgcgtgtcccattcagatcacaaactctatctttctactggtaaccattattcttacttttgtgataacctttctttgctttcctttatggagtgtgtagattcttaacactatagttttgcctctttttgaacttcatgtaaatgaaaaaatgtatatattttgtgtttgtgtgcatgtgtgtgtgtgtgcttgcacacgtgtgaataccccttattgtttgagcttagtattatgtaagatctaaccaggaaggaccaacctaacatttgtggggcctgggacctaagtatagacagagatgacatggtccactccatatctgttcccatcccagttctgccctgtgctacaaggggtcttccagacactgcataggtacccataccacctgcaggcagatgacctttgcctgtcctttggagttaggcctgggtaccctactagtggtgtctgctcttgggatgataaacccgaggggcttatcagctttatatatatatatatatatatatttttttttttttttttttttttttttttagctagcatctctctcgttcttccaggctggagagcagtggtgtgatcttggctcactgtaatctccacctcctgggttcaagcgattctcctgcctcagcctcccaagtagctgagattacaggcacgtgccactatgcctggctaatttttgtatttttagtagagactgggtttcaccatgttggcatgtgagccactatgcccggcctcttttttttttttttttaagagacagggtcttactatgttgcccaggctggtgttgaactcctggcctcaatagatcctctgtccttggtctcccaaagtgctggctcagtcattatgttctttactgccatccattgcagtataaaaagaataacagttttccctcagaatattcttggtgaaacagtaacaattattaattttattaaatcttggctcttgagcaaatgtcattttaatattctgtgtgataaaatagcaatgtcacataaagtgcttttacatacttaagtactatggttgtctgaagaaaaaggagttgtgtgattgtcttgagtttgtaagtggaactacttttttcatcgagcaccgtttttacttgaaataacaaagtatgaatatgaatgcagatttggccatttggcagatttttatttatttatttgagacaaggtcttgctgtgtcacccagactggggtgcagctcactgcagcctttacctcctgggctcaagtgatcctcctgcctcagcctccttagttgctgggaccacaggtgtgcagcaccatgctcagctaatttttaaattttttgtggagacaaggtctgaccatgttgcccaggctggtctcgaactcctgggctccagcaatcctctcgcttcagcttctcaaagtgctggaattacaggcgtgagccacggttcccagctcgccttttcatatgtttattgggttgctaaatatgttcttatttgaagtgcccacttgttcaagttttttgttcacttttttattgctgtctttataattttttgatgacaagaaatatgtttaaattaaaggcagttttgtcaatctgccttatgtttggaatttgttgtgtctttaaagactcttttcctgcccttatattataaagatatcttatagtattgatattgtcattcacagttaggtctttaatcctagaagttgatttttgtatgaagtaagggcccaatttatttttttccacctatgtatacccagttttcccagcaccatttaaacgggcggtactttcccctctgatatgtcatgatgacacctttgtcatgtacacatgagtttgcttctggatctctatttgtgttcagttgttttacttgtctgcataaatgccacagtcttggtttctcagtcattataatgagccttgcctgctaggaagggtccttctactttgttctccaagagtgccttggatattcttggtcattttctttccatataatttttagatttggtttatcaagtcgataaacttttgtcatgcagttttttaaaagaaaataaagtgccctaatgtgattttttttaatttggattacattgaatacataaatcagtttggggaaaatcaacatctttataatattgaggctttttatccatgagcatgaaattgctttctacattaataacttggtaaagttttatattttccttatggatctttcacttcttttgttagatttttctccacctaagtactgtatcttttaattctactgtaaatagtgtttttattttttaactgctgctattacataggaatataattttgcatctggccagcttgcctaaacagatgatttcaaaatattatctgtcagattttctgtgttctctatctctgtaatcatatcatctatgttttatgatctatgacagttatattttttcatctccaagctgatattttaaatttcattattcttgctttatactggttgtacatattcagttagagtgattgcagtaggcaatttgcgatgttcccaatttgataaggaaagcttttacattttaccattaagtataacgtttgcgagcttattatagctatcctttgtcacttagggaagttatctttgttttttagttatctaggaaactaaaaaatcagaaaagttagtttgattttatcagatacatctgctacatctaatgagatgatcatatagtttttttcctcccataaactgtgaatataatgaatcacattaattgatttttttaaatgttaaaccaatctccatttctgggataaattcaacttagtcatgttgtattagccttttgtatatcttatatctataatactgaatgagattatcatactctttacatgtatttgaagccatgtcattaagtgcatacaatttttattaaatttttaattgacaaataattgtatttatttatggggtacgatgtagtgttttgatatatgtttacattgtagagtgactaaatcaagctaattagcatactcatcactgaacatatttatcatttcttgtggtgagaacatttgaaatttaatctcttagcaattttgaaatatatgatacattattattaactacagtcaccatgctgtgcgataggtctcaaaaacttattcctcctaattgaaattttgttccctttgaccaacatcttccaattccccaacccctagcctcctctggtaaccaccattctactctctacttccattagtttgactttttcagtccacatatgagtgaaatcgtgcagtatttgtctttctgtacttgtcttgtttcacttagcataatgtccaacaggttccccatgtcattgtaaatgatggaattttcttttttatagctaaataacattccatcatgtatacataccacattttctttatcgattcatctgttgatggacagttaggttgcttctgtatcctggctattgtgaataatgctacaataaacatgagagcacagatacctcatgctgatttcaattcctttggataagggtccccaaaccccaggctatggaacagcagtggtatgtgtggcctgttaggtactggatcgcactgtaggaggtgagcagctgcgagtgagcattaccacctgagctccatctcatctcagatcagtggcagcattaggttctcataggagtgtgaaccctattgtgaactgtgcattgcaggaatctaggtggtgcactttttatgagaatctaatgcttgatgatctgaggtagaatgattgcactctgcaagactccccacgctcatccctgtggaaaaattatcttccacaaaactggtccctggtgccaaaaaggttggggactgctgcttttggatatatacccagaagtgggattgctgaagcatatggtagttttattttaattttaatttaatttagtttaattaatttatttttagcacctaggctggaatgcagcagtgcaatcatagctcactgcagcttccaattcctgacctcaagccatcctcccaactcagcctcccaaatttctggaactacaggaatgagccatctcactcagccctatttttagtgttgggaagaatctcaaaaagtaatgactgtactaatttacaccgctaccctcagtatacaagggttccatatcctcactaatacttatcttttatctttttgatagtagccattctaagtatgtatagttttaaaattatgaagtttaaattgaaccttaggaagttgctactctgtcaccaggctggagtgcagcagcgtgatcttggttcaccacaatctccgcctcctgggtttaagcaattctcctggctcagcctcccaagtagctgggactacaggcacatgctaccatgcctggctcatttttatatttttggtagagatgggtttcaccatgttgtccaggctggtctcgaactcctgacctcaagtgatccaacagccttggcctcccaacgtgttgggattacagacgtgagccatcacacccagccttgaagttgccttttttatcttcagtagtgcttcttggcttaaattcttttgttttataaatagtaatggaagcttgccagttttattttagaaagtatttgcaggccaggtgcagtggctcatgcctgtaatcccagcactttgggaggccgaggcaggcacatcacttgagcccaggagttcgagaccagcctaggcaacatggcaaaacctcgtctctacaaaaaatacaaaaaattaacttgggcgtggtggtgcgcgcctgtagtcccagctactctggaggctgaggtgggaggattgcttgaacccagggggtagaggttgcagtgagccaagatcttgccactgaacttcattcagcctgggtgacagagaaaaacaactctgtctcaaaaaaaaaaaataaataataaaaaataaagtatttgcatgatatatctttttctgtctttttgattcagatattgtcagctgagtccaatctaacaaacttatattttaaccgaagctttagtactgttatatttaataaactaataatatatttgcacttaaatacaacatctaattttatgctttttaattatacatgatttgtatttctttttttcccatgtaagtttttagggtatacatctttaaaggccttacttttcattatcgttcagtttaacttattttctaatttccatttttcttctgtgacctatggtttagttagtggtggatttattttccaaaatatggatggtgtccagtcaaacttttggtattgatttctggcttatcttgtgtttggaaaatatgtgaattctacagctggtctgtgtaagagttctctgtatcagttagggaagtttgttcttcctgttgttcatatcttgcatatctttactaaggtttagcctgtttgttctataaattacttagagaagctgtgttaaattttctcactaaaattattgatttttgtctttctctgtatttatcagtatgtatctactgaagtcttttcaaatccctgatcagtggtttgttcgggacagcactttgattgagggaggtgacgtggcttaacatagtatggtcttgagctgcctggtttctgtgatttagggactgaaccagctctggtcacatctggattatctactatccagcattcaaatgaaccagattacatgaaaggatatgggggtactctttgggggccacggtgccacaaggcctttggtttcgatctccattgcctagggaattaacctgtgctgtgtgattctagatgttttcttcctgctcccttaaataacacctaaatgtgttattcagcagtgtggctcctgctaagcagaggagaactcggaattcctaccaaattctgataataaaataactttcctccacctcaaccattgtttttaccagtcctgtcaactgttagctttcctggatttaatgatctcaagttgaggtcaatgtcaacagctttatgggatgaataagatgaacgcccataggaaagtcagtctcttgaacacgggttgttttcttttggttaccctctaagattttttctctttgatctccagttatttgaaggattgaaggcatttcgaggagtagataataaaattcgactgtttcagccaaacctcaacatggatagaatgtatcgctctgctgtgagggcaactctgccggtatgtaagtgtaggagtttcttttgtgtttcttttaatgtaacgggtcacggtgttgaccaccaaataaataatttctgaatagttagataaatattcagtacaaaccatatgaacattaacattatttctgatctactttagttaggtaaaaatacaagaaaatggccgggcacggtggttcactcctataatcccagcactctgggagactgaggtgggtggatcacttgaaaccaggaattggagacaagcctggccaacatggtgaaacaccatctctgcaaaaaatacaaaaattagccgggtttggtggcacatgcctgtggtcccatcggtgtggctgaggcatgagaattgcttgaacctggcaggtggaggctgcagtgagccaagataatcacatcactgccctccagcctaagccgcaaagtgagactctgtaaaaaaaaaaaaacaaaaaacaaaaaacccaagaaaataatatcatttggcaattccacaattttttaaaatcagtgtctgtgggggattcatatgcaagtgagagatgaaagagtaaggaagaaaaatgtatctcaaactaaaataatatttgaagaccacatgaaattaatattgaaaatggaaaatatggtgtgcagcacaggtattttgcggatattttgcctaattgctttagatgctagcaagatatagtaacttaattattttgatattttatcttaagtaatgttttgagataaaaagatatcaaaatggtttctcatggccattgaatcgtggctgtcacaatgtttcttatggagcagaaatcattgtaagatgggttagattttttttttgagagagagtctcactctgtcacccaagctatagtgcagtggcacaatcttggctcactacaacctccacctccggggttcaagtgattcttgtgcctcagcctccttagtatctgggattacaagtgcacgcagccatgcccagcttaatttttttaaaaattatttttagtggagacatgatttcaccatgttagccaggctggacttgaacttctggcctcaagtgatctgcctgcctcagcctcccaaagttctgggattacaggcatgagccaccgtgcccagcttcagggatttagcccaacctatgcattcaggaagcctgaggacggctaaatccaagtgttcttcattcctctgcctatttttgtaacccgcatttcacccatctcctttggaggccataatatagtagcagaggggaaattaaggtaaattctttggactagggcatagtttcgctcttcttctcattacagctagatcactggggaaaagtctttaaaatggggctggaaggaaagggaagtaatatttgttagacatcaattttgctaccaaactgtgttatgtagtttcacattccttatctgtgtaatcacagcagtaaggcgttgctaagaagattatttgttgtacagtttattagtgcctttgtacagagaagaaaacttgagtccagagagattaaatgacttgtctgaagtcacaaagagcaaaaggacagggcaagaaattagatccaggtgtttttattcctggtcaagttctcttctcactgaattctgtctctagacagcaataccaggggctgaggcaggtgctacagggttcacctatatgattggcagtcccaatttctataacattactacattattattgctgttacaggtcaatatttaaatagacaaattctgacttcatgagctttactcagatgcttatgactgactcatttctaccttaggtgacccatcacatctctgaaagtatgtttctctactttgcaagtgagcagagactaaattattttatgaagtatcacccatctagtagatgtaatttttttttctttagaaataaagtgctctttgcttttgcccattttcctattgggttatctatctcttcattgactttggggatatccaaatatatataccagttaaaattctttgttgatcatgctaccaataacttcacccagtttgttgctttacatcttttgaagaacggaagtctttaagtttcaaatagtcacattttatccatttttttccttcatgatttgtgttttacatctcctacttaagaatcctttcctaccttaaggtcacagagatattttgtactttttaaataaagtcttagtattttgtcacatttaagtatatcatctaattagaattgattggggggtatggtaagatgtagggatctaatcttatctttcacatgtggatagctcgtcatcccatcacaatttttggggggaaaatcagaaaaaattgtttggttttattattactttaaaattttttttattggtaccataaattatacatatttatgaggtacactgatgttttcatgcatgcatataatgtgtaatgattaggacaaataagaaagaaataaataaaaattaggataattaggatatccatcacctcaaacatttcttatttttttgtgttgggattattaattttttaacagtttaaatgcttcagtgaggatcatttattattgccacattgtgagaaaattctgtcatttattatgtttttcattctttcaggtatttgacaaagaagagctcttagagtgtattcaacagcttgtgaaattggatcaagaatgggtcccatattcaacatctgctagtctgtatattcgtcctacattcattggaactgaggtgcaaactgactccttattttggggtactttgctgggcaagttattattgtttattgttgtttgaaacttctagcatatagtttgcagtagccccccagtagcatcattaatgacttcttccttctgattgtcaagattagaggtagcaaacattttctgtgaagcgccaatcagtaaatattttttggctttgtggccatatagtttctaataagaaattagatccctacctcttaccataccccaaaatcaattataattcgattatatacttaaatgtgacaaaatactaagacgtttattaagaaatacaaaatatctctgtgaccttaggtaggaaatgattttttttttttgaggtctctctctggttttttttttttgcccacgttgtcgcttaggctggggtgcagtgatgcaatcacggctgactgcagctttgacctcctgggctcaagtgatcctcctgcctcagcttcccaagtagctagtactacaggcatgtgctaccatgcctagctaatttttaaattttttgtagagatgatgtctcactctgttgtcctggctggtctcaaactcctggcctctagcaatcctcccaccttggcctcccaaagtcctgggattacaggcatgagccacttcacctgaccggagaggattcttaaactctgccattttagtactaaagcagccatagacagcacataaatgagtaaatgcagtgctgtttgccttgcccaattaagactagtcattattttctaagtttacaagtgcagtgcctcccattgtggcagtacttctctgaggtagaaatggttttaaaatttaggggagggagagctgctaattttcattttcatgaggtcttgggattacttggcatggagtgagaatggaggttccccttcccacatagaaaaatggtgaaaataaagttcacagtgggagttaaggaaggaaattgaagagctgggatggtaggtttaaataacatgaccttatgatttcctggtgggtcacagtctcttggttgggtgcccttgtgaataaaggcatggattgggcatgcctggaggggccaaggccttttgagcggacgagtatgtttatatgaagaccctgtcacctgtctctggtatctgctaggcagctgtggcttgagagtgtgatattgagggataattgatggaaggagattgaatgtggctggcaggtaaagagatagggaacatatggagatatttagaataagagagtgtgagatagagcgcttttgctatagcctagccattctgttctctactaagtgttgcggggttaccaggttttctactaggctgtatgaatgcaaaaggtagagagatatatagggccatggaataaataccgaagtgttttctttggtatccttgatacctttcgaaagccgtgtaaggatctagataatgaatttcgtgaattgcagtctctctgacaagttttaaagaataggaacaattttaaaaagtcatctacttccataagttttttgacattttaagataattgaatttttttttttcagcttttaagttccagggtacatgtgcaggtaggtgtgttatataggtaaatgtaagccatggtggtttgctgtacaaatcaacccatcacctaggtattaagcccagcatccattagctattcttcctgatgctcttcctcctcccgccccttccgacagaccctagtatgtgctgctccctgcatgtgcccatgtgttctcattgttcagctcccacttataagagaacatgcagtgtttggttttcttttaatattatttttaactttatgataggaaggagtactttttaaagttggttgaaacattgttactgatctcaaagcactaccttccagttattctgagatactttttcagtctaagatctgatactcctattcctggtttgttgagagtttttgtcatgaatggatgttggattttgtcaattgctttttttgaatctcttgacatgattatgtggttttgtactttattacattattaatgaatgaattatatcaatttatttttggatgttaaatcaaccttattttcctaagctaaatcctacttggtcattgtgaataatccatttttttatcttgctatattcagtttgctaatattttaagaatttttgtttcactgttcatgaaatatattgatctagttttcatttttcttttctttcttttttttttttttttttacatctccctcctcttcctcttgatctagttttctaatacagctgcactccaacttacgatggtcctacttaggagtttttgactgtatgatgtttgaaaacaatatgagtttagtagaaacttactttgagtacacataccattctgtttttttgcttttagtacagtattcaataaattatgtgagataaccaatactttattataaaataatacacttttagatgattctgccctaccataggctaatgtaattgttctgagcacatttaagataggataagctaagatacgatggatgtttggtaggttaggtatattaaatgcattttcaccttaaggatattttcaacttaggatgagtttattgagttgtaaccccatcacaagttgaggaacatctatgtatctaattccatgattcagtaaattctttagactgccaaaatcctgtaatctagagttagacaagatcttaaatcaggttttgtggtccatcttgtagtcatgatcattctcactattagggaattcttaactttttgcatttgaatcaccgaggtgttatttaaaatacacatatggaatccaagctccagagactctgagtagatctggtgagtgattgtgatgcctgcccacattcaagaaccttagtacaaaagccctgctgaatggttctctttcactatacactctatcaacttatgtacttgatcacactttggacctcaaaatcaataatttttaaaaatctacttcctaagttgtgaggtacgaattgaaggaaataatgaatactatttggggagtcaacattatttattaacgaataccatttggggagccgacattatttatatttggttggtatatttgtatcaactatcattttctaattaatggtataggcagaataaaccatcacttgtgattcagaaaggaacatgatacaaataacatccaataatgtatatggatttaaatagatctgccccctacagatgttacgcaattcatgttggtaatgatcattcattaggttttcgtggtggctacatttgatatgtgaagtactggctggaagactggtgccagtagcttcaggtttgctgggattctttcatcagagatgactagctttacttatctttttatgttgcatgtttctatgatgggcctatcctgtcattgtcttcatagtataattgcaagctcaactctgtcagttatgtgatttttttttttttttttggtcctgtcttgcttttggctgacttctatatgtttttatttcatgtccttttcatagttagattaactgggtcttatgtccaagagatattttgatttctttgaatgaataaatctatgttaggctactgtattaggttttatagacacctagttgatcacttgtgtccagtctctattccctggtatggtagttgctgtgtttatagaacattgaggattctacaatggacacattggtgttgggccccagcccagacccaaatcgaaatttctagagccaggatcagagactctgcattcaacaaactctccagagatttcataaccacttttaaaggactcaccatcccaaaccttgttaaggaatgaaatatatgtctgccagtaatttcagtgctttaagtcattgaaagctgaacttttaatggcaccaaagtggaaatatttatataattgaaagctaaacttcatcctaatggcagtgttgagttcacttccataggccctgatataacagtctaatattattgtttttcacataaaataagattcagtcactgccatataattagggagtggctctgctattggatggacttaaaatatttcattatgtttgccaagctctgtctctttacatgttttataattaactgatccttcatttttattttgttttattttatttttgagatagagtctcgcttggttgcccaggctggagtgcaatggtgcaatcttggctcattgcaacctctgcttcccaggttcaagtgattctcctgcctcagcctcctgattagcggggactacaggtgcgtgccaccatgcccagctaatttttgtacttttagtagagacggggtttcaccatgttggccaggctggtcccaaactcctgacctcaggtgttctgcccacctcggcctcccaaagtgctggattacaggcatgagccaccatgcccggcctccttcatttttaataatcttcatagatacatacttgttgtactaatgtttttgtgcagttcctcatgataaataattaaatcaattactaaaatccttatagatttatgatgataataaatggaagtgtgtattattgaaacatgtttaattaactgttcatatataaccagtgagtagggattggcaattaaaaataccaggctaccagtgcatggaaatttgaagaaaacaacaacctgaaattcagaatactccaaaatctgaaactttttgagcactgacatgactaaaaatgctcattggagcatttcagatttcattttttcagattagggatgctgaattggtaagcataatgcagattaatccaaaatctgaaaaaaatcctaaatcaaaaacagttttggtcagaagctttgtggataagggatagtccaagctttttggactgaagctttttggataaggtatagcctataatacataaatacataatacaggataatcactgacctgaatgtatagcatcagtatggtacacaaatatttaaatccatgtactttgttggatattatgttatataaacttcttgtaaaaagtttagagagtaaaatcattcacattaccaaaagatttctcatatttataaaaaggattatagcagcattttaatcagtatctcctaaagtatttatttatgggttgttaaatctaaaagagaaactacagtctggagggctctaaactactgctgattacatatcagttgggaattaagagaaaatctcagatcataatatttaaataaaaacatttacatgaatgatttctaagttttcactttactagacaagaaactaaaattatatgactgtcatgttcaatattggatacttaacaacactacatccaaggaagccaggttttgctgattttaacctcgtcctgttgagtaactccatgcaggtacagtggtacaaacacatgtggacacacagacccagacctttatttcctcggggattctggtaagtgtagaggtgtcttgaccatagtcaatagcagaaatatgcacaaccacaagctctgaaattccatttgattgttgctcttagccttccactttttaggcatatgtcagtcccatttcatcccacccactctctccatttgggaggtggtagagtgagacaatactgaactataccagggctgagaataagtgtctttgaaaagggtcgaatctgtgatgctagagacagccctggaaactgtcaggagttagcccaaccaggactgtgaccagatcccaggctgtccaccacagatttgcaggctacctgcagatgtgactttttcaaatgtactcaaagacaagctgactttggctaatgcagaaattaattaattcctctttttcagtaaactttatcctcctacacttagattgtctgtaagtacatctctggagttgagctcaactagaaagaagctgtctgcatttagttaataccagcattggatgcacacaatataatttgaataatgtagagcaacattttaatcatctctcataagcagtttccccatttgcaacttcctgggaaatcttacattatgaaatgttcattagaactcccattttaaaaccctgctgccattttgtgagtgggcagaagaaaggctggagatgagatttgtctgtctcaaatgattcactccttcatttctggttcactccacagggagcttaaggacatgtgcgtttcatagacatgcctttcttttccttttatcaccttgttaaatcttaagattgaacatacaattcagcctgtaatcatatcaattcccatgaaaaatattttccttattcactgcctctatttgtgcttatacatctgatcatctttttcctttactttacaattagtttctatgaacagaagaatctgaaagatttaaagactagttagcacagcagcaatttataaatcattaatttgggtactgtctatacatttaatgtgttctttttcatagtcctatgtgaaatacatatacatatatatatattccactgtttataaacaatattcagttttatttgcataactcaatatattttatattaacagctccgtttttagtgtcttaagacatcgagtctgtttttagagatacagtctatttgccttgattttagcctgttataatcagcttattattatctggccactcttaccagtgagtatcatcttgaggctgttcttgctcatttcaacttgtcacaggggatgttttttactctttggagtttaggtacaccaggttattaattatgctcctgattcatggtacttccatcatggggcatataaggtccctgtctttgttttattcccttctatcttcattcaccactctcatttcctctctctccactagaaatcattctcaggaatcaaattaatattattctggcttatatgtgtttttaaaaatctcatcgctttttatacatgtaattttaatttatgtaagagactttgtcctacagatttcattgtgtttcttctctttttcgcccagcactgtgtgttccatttctatccagtctactatgtgtacatcaagtccatcatttctaactgttgcatagttcatgatgcgaggcatcttccacattgtatcccaattccctaactggaatcccagttccctgctacctcacacaatgctccagtgaacagctggaaaatcatacaacccaaggaattattgaaagtgattatatcccagcaaaaggcccaggcccatcttacacttccaccccaagaaggtactgctacttttcgggaatggcctggtctccttggcgaaattggcatttgatctgttctcatcactgtcgtctggcatcagaagtgaccccacttgtcaggcactgtactcagtgctttccatgcactaactctgataacaatcttttttttttctttttttgagacagagtcttgctctgttgcccaggctggagtgcagttgtgtgatctcagctcactgcaacctccacctcccaaattcaagcgattctcctgcctcagcctccccagtagctgggactacaggcgtgcaccactacacctggctaatttttgtatttttagtagagatggggtttcaccatgttggccaggctggtcttgaaatcctgacctcaggtgatccacttgacctcccaaagtgctggaattgcaggcaagagccactgagcttggcctgataacaatcttgtgagcaggtgcttatgcagtattttagggatgtgaaagtaaggtccaaagcggtgaaataagagcctgtattctcttaacctccatcccgcaacatcttttatgtgtcagtccctgcactaagtctagggatactgtgctgagcaaaaactatcttcttgctttcacagagctcagtgtctggcagggggtcagactttcataatataaacccactaaatgagtgcatattgatggcggtcactgctgtgaagaagtgggaatggttagcatggaaacatagccccaatgggggcaactaagttctttcccatctcattctactatgtctactttcatctctacttttttcttttctgagctatcagctttcttgctctcaactatatttgatgtatttaaccagattttatatattgtattatgtattttataacatgtatatatatcatataacatacacatatacatacatacacacagccaattaagtctcaagttcaattacaatgcttctaagtttaggactattcattttcattttggcagagaaattatctggtaaaaaattcaagtagaaccaaaggtatacaatagatgggaagtttccttttcactctcacactctcatttccatccagggttctacaattcatctccttccaagcaattcctattgccagcttttcttataccctttcagaaatacacacacacacacacacacatatatacacacacacacacacacccttacatgtgtttgtacattatctctctttttacaaaattggcagtgattctttgtcctgtttctgccactactcaaaaattttaaaacaaattacacacctataaacatacaatttaaagaaaagagtgaaagtgaaaatctaaggacccagcacatggttaagatgagagcatgatgggttcaatggaaagcctttgtgtacctttctcctttgcctccgttccctctccaatagagtcaaccacgttggaggttatagcacttccttctttatgtccccccatctcccatctggtatggtattctcttttactgcagatggacattttggcagacatatgtagttgcttctctttggtatttacctaggagttgaagtgctgggtcacagggtgtatgtatatttcactttagtagatactgctgttgtaggactttctccttagtttagctaaagatggggtccttgtcccaaggccatgaaaaattaggctcgcagacaatttgaaaggtgagaataatggaacttattgggaaaaaagggaaacagggactccccacaaagccagggtcctgctagcatgcttcctgccttgcagattgaatcccaggtaccacccaggaagaggaggggccaggctcctccccactgtgaatggtgtgaccgtctgtggctccccagtgtgcactcctcccagtgtgcaggccggttggagtttctctggggtcttcttcccacttggctgtctcactgccaaactcccaaagtgcttataccagtttactctcccatcagtggtgtatgtatttgcttcatttctttgccaatactgatactgtcttattaactttcctcattctaatgtatacagtcttgtgttatttgtggtttaatttccctgagaaccaattatgttgagtaccttttcataggtttaccagctacagaagtcctcttgtgaagtgcctttgcaagtcttttgtctttttaattttttgcatctttgtatattctaggtataaatcctttgatacatatatcacaaataacttcctagtctatggcaaatcctatgttggataaacgtactgcaaatagtttcccagtctgtggctagcttctgtgtctgtgtcttgctttgtcactttcttactgatatcttttgatgaacagaagtacttagttttaaagtagttaaagttttctttatgttttatactttttatgcattttaaagaaattttttgttactccaaggtcatacaggttaaataaattcttactccaagaacattcttttaaagttttgctttttttcatttaaatgaaatccatatgaaagtgaactttgttatcaagtaacatatacaatttcttttatttttctgcacggagaccaagttgtcccatcaccatttattgagtggtctatcctttcctcactgattacagtgccagttttgatatgtcatgtttccatagatgaagaatattttggggctctctatctgtaccttcctttttaaaaaatataaatagtggtgatactatgaacaattttgtttgtattattgttttttgcacttaaaatttgtcttggagatcttttcattttggcacatacggatacacccctatttttttttccattttcctagatgtggggtatccattggacatatgtaccgtactgaatttaatatagaatgtcataaattacaagatgtaacattattttatacactgagatggagaatcaaactgcaacgcagtacttccctgatcatcctgagtgattcatgagttagttatactagcctcttatttctttgaggtgtacgttttctgagggaatctgccatttctcctgccatgagttgcattgcttggctcgtgataggcatttttatttttgcatgtaattttgtaacaaatgctaacactgctttatcttctttttgtttttgtttattgagacggagtcttgctctgtttcccaggctggagtgcagtggtgcaatctcggctcactgcaacctctgtctcccaggttcaagcgattctcctgcctcagcctcctgagtagctgggattacaggcatgtgccaccatgctcggctactttttgtattttttgtagagatggggtttcaccatgttggtcaggcttgtcttgaactcctgacctcaggtgatctgccccactcagcctcccaaagtgctgggattacaggtgtgagccaccagccagctttatctttttaaaggtttcttcctattgtgggtttcattagagggcttggttgttgctttgcaagaaaacattgacttgcttttgtttaatagtcttataaatatttgtttcactaacatcaaatacatgccatgctcctgcttttgtgcttttctgtgcagtaacttttcttctcagtgctaaatcataagtttttaaagacatttaacatggcacactcaacatgtgtcaccaatgcccatagccactggaagtatcatcagtgtcaacagctatgacgtttggcaatgacagctttgccataactgctgcttagccaataacaattgtggaatgctgagtccagatctcaaacatgttaaaggtaaaaaaaaaaaaaaaaaaagatattttcgagtctgtaaaacatggtagcgtatccggaattggtgggttcttggtctcactgacttcaagaatgaagccatggaccctcgcggtaagtgttacagttcttaaaggtgtcgtgtctggagtttgttccttctgatgttcagatgtgttcggagtttcttccttctggtaggttcgtggtctcgttggctcaggagtgaagctgcggacctttgcggtgagtgttgcagctcttaaggcggcatgtctggagttgttcgttccttgcggtgggttcgtggtctcgctggcttcaggagtgaagctgcagaccttcccagtgagtgttacagctcataaaggcagtgtggacccaaagagtgagcagcagcaagatttactgcaaagagcgagagaacaaagcttccacagtatggaaggggaccccagcaggttgccactgctggctcaggcagcctgcttttattctcttatctggccccacccacatcctgctgattggtccattttacagagagctgattggtctgttttgtcagggtgctgattggtgcatttacaatccctgagctagacacaaaagttctccacctccccactggattagctagataaagagtgttgattgatgtatttacaaaccctgagctagacacagagtgctgactggtgcatttacaaaccttgagctagatacagagcgccgattggtgtatttacaatctcttagccagacgtaaagattctccaagtccccactagactcaggagcccagctggcttcacccagtgtatcttgcaccagggctgcaggtggagctgcctgccagtcccgcgccgtgcacccgcactcctcagccctcgggctgttgatgggaccaggcactgtggagtgggggtggcactcgtcagggagactcaggccgcacaggatcccacagcggtggcggggggcgggaggctcaggcatggcaggctgcaggtcccgagccctgccctgcagggaggcagctaaggcctggcgagaaatctggcccggcgagaaatctagcgcggcgccggtgggccagcactgctgggggacccggtgcaccctccgcagctgctggcctgggtgctaagcccctcactgcccggggctggcagggccagccggtcgctccgaatgcggggcctgccaagcccactcccacccggaactccagctggcccacaagcaccatgcgcagcccgggttcccgcccatgcctctccctccacacctccctgcaagctgagggagccagctccggccttggccagcccagagaatggctcccacagtgcagcggcaggctgaagggctcctcaagcgcggtcagaatgggcgccgaggccgaggaggcaccgagagcgagtgagggctgggagggctgccagcactgtcatctctcagtagcataatttatataaccagtctcttgttgattaaccattatattattgatacaacaaatataagaactgttactagtaaattgagtaaagcaggaaaattaaatttggtctcttactgatcaaccattattagattgttgataacaacggttataatgttgatcaaccgttatattgttgatacaattatatttgatgtatttaaccagattttatatattatattctatattttataacatgtatatgtatcatataacatacacatatacatacacacacacagccaatataatttcactctcagtttcttgttaatcaactattatattgttgatacaacaaatataagaactgttactagtaaattgaataaagcaggaaaattacatttgggagccttaaagatgtaggttttcttcaagaaatttatgttatagttatatcccctgttgcatgtgaagacatacattcaaggatacttactgcagctcacacaatttgctgataggttggatgtgggtgtgagagaagagatgctgttttccttttgggcgatggcaactggatagtaatcagttactaagatggagaagaatgagaaagaagtctttttttgtttgtttgttggagtgatatgggtagaataaagagttaaaacagtcatgcatgtaggtactatagatgtgaaagtctattattcaggggagagtttggaatttaagggatagattcttgtctttaagcataaaaatgcctttgaaggtgagaaactagattacatctttaaggggagaactgtagatagagatgaaaagaaggcaaggactaacccctggggcaggtcagcatttagaagaaagggagtttgtaaaatgctaagctgtctgagaagtagcagcctgcaaggtagaaagaaaaacaagagaggtttagtggactggaaaccaagtgaacctggaaaccacaagcagctgtggcaaatcctgccacagtgagatgaggcctgagaactgagtattggatttgtcaatgtggaaggccttggtgatcttgataagcatgtgttagtagggtggtggggttgcagtgtttgggatttgagagagaatgagagaatgggtagctgtgatgctgaatatgtata[450 bp omitted]gcctagtcaactgagccaaactggatataaccacaaggtcaaaggcaggagccagtgaggagatcttggttttgaggtcattcctggtgcgataataaccatcctgtagcattttcttgtcacttagagaaggcattagcaaactttttttgtaatggtcttaatagtaaatatttttgactttgtaggctatatagctactcacctctgcttttatagtacaaaagcagccatagacaattcataaataaatgaacatgttccaataaaagcaataaaaacaggcagcagtctgaagtttgtcgactcctgatttggaatcattccagaaagtgaaataaaagcatggcttcttttttttttttgagacaaggtcctgctctgtcacccaggctggagtacagtggtgtcatcatagctcactacagctttgacctgctgggctcaagtaatcctcccacctcagcctcctgagtgtctaggattacaggcatgtgacatcacacctggctgatttttaaattttttgtattgatggggtcttgctatgttgccaaggctcacctcaaactcctggtctcaagtgattctcctgccccaggattcccaaagtgctggaattaaaggtgggggccactgtgcccagccaaagcatggcctttctaagggtgactcactgtagcacctcctgagtactttcctatcaagtatcctggaccactttttaaataattcattctaaaatccatatttaggattgattccaaatttgccaacctgtatttcccaaataactggcatgataattcttgtctttttcccaaatgctcattttccactcttcaaacgttgagtgttgactgaagttctgtggtcatgtttacagtcatttttatgctctttgtattgtacatatggaatgtatttaccatttctgttagcaatgatttcttgcaaaaacaataacacttgctagttttgcgtgcttaaaaatatcgagccctggcgctctctacatattatctaatgtaatccttatattaaccctgtgagtagtcattatcacttcttttacacaggaggaagttagagaagagtgttaagtgttcttttagtcttttccactttgtctttagttttctcttagctgttcttttaaattctaaggtcattcttatctaaaaacttaaaagagttgatcagcctttttatcaagtgttaaatttataccatcttttttctttgaacagggctggcaaataaacctggatttatcccttagccctgttacagcaagtctcagaaaatttggacttcagcttccccagtgatacattttcaaatgcctatgtatggattgcctattagtttattggctagaactaaaggaaatcaggcaagagacaaaggacattttctctagggtgtcagtcaatgcaaaatgttaggactagcatcagatttttttttttttacaaatgaaaataattgaagtgtggtagaagttcctctagttctggcagtcctaaatattgttaactgaagaatgatggggctcataaatttggaaaggagagagaggggaaaagagaacgggaatttatgctgagcagggtggctaagtatatatattcaacaggctataggaggagctattagtattcacgaaggggtggcacacacatacatagtaggctaacgtgtatgcagcatgcatcacaagtcactttggggtggagccttaacatttaatgtattacagttagggcctatacatcaaaaggtgaagcagaggacacgaaagccctctgtgttcagcctctgtagactggccagaaccactctgtggtcagaggtctcttatcaggaaagaattcttgttgttgtgttgaaactgcaaaagggaggggcagtgtcaggcaggtggttgataccagtctttcagaagcactggtttctgtttaacttttagagaagaaagcttaattggagtgttactggaaagggataccagtctagaccacaagagaggattcttggatctcacacaagaaagaattcagggtgagtccacagagtaagatcaaatcaagtttattagagaagtagagaaagaaaagaatggctgctccataagcagagcagcactgaaggcttctggttggctatttttatggttatttcttgattatatgctaagcaaggggtggattattcatgagttttcctggaaaggggtggggaattcccagaactgagggtttctctttcttttagaccatatagggtaagttctggatgttgccatggcatttgtaaactgccatggcactggtgggaatgtcttttagcatgctaatgcattataaatagcctaagataagctgtgaggatgaccagaggtcaatttcctcaccatcttagttttggctggcttctttactgcttcctgttttttcagtgggttctttgtgacctgtatctgtcttgtaatgtcctatctcatcctgtaactaagaatgcctgacctcttaggaatggagcacaggtggtctcagctcattttatctatcccctattcaagatggagttgctctggtttaaatagttctgacatattttccccaatacccccaaagggacccttaatcccaaaatttgcagacagatgaagatccatcttctgtagcttcttctggctgaatacaggtgatgatatttttgcgtaactattcagggtagagaggagctcagtgagaaagcatcagtatggtgaaggccattcctaactcccgagttctcacaaaaggtgatatctggaagattaataagtgttcaatttaagaaaacgttgagtagtcttatcctgcattgctacacaaagagtaccacagcaatatattctacaacagtaaagcaaaataagtataattatcccaactaaactaaataataagcctttccatgaactaggcagttgttggaaccaagcttatatggggttgctagccaattccaacacatgttcagaattaaaatactgatccagatatttatgttacccttctgtttcttctgagcagcagctagagatcactggttggttcataggaacaaacagggtcaatctaaatggcagaaaaaactcgaaacaatgaatgggactagagttgaataacaagtataccatagtttctgaaacataatttttctctctccagtctcccatttctattgaaaacaaatcatggtaggactgatttgtttgcacagtaagctttagtcttattatgcttggcctggttatttgtataaagcatagcaataataattatttgccacgtaggctttttaaaaattgactttgatgtaactttgttccataagaaatctcagattagactttctaaagccttgagctgagacacagatttatctgtgcctgcaaatacttgtatgagttgtgtgaattctccttttgagatcccaagataactggagctcctaggcctgtcagaaagtgacattctttacttaccacaggtcaggaaccctgtaaaggaattgaatagacaaggtatgaggccagcttttcccagaggctttcatcagttctgtaagtcaactttgattccttaaagcaatctgtttatatttgaaagaatgccattccagtcaaagccctggtaaaacaggcagtgtctctaattgtgtcctgttacaaaggaaaacagatttttattgcacatatgcaaattactatgctgccataagttaagaatactcacaaatagttttcaaattcttgagaaatcaggtagaaagaaatatgctccaaagttttctcataggagtataatttactcaatttttaacaactgtaaatagctcaaaaaaaaaggtttcttgactctgaaaaatgaaacaaaggatcagcaacattttaagcaaaaagtcactagaaggttattttgttcttttattagtttagtccatgctgttaattcctgtttgctcaatatttatgaacatattggtttcccaagggagactcttgaaagtttttttcctctctatcttaatggcacactttacaaaatttttcagaaacctgcatttaagagccctctatctgattataaaccatcttttaaagaggatcaaaacaagacaacaattttctgtggataacataaagtcttaggaaagccgtggttaaagacacaattgactagaaattttggttacttctgtggcatacaacaattttacataacagttataattattactgataacataaactaagtcatatcagaatttaggagtttcccataattttggagcacataccaataacatatttatacaaatacaactcaaagaaagctaaacaccatttcatatttgacagtgcttcctgtatgattttaatataccaagtaagccaaatatgtcatttttggacttaaggggacctcatatctaaagtattgaccagatcaggaaaaggcataatatagaatttgattttggaaagtttgtcaaatatcaaagatttaaaacacttgatattataaaatcgaatcccaggtcactgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttttttttgagacgagtctggctctgtcgcccagctgggagttcagtggcgccatctcggctcactgcaagctccgtctcccgggttcacaccattctcctgcctcagcctccggggtagctgggactacaggcacccgccactacgcttggctaatttttttgtgtttttagtagagacggggtttcaccatgttagccaggatggtctccatcttctgacctcgtgatccacccgcctcagcctcccaaagtgctggtattacaggcgtgagccactgcgcccagcaagcaaaatcctttactcattgatagagggaagacagctttccaaacaatgtctcactttttcttctttattttgttgtttattcaaaaggcaaacaaaaatcttccatgatcttttaatattacatgaaaattttgttcaagagagaaagccaaatttcatctttgcattaatgaatgtcaaatccaattcttaagaaaaccttgtagacaaattattcaatcttaatcaattttaccatgagataagattctcataaaccttttgtagtcctttacaatttttttttgttgttgttaaagagcagattaatgctctaagaaaaccctgttgtgcttttattccaatgttctatttatggaaaaactgaataataccctttaactttagctaatattttaacacacagaatttcttttacaagattaattttcactgacctcccacaacttactcaaacctttagctttatcctatgtaacttaaaacagtcttttaactctgtaaactaggcaataagaccacattcccatgccttcttataatcttttaccaaaaacacattctattttccttacacgccttgcaggtaacactgtttctctggtagcctcaattacatgtgctacaatgttaactcttagcaacttttatatttggtgaaaagtctgataaataagtggttttaattatgtaccaggtgtggagcctaggacgccagacagaagtgcagataaggtctgagtctttccagcatagctagggggcatggccaactccacatgtccccaggccctacctagaatctaatggctccaaagcaggtgagttgaacaattatcaagttaaagaagcagtttatggcattgaagcattcagcaaatctaatttaatctgacctaatttagaccagatgtctaaattttgaagacatttttattttaccaatatatttgattctctttatttcccaaagattattaaagtcccatgaattaaaaggtgttaaagtttttatttttctgacaaaatattcaatttaagtgcttatttttcaagccaattaattagagctcttttctatgcatatcacacatacaacacacaaaaatacacagacagaagacccagtagctgttaattttttcatttgccagcttttaagaatcttaattggattactggcttcagggtggagcaacgtgtggggacagagccgggaaaacatgcagtttctggggcctaataaacaggtgcagttagaaggcaaaacagattccccaaaattacagatctcatttttatattggattctggatcccaaaaagagggaatcagcccatcccctctgggagttttggaaggtgtagaagaatgtttccataccttctaggtggccaagagcatgcttctctgatccaaacgtgcacagagtggggtattcccctataactgctattagccttcccttaaagcatatttcctgcctagttattacacaccaaggttaaaagctctcccataatgcaaagtaatttctgatacccctacaagtaaaaaacattaggtaacacaatgcaaatcagagcaatgccttggattttgagagggatttgcttgccttcaattcctggggttccatgaggaaaacagatttttcccaaaatggagcctgtggtgctccctcagttttttctaaggaagcccaggctgttagaaatgatcttaggtcctctcaatgtgggcatcaagagtggcaagaaaacaaaatgagaaaaacaattcagttgactgagaagaaaaaacttttatctagaaaaaaatcaatataaaacctgccagatagatagatagatagataatcttggacatcacttttaattaagctgacttttaaccaaatctcttattatcagactctagccaggacaaacagctaatatttctggcttttgaactttaccaaaagtaacctcccaggtgaaaccaataagccttaactaaggttatgatttaaccacaggtgtgggaggtattttcaaagaggtggtaagcagtttttacaagatctggaacctccaaacatagctcagagaaaggaagattcaagacagggagtcagaagttgttcatgaggggaagataattaataaatggcaaaggtcacatagatatcaaaccagaaaggactcattcccgaagctaggaattgaatccaggccaccactgtgaaatagcaaagccttagttactgagctgcagtactgcacagtctccattgctcctccgagaaggagcctagagcagccaattttgagcttgcaaaggcttttaactgctcaagataatttttaggactaattgacaggaaccccaaaattcacaccctctggatggcagagatcaggagaaagtacccccacgtggttacaaggtcaagctttcaaggacataaaacaagacgagagggaaacttcatccagtttttgtttcagggacctgcagaaaagtttgtaactgaccagtttgcgggccagcttgaagaccagatttgtaggattcctaggcctgcattctatcctgtggctagctagggctgccataatagaatattacagactaggcagcttcaaccacaggtgtttattttctcactgctccaaagtctagaagtccaagatgagggtgcctgtaaagctgatttctggtaagagctctcctggcttgtagatggccaccttctccctatgtcctctctgggcctttcctctatctggccaagggagctatctctggtgtcttttcctcttcttataaggacagcaggcctatggattaaggcctcactttcatgtcttcatttaagtttaattacctctttaaaggcccgatgtccaaatacagtcacaccgtgggttaggatttcaacataggaattttagggacacaattcaacccataataggagggcattggaaggagagtgttccaggcagaggaagtagtgcagtagagcatatggaagtaggaaagtgaggagcaatggaaggggttcagtatggtttgagcgtggggtgtgtagagggtgaaggctatttcacccagtgcagtaagctctatcatccacaccggggttttacagtgggagaaaggagggtgtttatttgcaggtcaagaagcaaacagaatcagggagctcatgcttaagacctgaactccacagtggcttacatgtaaggtgcagaggttacaggcaaaggcatcaatcaacacatggaagccatatattggtttggcctaaaaaggtgggatatcctgaagtaggggcttacaggttacaggtaaatccaaatattttctgatttgcacattgtttaaggaaggggatatttgtctaaagatgggatcagcaggccaggtgtggtggctcatgcttgtaacctcagcactttgaaaggctgaagaaggagggtaacttgaggccaggatttcaagaccagcctagtcaacatggcaagactctgtctctaaaaaaaataaaaaagaaaaaaagaaaaagaaaaaaaataaagatggaatcagcagaaaggaatgttaggtctggcccatgggcggacttcctccagacttctcagaaagaaatttaagacaaagaatggtgccaggcgtggtagttcacgcctgtaatcccagcactttgggaggctgaggagggtggatcacttgaggtcagggatttgagaccagcctggccaacatggtgaaaccccatctctactaaaaatacaaaaactagccgggtgtggtggtgcacgcctgtaatcccagctcctcaggaggctgaggcaggagaatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgggcaagagagcgagacttgagactccatctaaaaaaacaaaatggaaaacaaagaatggtgataattcagtcctcaattccttttcttttttttttctttctttttttttttttttaactgctcctgcggagcagggctacctcatagccagtatgtccagagttgtctcagttccctcgttatctgtggtctggaggatccatatgatggtgatccaggttctgaaaaacaactctggaacatctgttaagatgttatctttagtttctataggaaaccaaacatcttctgactctgacctccttggtgattattttaagctactgtttccctttttgcttatcgagttgctcatttacttctcaaggctagcaggatgactggactttctcttgaaggaactcaagctgttcctttatttttatgctcaggggcggggggcactcagcaggtccctaagaggtatccctgctgtgtctcactatgggtgaaggctcagcgggaagaaagctagataccagttggaactctcttaaagtaaggagatcttgggtactttattaatatttttttcaagctttggtaaagtatgaaataactctggattaagaggagaagaactagaacttaataaccatgacatttgggcaaattgtttgaagcctcagtttcctcaacctaaaaataggaattataactttttgaattgttctgttgtatgagataatgacagtgaaatattttggagccaaaaagcaatgcatactattgggggttattattattttttgatctttcagcaagccagctatagtagcttttcctatataaacacagtatgaattcagtgccctcgctttactgaccctcacagcattcaagccctgtatggaccgctgagctctcccttgaagcaccccttagtccagtattctttactattttcccctttaacaatttaaacttctttcaaaacaactggcagtagttttttaaaaaagaaaacaggctactcttcaaattaaaaaaaaattgtcttgctttaggaaaaatgttcttctgtcttttccaattatcttatttcttctgcctctcatctgccttgcctaggcagaattattctcaagcctgcacatgctgctgtgcctctctggcttctaggccaaaacataggctaatagtactcttctcagctcactgagctctttcctgccgtcattcaaatcacctctgaaatcctgccttttgataaagtaatttctgactgatcagaggaaagtgatgattttctctgtgacatgtctttttattttccatcacactcagtgtcttgtccttctgtgcaacatatccatgtatttaaaaacccttgtatatgtatttgccatgtatttgtgaggtatagctcgtgaagtaaaaaaagtctttatttttttaaacacatcatcatttcagcttcaaagtcaatgtggtctcttgagaagttaaatatgctgcatttgaaattttatgtttctcatttttcatgtttttttttaaagccccttttaattcctcatgtatttgaatattccaggaagctagtagagtaaaaagccaaagtgttaaagtgtttataaggaatgtgactcatcgaaattgactcacacaattcatcagctattgtcatccatatgttctcattatttacgtggcttttgctttatttaatcagatgactgaacttatcatcgtgggattttgcttgtagttgtttaatattatataataaaatactcttgtgtgaaacaagttaattgactttttttaattaaaaaaaatttatgtgagagtcaggagttacatgtgcaagtttgttacatgggtatatgttgtgatacaaagattttagcttctaaggatctcattgcccaagtagtgaacgtagtacactataggtagtatttctaaacacttttcccctccccctcttttggaatccctagtgtttattgttcccatctttgtgtctatatgtatctaatgcttagctctcacttataagtgcggacgtgtgatattttggttttctgtttctgtgttaattcatttaggatagagagactccagctgcagctgtgttgctacaaatgacatgagttcattcttttttatggctgcatagtattccatggtttatatgtatcacattttctttattcagtccaccattgatggtcacctgggttgattccatgtctttgttattgtggacagggctgtgataaacatatgagtgcagttacctttttttgtataacagttcataataaaatactcttaacagtagcacagaatttagattgcttttcaggctagaagggataattgaaacatagaaaaaaataatgactcctaagcatagaaacagacccaatcataaagctctcttcctctctttctgcctagtgttagatcttattcattgtcttaaagcactgtgaccattttcagtgaaatcacagttttattcatgaaaagacaatgaattggtgtaagtaatcatttgaggatgaaggtgactagtctgtgatcaacaccagtacttgaagtacttgtaaaacatgaattgaccttggttaaattgcagaaaataaagtattagtatacataaacacattttctctcagcattgaaaagttatagtctataatttacctgcttgctaagaataaaaatattacttagaggtttatcaagaccttttttctacaaatggatttaatgtacagaattattccattttctatctgtgctctgtatactaccacctagtggaataaaatgcaaatttacctgtcaaaatcaggagaagaaaatgaaccaggggaaatttatttcaggaaaaaattttcataacacgttattgttacttcttttagtataatgtagtttgcataaaatacattagtttggagtgaaaaaagtcccagccatttttgtgatagctattaaaatgctattagtttgtccacaaataagctattctattcagaaacttagaagctaggtaaattattgagatgatgccagcatattatatctctaaattatgttaagaagcttctctaaattcctcatcactagggtgtattagtccattttcacactgctataaagaactacctgagactgggtaatttatgaagaaaagaggtttaattgactcacagttctgcaggcttaacaggaagcatgactgggagacctcaggaaacatacagtggaagaaggtgaaagggaagcaaggaccttctcatggcagcaggagagggagagcacaggggaagtgccacacacttttaaaccatcagatctcaggagaactcactcactctcacaagcacagcagggaggaaattcacccccacgatcctatcatctcacactgggcccctcctccaatttgacatgagatatgggcagggacacaaatccaaaccgtatcataggatttgttaaaaaaatctaacatgttctgcttcaaggcacccatgaaatgaaggtgtcatttcttaactgagaggttaaataaaagtgcagagataagatggttaagttttatcgtagctgggaagaaaagcgggtgtgtgtattatgcttaggtttttcctcccaaacaatgaaacccaaaaaggcaaatgaagctttaaggcgctttatcctttactggtaggatggtcctcctttaatcttcagtctccgttaaagaacaaacacaagctaacaatcaaaacctgttgttgcttgctgacggatttctctaacatagtcttccatcaaccatcataggtttgttgtggccacccaggccctttggtcgtcatgttcccatggaatgctaatgaaattaccttcccatttcctaaggtgacatgcctttcagatggcattggtgtgtgcttgtgtaaacacatttttttgtgctcatgaatattttacctgcctgattttggtgatctgagtgttgagcagtgggtgagggatggtggggcaatgggtagtaaggggaagtttaattgaagttcagataaaaatatccctccagaaacattacaaagccacaaaatcagctgaagttgagtcttctattgtaaagattctctttcttctcctgacagatccccattcctatccaggtagaccaggctctagtgaagattggacacaagtggtttatatcccgaagctcttaacctaagagtcctgccttgtttttttacttcatgtggtcttgaattgctgaggatagcccagtgatcatttctaccttaatatgtagccttcaaaacgttgggtctctcagttttcttccttaataaacaatgaaccctaattatttataactgctcttgtgatggaggaattggcatgattttgcattgtgggcttctggctttacagtgtttgtgggaaagatggtcttctatctttgttatttataagtcattcattccctgtttttttgaagatattgttaaataaaaaaacttcagctgaattaaatttaaaagtttttaattgagcaaagaaccattctcaattcgggcagccttcccatccagagtagtccctgtgacttcagtgcagccacatggtggaagaggatttatggacagaggaaggaaagtgacatacaggaaacagaaaagagattcagaaacagctgaattggttataactcagcgtttgccttatttgaacatggtttgaacagttggccacgtttgattggccaaaactcagtaattggcacaagagtaggctaccatctgtttataatgtccacttaggttatagttcatgatgtgcaaagaaacctttaagctgagcttaaaatgtaatgaggcagctgtaggctaaacttgatttaacagtacttatccctctgttgaaattgcactcttgctacctgctagttgatgtgggcaggtgtgctaatgacacattcgcctgcacctaccacctgctgaagaccctgccatgtcctgaagcagtcacttaggctatgaaacagaaggatgagttagagaagtaaatattatattttaccccccaaagcctaaaaccatgtctaggttctcccctttctcaattcccaatcatgcaaccttgaaaggtgttatatagatagttgttagaaatatgtctgtcctccaaaaccctactaacacgcaaaaatggacaaatctagcttttttgctaaaatcctaacaactcagaaagcaaagcaaaatgaaatgtatgtactccattctcaggatttccttcttaaaaaccactaggctttgtgtaactcaattttaaaagtatggtaatagctcctgtaattcgatggcttcttctgggagacagatataaatctattctagactttaagactggtgtccacattttaagttacagttgtatgtacttctactttgttgcagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggtaagtaaatctgtgtctctgtctaaaggaaagacaccttcatgaccatttagttagtgccatttcacttcagtatgaacacatataatacttttcaaactttaatgctcattgtgtttcatggttaattttcagtttaatctttcagcaagccagctgtagtagcttttcctatataaacgcagtatgaattcagtgccctcgcttttagatgtgctagtttaaaggatagcccatggccctttgtaagggagaaacactggatatgatatctagggaagaactgaagtaagaaactacaacaagcatcacatcggtgctttggataaacttcccctgggcgctggtctctggctgcaggctgacggctggcattaaaaagcatctggtcctgggacccaggctctcagttggctccagggagtcatgtctggggaaggtgcccgcttcactgaagtgctgtcttcattgccacagattgtggccacacctgctgccaactggctgcgggacagccctgctttggctctgtcaggccagtctcataggccatatgtagctggcaggaaataaaagagcatttgaaaagtgttggacgatttcaggggtggacttggccatgagttgggaatgcccctatgggtgaacgagaataactggtttaagcagcatgggttcttgctttgcatgtatcaaatggtgctgtttgcatactcagggcagcagctgtcctagaaggtgactccatggcagtcttgtgggccctggtaggacatttaggtccaggaggcaggggagagtcacatgacgtgctgctggggtattagaggcaatgaccactggctttgacccctctgtagtcttgctgtatttcctttttcttttctctcctcacctacccaaattaaaaaagaacggttataaaagtcatccccactggcaactttagcaactgcattccctcaatgggtagagaaatccaaatggagtgcattaaaactaggaagtctattctccttctggcttagagcacaccttcctgtgtcctaggctagccaggttgaaaactcctttttttgactcttgatttctttttttactggttcaaacttcttcgcagagcatgtgcctatgtaccactgcataccatatatataccatatatagagagtaaataaacagtcttgatgaaaagtaataaggaaaaagtttccctgtttaaaatattgctttctagctcccccacctgtttaggaaaaagataacctggggacacagaaattgcagggcaatctttattaaccggtatttgggcaggttgtaatttattttgtaaacaatgatttaatgcactattgcagaatacatgatcactgtaggccagttaaaaattaatgttttcagtaccacacagagtgaaccctaatgtaaactgtggacttgtggaccacactaatgcaagatgataataagaagaaaaactgagagggtgttcgggaaggggtataataggggaattctgttaccttttgctcaatttctctgtgaatctaaaagtactctaaaataataaaatctattataaaaatatttgattcattaggctcaggtggactatgatccatggaaattgacttgaaatctcttaggaaaggaagagaccggagaagaaagtattgaactcataaattaaaaatggcaagagggaaggtggtaaccaaaaggatgggcatttaacctatatgcctatcacttccaaaaagttctagggccgtctcctcctatgcttctgacctggagaggtacaaggggaacaaaatattccgcatttaatattatcctgttgagttggcaaagacatttggagtcaactttagttttgtgtattattacatctgtaaacctaattaagtcaacagttacccttgacacctgtagtcaactggtattattaaataactattgagtctcataaagtcaagaactttctgctttctatctaagtgaatctagggcagagactgagcatcaggattctttagcatgcagccaagcttgagaagcactgagctagagaaaggtcttgcactgtagaaacagctttagttccaggtgattccttggttaatttgggaggaataaggctttctgtcactctctctctctttctctctttttctctctctcttgcacatgcacacgtgcacacacacacacaaattatctctcttagttttttcttttttccttgcattctgattctgcatttaagagtacaagctttgaagtcagaaagacctggcttaaaaacctaactgtcataatggtgcgtaaatgtcgttatagatttgtccaaacccatagaatgtacaccaggaatgaacactaatgaaaactctagacttcaggtgataatggtatgtcaatgtggttcattaatttcagcaaatgtaccactctggtgtgaggcattggtaatggtagaaactattcatttggatggggagaaagggatatgggaaatctttgtacttgcctttcagttttggtgggaacctaaaactgctctgaaaaaaacctgaagtctttaaaaacaaaccaacctaattgccttgggcatgttacttaactgctctatgtatcagtttcctcatttttaaagttgaggcaataataccttgcacagattaagtgagataatagaaagtgcctaggatagtacttggcatatagaaagctctcagcaaatgcagtatgataacctaatggttaaaagcttgggtttaggagtcaaatgtctgggagttacacacttaactatctgtgagatcttctacaactgaatcctctctccaagtcttccaaagaacaataaagtctagggttgtttttagatgactcaatgaaataatgtagttaagtacttagtacccagtctggcaggtatgggttgcatatctcttatctgaaatgcttgggaccagatgtgttttggatttcaaattttggagtatttctctttgggcatccctaatccaaaaaattcgaaatccaaattgagcatcatgttggcaccgaaaaagttttagattttagagcatttcaaagttttaaattagggatcctcaacctgtagtaaactctcacagtcactgatgttgtgaggttttctcactttctcatttcatttcctggactctctttatcttagaagaaatcagttaaattttacataatagaatttattcttttggagggatgtatttaatatgtctattctcccagataacctatttaaaaccatattgaaatgtttctatgtcaacagctttcttactttttcatttttctgtttcctccaagaacatgtttctcttatgaatattggcagcacatgggcgggaacccaactatattaccatggtatcagttatcctgtggacattaataatacagcttacacctgtgagagaactctgggaaaattaaaacttgtttgggggaataaagaccatctacagaatataataatacatcaatcaatcaattaaaacttaaacataaaaaacccttttcttttcagtgcattgaaatagtcactgtctttaatcctctttccttgctcagtgcttcatgaagctgaggagccatggttttaattcagctacactttcagaaatgtgtatgcatttgtatttagaagcttctttgaaaggctaaatattcatcctgtaagaattctctatgtgttttttaatacagtctaaagggcattttgtatatgaaaaaataatttattttcaggtagggtaaaacttcactgcttcactacttcgtagttgtgtctacgaatgagaaaaaattcaaataaaatagttattattattagtttttagagatgcagtcttgctgtgttgcccaggctggtctgggacttctggcctcaagccatcctcctgcctcggtgtcctgagtcactgggattacaggcatgagccaccacaccccactgaaatagttattttttaaaaaacttaatttcattaggatgtaacagtctcatgtaactcatcctttggcttttattgttattatttattttttccaagcaacccaatgagatatataaagcagatatttttatctgccagataattaaatgagggaaaaataaggactaacttgcttaagttcacatataccaaatagtggaaatgcaagagctgtcctcaggtctgttaacaacaaacctgtggtctttctaccagacgtcccctgcaatctggtttatactcattattaaaaagcatttgtaatttaactcagttatctatttactatcagttatgaataaggattatttgactttttatggtcattaaacaatagcttcctatctgttgtctttgtctttttaatttttatttattttattgtttttttaatagcttcctatctgtataccagacttgcttcatctccacattgaccaagaatttatattttgtcatctgtatttagaagcatatgttttaagcgtcttttaatggctctttttttttttttgctgggaggggacagtctcgctctgtctcctaggctggagtgcagtggcaccatctcagctcactgcaacctccgcctccctggtgcgagtggtgctcctgcctcagcctcccgagtaggtgggattacaggcgtggtccaccaaacccagctagttttttatatttttggtagagacagggtttcaccatgttagccaggctggtctggaactcctgacctcaagtaacttgcccacctcagcctcccaaagtgctgagattacaggtatgagccactgtgcctggcccttttaaggactctttttttttttttttttttttttgagacagtctcactctgtcgctcagactggagtgcagtggcgcgatctcggctcactgcaagctccacctcccgggttcacgccattctcctgcctcagcctcccgagtagctgggactacaggcgccagccaccacgcccggataatttttagtatttttagtagagacgaggtttcaccgtgttagccaggatggtctcaatctcctgacctcatgatccggccgtctcgcctcccaaagtgctgggattacaggcgtgagccaccgcgcctggcccttttaaggactcttaacattaccttggtgtgagtcaacctcatcgtgctccaatcgcaatcaccatagtatgatgtctattttccacagcttactggaatatttcagctattagtcaatattctttcagttgcaagtcagaaaaccaacttgaaattattatttatttatttatttatttttttgagacggaattttgctcttgttgcccaggctggagtgccatggcacaatctcggctcactgcaacctccgcctcccgagttcaagcaattctcctgcctcagcctccagagtagctgggattacaggcatgggccaccactcccggctaatttttttgttatttttagtagagacggggtttctccatgttggtcaggatggtctcaaactcccaacctcaggtgatctgcccacctcagcctcccaaagtgctgggattacaggcatgagccaccgtgcccggcctggaaatgatcttaagcagacaagggcttatgaaactaggatgctaggggctaaagcaattatttccaagtttcttgtgtcctttgcacatccccctttttcttcccttcttcctctgcctctggtcagagcttctggctccatgttggcctagggctctcccacttcagacgctttcttctgtgaagtgtggtgatcatggacacagccgaccccagttttacagcataccaagtaagcaaccccagaagggagaaaatgcctgtatttcaggttatagacattaaaatgagtgaatgcacccaaaaaaggaatcatgtgactgtcttaggttatatgcccaccctttaactcagctgcagcagggcaagatgctatattgtcatcagttgtggtagggcaagatgctatattatcagtccaagcagaatgacatagctctatagaaagactatgtttttataagagtatggaatatagtgcagatgaaaacagtagatatacactaacatgtggctctaatgtttaatttttattttttttgagacagagtctcactgtgtcacccaggctggagtgcagtggtgctatcttggctcactgcaacttttgcctcccgagttaaaatgattctcctccctcagcctccctagcagctgagattataggcacccgccaccacgcccagctaattcttgtattttcagtagagacatggtttcaccatgttggccgggctggtctcgaactcctgacctcagtgatccgcccatcttaggctcctaaagtgctaggattacagacataagccaccgcgcctggcctcatgctcaacttttatttagacaacagtacaaattgtaattttacccagatgtaaaagagtctaagagacctaaatagatattttgtggtagattacattaatgtaatgtaatgtaggagttttacattactacatttgtagttgttttagttgtttttcattgtttgtttctgtgtatttctggggatttcatggtgcaacaggaggactagagtttattcccgatccctgactgtcttacggcagtacttctcagacctactgagttatacaaccaggggtgtagggaggcaagcagtcatcacatttatttgaggactctcatgttttgtctaaaatattcatccctattttataatatactccataattttcccatataagtttagataaaagatgataccttaaaagtattataacactaaattgtcattccgggaaaatgtgctgtgttcctttcattttaaataatctgagatgaatggtgcaggctgagaaaaataggcttttgaaatactttttggtcaacatcgagacttttaacatttgtcctatcttttaggggaatttagacattgggcattatgtattccttggatacattaaaaggtgttagataagagcgctcacacttgctgctcttctattgcaacttgacagaagttacttctctaaaccttagtttctcatctgaacaatggaaataatgatagtgtctatctcatagtattggtgtgagatttaaatgaaataattcatgtaaaattgcttggtgtgtggaaacatagtaacttttaactgttctcattaacttggctatttacctgtgttcttctatcattacatttcaagttaaaatttcaaggtttcacgttgttctctctccaatgaatgcagttaaatcacttagattttctaatgagttttcctttaatgttatgcagttgactagagagtgtatatatattaagaacataataccttcactatgtccacatgtgaattaagagcttgaggctatcagagggtagaagatgagggagtggggatgaagtatgtttgtaacctgtgtattttctctttcttaaaggaattacggctcatctctttttgcccaatgtgaagcagtagataatgggtgtcagcaggtcctgtggctctatggagaggaccatcagatcactgaagtgggaactatgaatctttttctttactggataaatgaagatggaggtaatccactcagatttcactgtgtgcatttctcagtcattttcaacaggaccagaaagacaagagctagaaacttagtacaagggagtaagtagcacagttccaaaggctaagtaaggactactgtgcttttgctgcccaaatagacacaagtttcttttttttctttctttcttttttaaagaggtggagtctcactatgtcacccaggctgcagtgcaatggtgtgatctcagctcactgcaccctggttcaagcaattctcctgcctcagcctcccgagtagctgggattgcaggagcctgccaccatgcccagctaatttttgtatttttttttttagtagagatagggtttcaccatgttggtcaggctggtcttgaactcctgacctcaggtgatccaccggccttggcctcccaaagtgctgggattacaggtgtgagccactgcacccggccgagtttcgatttaaagaagctctagaggttttttgtttttcgttttttgtttttctggctctagatgtactgattattgagatactgagatgtcacattaagggatttaagttaccatgattggaagatttgcttccttatcccttctgcagttccccaacaattttcctatctgaacaccttgcattgagacacaggtctcagatcaggtcaatggtcattcaccatataccgtatataaaatgctagagtaataaatgcagtgtactgattctactggaaggattttgtgtactctctggctgtaattgttttaacaattgttgccttttctacatattttgaaaatgtatcacaatctctccaaatttactctagaactcaatctgattaaagagcaccattttaaaagataaatcaatgtatcttgggattgtaactagatcctggttcattcaagacaatttcatatatccactatagatatcaatatttctctattatctttaatatcctgagtactcattacttttctttgctgtttttttttattagttggcagagaccataggggttcagtgaagtgttggcaacgtgtatgatattgaattaaatggccaacggtgggagaaaaacaggcatttatttctattagaattttgataatcataccaaatttagaagcgtatttttagacttgtttacattcttaggttgttcatttcacagtagtaattatagagactagaaatataaatgatgtttccaaatacttatgaagtctcagtgttagtagtttcaattaaattttttaaaatgcagtttatatttgaaagtagctacagtagcctctcttgctctaatgttatttggctacaaaaagaggaaaatggtaatttagatgtggctgaattcagagctaagtactaattttagtgttagttgcagagactaacaagatgagtcttatactgcagtcagaggtagaataaacagaagatatggtgagtaagccttgtcctgggcttggccattggtagtccttggcatatgaaaaaccagatacagatcattctcatccttccattcctgctgtttgtacttggcactgtttgaaaataaaatttatacaggaatatttatgatttataaatttgagttactgtatgtgacatataacaaaagctacacttggaagattgtagccagtgttgacctctgcacttagaagataataggccgattcaacccttcttcccatctgcccactcttacccccaccccaaactccaccaaaaaaccacacagctcaaaacaaaaacagttacatcattcagaggtggtaccatcattatttttatggatgggagatgtcagaatttaagtacactctgaatcagagctacatgatttaaccagaaacaccagaaactgtcctggtggaaaattgttctttatccaaacaataatcatgaaacatttccaccatggcttttaaaggtcagaatagaaatgagtgagtttgtcttctgcctcttgcaaaatatacaagaccttaagactgttagttactattcagattatggttgcctgggataactttagttttaatatactccttcactttggggatgttcatctaacagaacaaataaaattcagaataaggagaaaggaaatagaatatatatttgaagtaaatagaatgttaggaaaaacctttgggctaaaaaaaaagacatgcaattctgaagtaactttgatttatatcatatgattttaagaaaatacaatgaacaaacgagttgaaaatcagcacaatactgattttcacaaacgttaccgataggaggtataaacagagttctttcggtaatagcctgccgtcttttcatgagcgcccacacacactgctcctgttggttgagatggctggtgcaggaaggtggatggggtggtggatagtgtgtgttcaaagcacagtgctgtgcacagtcactatgtgtggcactcagcttgtaactcatgggagttttgatttcagtaacagcacccatggtggcaagatcacacatcatcactctgttgatgagtaatttaacccatacgcttgctattcaccatttgaacaaagcattgtatcatatcctggaccctggagataccctgaaaaataagacccaggccttgtggttgagttcacagtcactttgggaaaacaaccacagcagtgaatctcggtattgctcaggccacatcatgagtcttctcggacacgtcaggcgtgtatacggactcgacttggagcactcttcctcagatgtctgtaccgcttgctctttgacatcctccaaatctttgcttacaaatcccattctcagtctggctttccttgagctcttaatcaaaatcataaactccatttcccatttctcctcagcattccagcattctccattgcttttccttctttatttccccctgtgtagtctaacatactatcaacacaataaatgtttacctgtgtctattagaaagtaagcagggagatatgtcagttttgttcactgctgtattcatagagcttaaaacggtaaacagcactcaatatgtatttgtagaataaatggctaattgtgctgatggtgtttagggcacttatgcagacctacattcctggtttccattagtgtttgactttgggaagtcacagatgaatcctgctgttattgcttctaaattcctcatctcctaaaaatgacttctttgtcaaaaacaagctgcatttgtaggttctgttttcctcatgttgggcaatctggagtgatttctggctcttgtaagtatgtttgtggttgcagaggaaaatgaatatttctcacccaaatgttgtcatgtcatcatctctgtctggcaaccagagaagcagatgttctgttccttgacctcaggctagtggttacagttctgggtgttaaacatgtttcacaaaacagcacttgcacatgcggggctgctgttttcatttaacttcatgtagtctcagggctcagcaagctttaggaaaggtccggtttgggggcactggaagtgtgtgtgtgtgtgtacatatatatacacacacaaatagatccatacatttatgtatctagttggctagctattgcaaaacacatgtttattttgagatcatcaacacttctaaacatgacaaagagtagccctaagaacattgccaagaacaaattttctcctttccagaaagcaattttcagcagatgattttcagaaacaaaattcaaaaaagccatactgctgtatcctagcaaagataacttattcgtttattttttactcaaaaacatttattatatacactctgggctaggcacaatgcccagttttgaggatagaaggatgaagatagagtttggtattccagatagagcttgattgttgggcatgtctgatgtaaccccagtggagtgggcgagcctagaaccaccatgtattgagggagagggtggtggcctcagtgtcaggactcactagattcagactcctgggtgtcagaagtggggaggaaagggagatgctgagtgccagagggtactgtaaggagagcttgtgcagctgatggatcatgcatgatgcctgtgaacaattgtcctactagacctcacagtagttagggatgtctgcagtcatctcacagtagagcagtagctcagctttggagttttgtttcttgaatgtcttcttttttaaccgtacacgtgcttgagctcactctgataagcccattacatttgaatctcagagagcaaaggcagcatctccatacttgttgctgatgctccaccaggtttgaaaatcactaaagatagactgttaggctgggtgcggtggctcacatctgtaatctcagcactttgggaggccgaggtgggcagatcatctgagctcaggagttcgagaccagcctgaccaacatggtgaaaccccgtctctactaaaaatacaaaaattagccaggcgtggtggcgcgtacctgtaatcccagctactcaggaggctgaggcaggagaatcacttgaccctgggaggcagagggtgcagtgagctgagatggtgccactgcactccagcctgggtaacctaaaaaaaaaaaaaaaaaaaaaaaattagactttccaagggcagcgtggaagcagtgaccagcctgagtaggcacgcacacttcttggggatagcctcctccatagcattcttagaaggtttggtaatgaccagtttttctgagtaagaccctatctacattattctaattagtaaccacctttcatctgctaaggtaaattttcacttcagaatattcctcttaagaccatgcaataactcttactgtttgttggtggaaaaccatctcattattttactggttaagggtaaactgaagatgattagataactttccttccttccctccccccttcctcccttccttctgtttcttccttccttccttcctttctccctccctccctccctctctctttctttccttctctctttcttttctttctttttttctttctttctttcttttttctttcttccttccttcgttccttccttcctccctccctctctctctttctttctgttttctttctttctttctttctttctttctttctttctttctttctttctctctttcttttctttctttctttctctttctctttccctccttccttcctttctttctctctctctccttccttccttcctctttccttccttccttccttctttccttccttccttctttccttccttccttctttcttctttttttaaataagggtctacctgaagtgtgaactgatttgggaaatttgatcatgcagaacagtaaaattttctttatgtttgttgctagcaaaattgtgatggttttttaaaaaaatggctattgataataaggcatgcctaatgtagtgaaagtttgaaaatgtcccaatttctgattgacagaagaagaactggcaactcctccactagatggcatcattcttccaggagtgacaaggcggtgcattctggacctggcacatcagtgggtgggtgcctttgatatgaacaacttttgtaagcctgaaataaaaaataatcaaaataagcccagcctagtgttgaaataatatcctgtggttccaaccaatgttatctaatctttaaattctaacgtgaatgaaaagtattcttctagaagggctttcttggcaagactattaaaataagtattgttgatagcaagggcagagagaaaccagtttagcaagatgtcatagtggagaagtattctagtagtagtctcagtctaccaggtatctcccaccaacttttgtctggttcatacctgatgtgcttccatccagacattccttaacttcccaagtctgtgttgcttccaaatggcaatgatacttcttcctttcctttatttataccagtgtaaccatgcttgccgtagaaatgaaataatttcactgacatataaatgtttactaatataacattattggtttgactgccttctttttctctctgtcctacccccatcctccaaaattcatatacatgcctattttaaaatcagaacatgcaagcaaatgtaaagttgttttcagtagactttcaaattcgtgtgacacaggcaagcatattaaacaatttggtggaccgggtgcagtggttcatgcctataattctagcattttgggaggccaaggcaggaggatcacttaagcccaggaattcgagaccagcctgggcaacatagtgagaccccgaatctacaaaaaaatcaaaaacattagctgaacatggtggtacatgcctgtagtcccagctacttggaggggctgaggtgggaggatggcataagatctggaggtcaaggtcgcagtgagctatgatcaagccactgcactacagcctgaatacagggtgagaccatgtctctaaaagtaaattaaataaataaataaataaataaataaataaataaataaataaaataaaatttaaaaaggtttggttttggaaatgacgtaatgtattcaagacaaattattgaatgaattgggtgtctggtaaaggttcttggatggaacttttgacccaggtgttaaaatggtctccaaagaacatgaaaaggctttgagcttactgtggtcaaagagtactagtagtaataggacaaatgtttagaaacacacacgttatctaggagcataccagcatggtttctctggaaaagactttcaaaatagatgaaatgtgctataaataattctacaaaaccctgaagtagacaagacccaactgctacatgctggctggcgcattgggcatgacatttacaaaccgttggtataattttcaaacagcttgccctgtcctaaatatgtttgcaattggaaagatatttttgaagctcagtaatttttgttttattaaagaaaaatatcaaccaagtacagaaggttcgacgacaagttgcaagtggaaatactttcccacactaatgatttgctagcatgaaaaataggttattatggaggaaattttttcttgacttcatagctgtaatttattttaaaagctattttaaaacatgagacgtgaaatgccaagaggcatgtagggggtcaccactatttgccagataggggaaattgtccaaagataagtaagggtgagcagagcaaaaacaattctgcttatttacaaaagagttttcttttcttttctttttcaggacacagaactcagcttgttttcaattaatttgcctgattttctgcagttcatttacttttgaacaacataattgcaattgtagactgagagaaattgaaactttcaaagagccatatttctattgcagatatattttcctgctcttccaaatctacttacagcatgagttcttcttttaaatattcaaatattttgaatattgccaagagctttgatttccatttttatctcttgtgggtttataaattaagaaaaaatactcatcttatttttttaaacctctctatttttattgccctttattcaaataacttgttgacaaactttgaacttgaaccactgaggtaaaagaacaagaattaaacagatagtttaaacacatagcttaaaaggatctttttcccatttcctatccttgagcaaagaatatattcaaacactttggcagaagtcaatgatgttataccactaattccatgatgaaaatcaactgaatgtgatactgaaagagaaggaagagaattgtcactgtaaagtcaactgttagtcatattaggaaaaaaaatacatacaatacaatttctcaaataaagtccaaatatacattcaacgtttaaaaataatgagtatttcagatatttgaactcagtctgttctttattccataaaagatataggtaagccgtgcacagtggctcacaactataatcccagcactttggcactttgggaggctgaggtgggaggatcacatgagcccagcctgggcaacatagggagacccctatctttacaaaataaaatataaaatataaaacctagttgggcatggcagcatacacctgtagtcccaggtgctcaggagactgagacaggaggatcacttgggcctgggaggtcgaggctgcaatgagccaagattatgccactgcattccagcctgggtgacagggcaagaccctgtcttaaaaaaaaaaaaaaaagaaagagacaaacgtagaaagagtaccaaatttggagccaatcagatcagacctgggttcaaattgagtttctgtcacttacttcctttgtggccctggagatgcccttcaacctccttgaaccttagtttcctcatctgtaaaatggggatgatagtactcacccttaaaattacagaacttggcataatagcgggtgcttgataaatggtagctataattattaatattatataatacattgttctcctttatggtaaagtaggttttaagacactgatttttttgttttgttttgtttttggagacagagtctcactccgtcacccaggctggactgcagtgacgtgatcttggttcactgcaacctctgcctcctgagttcaagcgattctcctgcctcagcctcctgagtagctgggattacaggcacccgccaccatgcctggctaatttttgtatttttagtagagacagggttttaccaggttggccaggctggtctcaaactcctgacctcaagtaatctgcctgcctcagcctccccaaatgcagagattacaggcatgagccaccgtgcccggcctaagacactgttaacacggagcatgcatcaagcagcatttgggatgcatcaattttgtgagactttatacaagttaacaaataagaaggcaaaaaagaaggcatatgttaaagtataccatgtgtcttgtggtgataatcttatattttatattctgataatctcatatataaatctgtgaccttgaagtaggttacttaacacctcgatgtgttcaccagtaagatggtgtgccacttccagctttcccttaaaggatgattgtgaccttgtctaagtgcaatcagaatgttaagcagaacagtaagtattgcaattgttttgcatgccttttcctttaaaatatacttgttattttttatattccatgcagggtgaatttaaggtgtcagagagatacctcaccatggatgacttgacaacagccctggaggggaacagagtgagagagatgtttggctctggtacagcctgtgttgtttgcccagtttctgatatactgtacaaaggcgaggtacgacaagtatttcctcatttcctatcatttccaatcacattaaattacatttaatttaagtgtatgaataaaattgtatctggacccagacccaagatgcaaaagttttgtcgttgttgttgtttttctttattttaaagagatggagtctcgctgtgttgcccaggctggagtgcagtggctattcactggtgtgatcatagctcactgcagcctcaaactcctgggctcacgcaatccttctgcttcagcctcctgagttgctgggattacaggagtgcgccaccgcaccatgctaggtcttttttgttgttgtttttgttttttaacttggcactacaaaaaaaataactgggacagtttatccagatgaaactgtattagcatatatctactatgtttccagtgatttcatgtaagcttaaacatggtgggaagttagttttgtccttggacacgtgtaagatctgtcttacctacatgtcgggattggagctatgccgacagtcttctactcttctctcttccttcctaccagctcactagggaaggctctataggtagttacatttcagtttctggttaaccaaaagtacttccaaactactggattaggaatggcaaatagttatggaaaatgcattcgagtggtcaatcccttgaattttttttactattaatgctgttatcattaatagtaagtagaccactttacaagaattattcattggcaaacctggtgcatttactaaaatcttacaaaaggaatttgaggatttggttggaagaaatgttctcctcttagtaaattagtctgattttatatgtgccatacttttgttttcttgtcaaattgttttgcttttcactttataacaaagctccaatacttatgattaacattggtatctaactttataacttaaaggcatgtaagtattagtcttataatgtgaactggcttaagttattcatattatagcagatccttgaacaacacagggattaggggtgtcaacccccatgcagttgaaaaatccacatacaactttttttgtttgtttgtttttttaaacggggtctttctctgtcacctgtactggagtgcaggggcacaatctcggctcactgcaacctccgcctcccaagctcaagcgatcctcccacctcagtctcccaagtagctgggaccacaggtgtgcaccaccacacccagctaattttagcattttttgtagagacggggtttcaagatgtttcacaggctggtctcaaactcttgagttcaagtgattcacctgccttgacctcccaaagtgctggtattacaggcgtgagtcaccatgcccggcccacatgtaacttttgacttcccaaaaacttaactactagtagcctgctgttcaccggaagccttatcaacaacaaaaacagtcgattggcacatattttgtatgttatgtatgttatatatgtattcttacaataaagtaagttacgaaaatcatggggaagggaaaatatatttactattcattacatggaagtggatcatcataaaggtcttcatcctcattgtccatcatgttgagtaggctgaggaggaggaggaggaggagggattggtcttgctgttttaggagtggcagaggcagaagaaagtccacgtataagtgaacttgtgtagttcaaacccgtgttgttcaagtgtcaaccgtaaatgcaaactccactggttttcaaattttactttagagttattttccctcagctgattggagttttgctcaactcctctgactttaataatggctgcttcatttgttgaggttttagaacttgcttttaagggattgctcttgacataattgcatcaacagatagactgtttcatgggagaagaattgttctgtttcatgtcaatacttacattgataataatgcatcaaggtaatgtgatccatccactgaagttgtcattaggccagattttttttaagttgaattattatttcacttctagaaataagaagtttataaagtttagcataattttaatgatccaggcttaggaagcatttacagccaaaaagtaagtatatataattatcatattatactaaagggcataatatgaaaagtgtttgagagcacagactatctcctaaaatcaaactatcaaaacctgcaagccagcaaggcatgagtaggcatgactcagatacaaattagaagcatgaaatctctttcagccatgcatttaatcatgctatccaatattgtggaggtagtggcccctggaagtttaccttgggccagagataggtatagaagccccttttatgaagtcatagacttgctttaatttatgctcccagaatgacttgcattaaactgtggcaaaatatctttgcgttctcatattagccagagggttaatatgtagaagacaatcattcatccttacagattctcagaatcttggaagaggtaaggttctttaagtttagccactattttaggtaactgtagctcctccttggttcttcaaatgatcctgaaggctggtatacaaaccagttatgccctaaaattaattggtaggtaggcaatgtataacctgtcattggctagtttttattcaaattttggatatgaaagtctttggcataaggtgctagcactcagagtcagtaggttttagtgctattccttaacttcagtggaattgccttagtatagcagaattgcttgagtgtcttatctgttatcaccatatacatgagtaccctcaaattatctcatttccctttcttttgtagacaatacacattccaactatggagaatggtcctaagctggcaagccgcatcttgagcaaattaactgatatccaggtaaagcttttcttttcttttcttttctttccttttcttttcttttttttatgtcaccttatttctgtcagagcttacaactaaattatatttcaatgaagaggattaaataatacaatttgagatcaataagttaaatttaaggaagatattcccaacacaatgtgtgggcatgagcaaagcagaaatgggaaagaagatgtatgttttaaaaaaagaaagaaaatattgttcaggactccacattacttaacattaaaaaatagatgtaatttttggtaacatttaaaaatctcattaagaaggataacataacttttgttaaaaaaaggaagaaaaaatttgaaagtagaagcaacttcaggaagaaaattacagtgcatgtgattccaacactgagatataatcactgttaattttttatgtctttttatttttgagctggagtttcactcttgttgcccaggctggagtacgatggcacgatcttggctcactgcaacctctgcctcccgggttcaagcaattttcctacctcagcctcccgagtagctgggattataggtgtgcgccaccatgcccagctaatttttgtgtttttagtagagatgggatttcaccatgttggccaggctggtcttgaactcctgacctaaggtaatccacctgccttggcctcctaaattgttgggattacaggcatgaaccactgtgccctgccattttttgatgtcttaaccttcaatattttgtaagcatttatatactttatttatttatttacttatttatttttgagactaagtctcgctgtgtcacccaggctggagaacagtggcatgatctcagctcactacaacctccacctcctgggttcaagcgattcttctgcctcagcctcccgagtagctgggattacaggtctcatgccaccgttcccggctaatttttgtatttttagtagagatgaggttttgccctgttggccaggctggtcttgaactcttgacctcaggtgatccacccgccttggcttcccaaagtgctgggattacagccgtgagccaccatgcccagccagtatacttttagatagttattttttcctaacaaaatgggatcatattgtacataattttgttacatgttttttcactgaataaatgctttgcttttttatatcaataagtagttttctccaacaccatttataaagtttaattgaattccattatattgatgtaccataatttttttaaaaaattatattattgaacatttatgttgttggcaatttttttttcactagtatggacagtacatcctcgattacttcctaaggataaatctgggatcaaagagtatacacgtctattttttcatactgctaactttgttttgcctattttttttctgagcaataatctacagtaatgcctcatcaggcagttaagcaggcatgctaaataccagataacactgggctactcagaaaagagattatcctgtaatttgcaagcatttcacaagttagaagactttgttgaagccagttactatccttgtcaattagtaaaaatatccaagagggcctgagacttacattgaaaagtaaaataaagtttgatcatttgagtgatgtcggatggcattaagtcatgaaactaagtgaaacttaaaggtggctgagaatgcaacaggcctccagagagcaatggaggtccttgggtagtgataaaaatggcatttctggctgggtgcagtggctcacacctataatcccaacactatgggaggccaagacaggaggatcgcttgaggccaggtgttcaagactagcctaggcaacatagtgagaaccttcctctaaaaaaagggaaataaaataaaaataaaagtttaaaagagagtttaaaaggcagttttaaaagagacttactcagcaagttttctgccaaatttacagtattaaaaagaaagaaagtgtgtttttgtttctgtttgtttttttgagacagagtcttactctgttgctcaggctggggtgcagtggtgcaatctcagctcactgcaacccctgcctcctgggttcaagtgattcttgtgcctcagcctcccacacagcagggattacgggcatgcaccatcatgcctggctaatttttgtatttttagtagagtcgaggtttcgccatgttggccaggctggtctcaaactcctagcctcaagtgatttgcccaccttagcctcccaaagtgctgagattacaggcatgagccaccgcaccctggccttgattgtggttttttaatcaatgagctgccatacttctgctctccagcaaaggttttctatgagaattttctgtaagctaagtaaaggaatatcttaatattggaagaaataaaatttagtcagagttgttttctacctttgtacacagcaacacttacaagtaatttgaagagtagctaataaaaatttctgcatggatggcttaggcattttaatttttttaaggttgcctgagtaaatctgaaaataataaattattacagttttgctcaaataaagaacacaaatagaacaaaaaatacataactggctagattacatgaaagcctttttccaaaacagaggtttagaggccagggcaaataggcaggaaaaataaataaagggcatccaaattggaaaagaagaagttaaattagctttcttagcagatgacattatcttacacctagaaaaacctaaagactccctcaaaaaacctgtagaactgataaatgaattcagtaaagttgcaggatataaaatcaacatataaaaatcagtagaatttatatatgctaacagtgaacaatctgaaaaagaaatcaagaaagcaatcccatttataatagccacaaaaagtataaaatacctaggaatcaatctaaccaaagacatgagagatctatacaaggaaaagtataaaactatgatttaaaaaattgaagaaaacacacaaaggtggaaagatattccatattcatggattggaagaattaattttgttaaaatgactatactacacaaagcaatttacagattcaatgcaatccctattaaaatactgatgactttcttcacagaaatagaaaaaacaatcctaaaatgtatatggagctaaaaagaccccaaatagccaaagcaatcttgagcaaaaagaacaaagttagaatcaccacactaccttacttcaaaatttattataaaactataataaccaaaacagcatagtacagatataaaaacagacatagtagaccagtgggacagaatagagaacccagatgcctaagtccacatgtttacaaccaactcatctttgacaaaggtgccaagaactgtaacggggaagacagtcttttcaataaatggtgctgggaaaattggataattatatgcagaagaatgaaactagattcgcttctcttaccatacacagaaatcaaatgaaagtatattaatgacttgaatcttagacctgaaactatgaaattacttgaagaaaacattaaggaaatgcttcaggacattggtctaagcaaagatctcattctgtcactcaggctggagtgtagtggcatgaacctggctcattgtggcattgacctcctgggctcaagcaattctcccaccttggctttccatgtagctagaaccacaggtgcatgccaccacattccactaatttttaaattttttgtagagatggagtctcaccatcttgcccaggctggtctcgaactcctgaactcaagggatcctcctgtctcagcctcccaaagtgctgagattactagcataagccactgtccctggccagcgaagatttcttatgtaagacctgaaaaagcataggctatcaaagcaaaaataggcaattgggattatgtcaagctggaaagcttctccacagcaaagaaaacaatccacaaagggaatagattacccaaagaatggatgaaaatatttgcaaactatcaatctgacaagggattaataaccagagtctataaggagctcaaacaactgtataggaaaaatctagtaatctggttttaaaatgggcatgagacctgattagaaaactcaacagaaaaaaaaatttgattaaaaatggattaaagatctgaatggacatttctcaaaagaagacagacaaatggccagaaggtacatgaaaaaatgcgcaacatcactaattatcagagaaatgcaaaacaaaaccacaatgtaaaatccacttgccctagttaaaatggcttgtattaaaaaaaaaaaaaaaacaggcaataacagatgctgggaggatgtggagaaagggaaccatcatatattgttggttgaaatataaatagtacagccactatggagaacagtatggagggtcctccaaaaataaaagtagaactagaacttccgtgtgatccagcaattctaccaccgggtatatatccaaaagaaaaaaattagtatatcaaagagatatctgcactcccatgtttattgcaatagtattcacaatagccaagatatggaattaacctaaatgtctgtcaacagataaatggataaagagaatgtggcataaagatatatatatatatacacacacacacacacacacacacacacaatgtggtactattcagccataaaaaagaatgaaatcctgtcatttgcagcaacatgtatggaactggaggccattttgttaagtgaaataagccagggaccgaaagacaaacatcacatgttctcatgcaggtgctaaaaaagtagatcctatgaagacagagagtagattagaggttaccagaggccgagaaggggagtgggaagtagaggataaaggaaaaaaacaagaatataaatgtatttattaccattaaactgaacatttaaaaattgtaaagatggtaaattatatatgtgtattttatcttaattaaaattttaaaaatcaggagtttagaaatttttaagagaagtgtgcccatagtgataagaaagaaagacccttttggaaaattttcttgaacaaattatacagtattttcttaaacaaattgtacattctgtagcagttaatacaccaaataagatttcagggttacctcttggagattgtatgaaataaaaacatttaggtgggcatgatggctcattcctgtaatcctaaaactttgggaggctgatgcaggaacaatacttgaggctagtacttcaagaccagcctaggcaacatagtaagacccagtctccacaaaacaaccaaaaaaattagcaagtgtggtggcacacacctgtagttccagctactcaggaggctgaggcaggaggaacacttgaggccaggaatgtgagactgcagtgggctatgattgtgccacagcactccactccagccttcactgtagaaagagaccctgtctcgaaaggaaggagggagggagggagggagggagggagggagggaatgaaggaaggaaggaaggaaggaaggaaggaaggaaatgtaaactcatttgatttggctgtaaaggattaatagaaaaggaaaacgtagtcactaggctgagaaaaattgaactctattgaattggtataaagatctaagtggaggtgtttggcagacatgatcatgaagctttcactgaggaaggaaactctaggaggcaaaagcagaaatgcaactcatcaaaattgaaatggtgacaaaatatgtgcattcaaacctgaaagtgactgaaagagaagcccaaacacacaattttggggtaagatgggaaaccattaccaaagttctcagaaagagcatttttaaaagtaagattatagaagccaaaaggatatgtagtagtctgttctcacactgctgtaacgaactacctgagactgggtagtttgtaaagaaaagaggttttattgacgctcagttctgcaggccatacaggagacatggctggggaggcctcaggaaacttacagtcatggcggaaggcaaaggggaagccagtacatattacatggtgggaacaggaggaggagagggagggtgggaggtgccactcactttttaaaacaaacagatctccttagaactcactcactatcatgagaacagcaagggggaggtttgctcccatgatgcaattacctgacaccaggcccttcctccaacatgggggattacaattccacatgagatttgggtggggacacaaattcaaaccatatcagaatgttagtgactaaagtaaatgttcttgattaactctttaatgtgtatattgagtgcaagccatatgcaggggctattctaggtactggtggtttactcaagaaaaagggggcaaaaaaatgaagaaggtggccaggcatggtggcttacgcctgtaatcccaacactttgggacactgagacgtgagaattgcttgagcccaggagtttgagatcagcctggtaacatggcaaatccctgtctctacaaaaaaatgcaaacaaacaaacaaattaatcgggcatggtgtcacatgtctgtagtcccagctacaggttgaggtgggaagatgccttaagcctagggaggttgaggctgcagtcagccatgatagcaccactgcactccagcctgggcaacagagtgagaccccatctgaaaaaaaaagaagtcaaaacaaatgaaaaaaaaaaaaagtcaaaacaaatattcagtgtaaatgtgagaccatgtaaaaaagtttaaaagtaaaatatatagtttaagcagaggatgggagacggggaaaaaaccttttctccctaactttatatactccctctataaattagtgcttatggccaataagaaatgaataatttcttttttcaccgttggtagtaaagtataatggtagttaacacaaaaaactaaatgatatattcagaacctcatactaaacaaagaaacaaaggcatgcaatcacaggacaggtggaaacagtggttctgaactaaccacaaaccagaactaccaaatgtgctacaaattgtttagtaacaaaggaccatcccttcagaatcgaagagcacgtctcagttatctcatgcctatgtgcatggaacttaaagtctcaaaattactcttacaagatggcaaattgaggctgtcagctaagctcctagattgtctgtttctccaagaaaaataaatttcagtaattattaaggaaaaagcatagaattgcatcatgttttacatttcattacttttggcatgacatgggagcatggatgttttctacaaagtgctctgataaattgaagaagaggccaacaacagccaccgaaaaaaccttcaagattcttgccagtatggctcaggggaaaaattccctcataaccacagatttgacttttcaacttctgtacttctgcatatgagtaataatctctgaggttaagtattcatcccatttagctaattgtccacataactccctgggtcttagattgctctataaatacctcctaagagaagaatttttcaaatgacagtttcgtttttcctttttcttcttttaaagcaacaaagaaaagcacgtctgtgtttatatttaaccaaacttaaacttggagagcattggccgtgttgtcgacgtgtttcttttctctactgttaaattccttactgttccagttactcaccatcatactcacctttgcctctgccacttggggtcctctgttctgcagttgtgttctgctctctgatgcctccaggttttgctgcaccttctagaaattgctcacctggataaggccttggctgtcctttatgactcatctcgttcagaagccttttgaatctctcttgaagaatattccctttgctcagtccaaatacacattcactcacttgaatgctgcttcttcctccagtttcacagtgctggggatgatcccgtaaggcctttaaattacattataattagtcatgcacttctctctgctctggggctgtttgaatcgttcactctctttatacctccagtgttcagcacagagcctagggtataatgcgtatgcagtaatgtttcttgaaggagtgaatgggcaagtgaaacaccaaacaaatactaaagagcaaaacatgtattgctcttgtatattaacacattccgagaagagatgggaggaaggtcttgaataatatcaaattatttcttaagagatcttgatttagatttttttcaaaatgagatacatgttgacactgctgtcaacaaataatcacataaaagctagagcctggcttttaagtatcagggggagcatgtgtgaataatcagcattgctgctgttgaagctccataaagtgggaagcagcgactgcaaagatccagagatggacatctgaagcataggaaaggggcagcttgaatgagataggagcaggatctgtattgattgcaggtcaccagatagaattaaaaaaatctatgttctcactagtggctacagttttcaaggacaaatgactattagtggttattgtatttttcttgttttcaatggagcagctccatgacttagttacataagaagttaaaggctccacccccttccctaccaatgtcttaagctgtcctccgtgtgcatacaaactttgtttccagactgccctcgtgtgactcagtccctggaccagcttcccagccccttctgtttccagcacatcctcctccacgtgttacaggattacaaagctttgcacagcctttcaatagggtttagagcaagaatgacagattgctacctggtaggcagcactgactatatttttattggcgttgcgtagagtgactgcatgacacgcaggttgtgcttttgttttgccaggaatttaaaggcatttagcaaaggccgtatgaaattatctgccttatgtacctcgaatgtgaggtaatgaacttgtcattagtcgtgttttagtttagtgttctcgctggaatttgcaaaagattaaaattctgcacatttcattaagtcttccacatgggctcaaaataccatcccgcaggctcgacctgacttgccacgttgctttgacaccatctctgattccagtgaacaaaactaagtaagtgtgacttacagccgccctaccaaacattgaaggtgtgagcctgcactgttgttttgtaatgacaatgacaagagtataatgacaagagtataatgacatcctagtccatgaagacatgttttctcttttccctccctctatgtatacttactcactcttaaggaaataatataatttctatttctgcttaaatctgccatctctacttagaattattttcccttgaaaaattaaattgcattatccatcagccaaatggaaaatctgattactaaatgcctacttctagacattatgaattacctgtaatatcacatttcttgggcacttctcagaatgctatgattttacataaaagcataaattacagaatgagaagagtaaagcttagtgcatattatgcaggttcgcagagtgatatgtggcctacgactgtcattgtaatcaaaattgatttttgatcatttataaaactaaaacaactaattgaaagcaaatttactttaactgatgaaattcaagatgaagtgacagtagtcatgaatcacagttctgtagatctgctaaaatgccaatgatctgttattaatggtgaaagtgtttaatatattaatgggaatccaagtaaggaaaataaaacacatattttgcccttaccttaagtcatgttgacatcatacataaatcaggtagaatttgaagatgtttcatccagcattcatcatgaagcaacagagtcaatagcgggcagttacagtctgtaggcaatgctttctggtgtggattatgcaaaaaacttacagtcatttggcttcctttattcccctttgcatgtaaactaccaggtggtaggtagacccattcttggctgccagtatttttaccacttggatagattctgctctctgaggtctttaagacaaacacagcacatgtacattgtgatataggagaaagaacatcagacagaggcagagaactgggcttgtcaaaattaagggtgacctagagccttagtgtccttatatgtaagatgagaagcttggattaaaattcattgctccttacacttgatttttatgcagcagaactttcttcaaaagagatcactcctggaatcccaatatacaaaatggataaaagtaggattgttctgaagtaaagaagtaaaatccagagccccacttatttgagtcatctcctaccttttagatggttattaacattgtttctagttcagaaattctggtgttttatattaatttaaactaaagttaaattaggactagaagagccatttcgtgtgaaaatagacatagtctgagtgatttaggcaaacccatagtgacagatttagtggcctgatacactggcttggaaagatctgttccaagtcagtctcaatacacaaggctcggtgaacacatggagagcagtcttggtggtggtcaagaacatggaatttgctgtgagagagagcttggttagggtctgggctcttccatctgttaactgcaaacttgagcaagttattcaatctccctaatattcagttttctcattcataaaatggattgataatggtaccttctatgtacagttactgtgggtattaaatgaggtaataagcctgtaaaactcctggcatgatgacattggcctacattaattgctcacagagtgagaacttattataaacacaggcatttttgttgaatgactgactgattgaatgaatgaatatagaactagctttctatttgtgatgtatggaatatctctatttcatttaatttcattttgaatattaaaattcaggcttgcttttaaaccaaagtatttgctgatgcaaagaatgaaattctgactatgatacagttacataacttttgaagaaataagaaaaatgctaacacagcatgaacaactttgatttagagaacagagtctctgttaaaatccatgggacttgtcaacttcatatttttgtttatgagcataaaacactctttagtgcatgtcggaatcatttgatgcttgctgaatcacaggttgctggaacccatccccagattctgattcagtctgagatgaggtctgggaatttgcatttttaacttgttgtctggtgatgctgatgctagtggtctgagaatacactttgaggatcactttttcacagtaaaagtcacagtcattaagcaagttaactcaatgagaaatgataatgaaaaggcatgtacctaaatagataaaggacctataccagctatgaatttgagttcagcaataattgtaaaatttgtaattcttttcaggtatttggtttttaaaaaactccctatgtatgcttttatcttatgttttatatggtgtccctcttttcctctctttctctctaatccagtttttaatgtgaacatgtttaatgtgaaaatgttgttcaaagcagaagcgaaccttttgtgtaaccttggcggtattaagtttgtttgtaagctatttctgccctgttagcttctgtactgaaacacgttttcttgcttttgttgcagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaatattaatgtaagccatataacatgggattttcctcaatgattttagtgcctccttttgtacttcactcagatactaaatagtagtttattctttaatataagttacattctgctcctcaaccaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacacatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcatagaagcacaaatcctattgtgaactctgcatgcaagggatctaggctatgcgctccttatgagaatctaatgcctgatgacctgaggtggaacagtttcatcctgaaaccacccttcaccctgcagtctgtggaaaaattgtcttccacaaaactggtccctggtgccaaaaatgttggggaccgctgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttctggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatggtaaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactgaatttctattcctatgagaaatgagaattatttatttgccatcaacacattttatactttgcatctccaaatttattgcggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattg

SEQ ID NO: 17013 - DNA, 9259 bp, Human
cctttttatttttatggcgccttttttttttttggcccctcatttaattgggaagcttctcagaatgtttttgtaaagtcactaaccaagaccggacctttcagttcatattaaatggcccccgtagtcaccttactttcatgtagtttcagattttgcagcctgaatctaatcacctttttctaagaccgaaagatcttccttgaacttaagattcgttctttcatcgcttcccattaaaatggaggcttaagacaggtgccagcagtgtttttaaaaattttcaccagtggtttggtcttagaacttactcctgggcacagggtgtggtcacggcaaataggatgtgtctggactggatattttaattagacaagcccagagtaagaagaacgtggtgtttatggaaagcacttcagctgaattattgagtagatggtttttatgtaattgaaactggtctacaagtttatcagattcatcgtcgaagtgactcagtaataaagctttatcaaatacaagtccgccaaggaagaacaaaaaaataagtccccaaagtgcagtaaattttttagtagcaaatatctctttgtaattttttattaaagtgaaattatctttaagtggtatttagtatattcagtgttgtgtaatcatcacttacacgtagttccaaaacatttccgtcacctccccccgcaggagactactacccattgagcacttactcccagattccctgtcccccttcctctagtccctagcaaccactaatcttcctgtctctctgaacttagctattttagatatttagtatttatggaatcgtgtacttttatgtctggcttctttaacttagcgtaatgttttcaagattttccaacgttggaggatttgtcagtacatcattctgaataatactcattttatgtctataccacattttgcttatccgtttctgttgatggacatttgggttaacatctttgggctactgtgaataagtgctactatgagtttacattttttaaaaaactgtaaagttggtctcgttgcttgataaatttttaccgcgtaagactctggtctatctaatgacatttgatactagccttgttcctatagttccaaatgaccaaaataggcatttatttatttatttatttgtggtttttttttggcgatggaatctcgctctgtcgccgaggctggagtgcagtggcgcgatctcggctcactgccacctccgcctcgcgggttcaagcgattgttctgcctcagcctcccgagtagctgggactacaggtgtgcgccaccatgcccggctaatttttgtatttttagttgtgacggggtttcaccatattggccaggctgggtcgaactcctgacctcgtgattcgcccgcctcggcttcccaaaagttctgggattgcaggtgtgagccgccgcgcccggtccatgggcatttttttaaaagtgaaaatcgttggccttatttttattaaagctggtaagttttggcttatgtaggtactttgaatcgcttgcctggtagtataaccttaaggactagctttcttcatcattgttttatttagttttgagtccccaacagaattctcttctgtttttctagaaatgctttattttggggattaaatgaaataacaggttaagtctcttaactcacggcccagatggtggtaaatgctcctccagttgttctcaacgttccaaggaagctgtttttttcttcactaattgctggcttcctgagggttaggagtaaagataatggggcggggtggcggggggggggaaatgggtgcttagcagtaacatttcttgtttggtttctagcatttttgtaatttttttttctttacgtgctaccttaaactctcttgtcctctctaatggagttctttctaaggatctgtggttttaactgtagatgtttagatgaatgaatatttttggtatttttcattacagaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaaggtgatttaatgattacgctgataaaaatgtgttgcttgtgtttttcatatttaaaatctacaggatatgtggctcttagatggctttcccaatcactggccaattgtatctttagatacaattgggatctttttttttttttttttttttggtggggagacgagtcttgcactgtcactgggctggagtgcagtggtacagtctcccgctccccgcaacctcggcctccggggttcaagtgattctcctgcctcagccttctgagtaactgggactacaggcgtgtgccatcatgcggggctgatttttgtatttctagcagagatggggtttcaccatgttggccaggctggtctcgaactcctgaccccaggtgatctgaccgccttgacctcccaaagtgctggaattacaggtgggagccactgtgcccagccaggatcaaatatttttaagagtagttgtgaactgatccttgtttaaaaaattgtttacaaaatggttacatgggttggttgtacctttacttttatgtgtttgaaatactccagaaagtgaatcagttactatttccctttgtgttaatagtgtcctgttagctggctgagtaaggcctgagtattgacctccatgcccccacccccctttcctcatatttggaagtataatgggaaaaaggagctgagtgttcactgtaaagctgcatgaaaggttggtcaattcaagcaggttgtagtaaagttttccagggcccacctcttcccagtcactcttcaaatatgatagcttatctaaatttaatgactggttgtattaagggtgaggaataatggtcttttttttttttttttactactgtgagctataatttctttttttaaaaaaatgtatatttattatttaaaaaataatacagacgacagtctgtgttgcccaggctggcctcaagctcctgggctcaagccatcctcctgcctcagcctctctgagtgctgggattacaggcatgagccacctcacctggccacagctataatttcttctgtgctgactgttgaggggagagggtgctgtaaaatggccaaaatggttctgtcttgtcttgaactgattttttacttggagtggggcagggggagaccaataaatacagcctggtaaataactgaaataagtgcagggacttcaagggaagaaatcataatgaagatacaggagaacttgtttttcaaggataaatggatcttcacacttaaattgcaactgttaacaaattaacattgagctcagtaatcagactggctctaacaattaggtgataaaatagaatttgacttccttgtgaattggtactttagaaaatcctatttgtttaatttgaaattaattgaaattttaatttgaaactgggaaacaagcttattttatttttcaagacagagtcttgctctgtcccccaggctggagtgcaatggtgtgatcttggctcgttgtaacctctgcctactgggttcaagtgattctcctgcctcagccgcctgagtagctgggattacaggcatgtaccaccacacctggctattttttgtatttttagtagagcgagggtttcaccacgttggccaagatagtgtcgaactcttgaccttgtgatccgcctgcctcggcctcataaagtgttgggattacaggcgtgtaccaccgtgcctggccaaagctcattttatattagtaaaaataagggagctagaaatttgatgttaaattgcacagacacttaggtgtgttctttgcagaatagccaactgagagtacttttggctttaatacgcatgtcagaaagtcaggctgttttaagtttaatatctttgccccctcagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcaggtacttgagagaaagcttgttaagaggtattggtgtaatggagtagctagtaggagcaggtatttctcttaagtttgttggtgggttttaaactttggaagaatcggaggtttctgtgaaacatttgttgggtgtaatttggggtatgtgagttgtgctgagtgttggcttttgtctttaggtcactgttcatgttggtagtcagtaacttctatcttggatctgtcttctagttcatctttctagttgcatctttccaaatcttcccttatacttcagtttaggcctttttccatttcttggctccataatgacaaacattacattcaactctagctcttcacaaatttgtgttttctactattagcacaattgtaatatttatcaaacaggcagctgttttaatgttacaactggtaaagtagaaatcattctgagactaacttaagtcactgaccaataaagggggctaaaaaagaagtaatcccagtcatctgttcttcaatcccaaataggagaaaattcagtttttttataattgaaaatggcatcattcttggaccaggcagtattgtctgggtgctaactccacatctcctcagacctccaaaatagtttctataggactaaatttacctcttacaggtgagtggagtccttctaggagacaggagttcaaaatcttgccccttttgctattttgaaaaacaacagcacactgttgcccatcataataaagagtatttgttagctaatagatggttgtactgatggcttgtttttcattttttttgtgctttttggtccatctattaataaaaatgaaccccgttacagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactagtaagtttttcctgcttatacagtttactgctggttaaaataaggagtaagcggcttaaagtaattcttttttctggatcaaaggctggctgtgcataattgaatggtaacgtacatatatattgcttgaaaaacttttaagggtgatagggaactcgtaatgtaactaggccttcaagtgaaacttatttgcatgtgcaagatgccaaactaaaaattttaatatctctaacagattagcttttctggcaaaaatttgttgaatcctatcacctttaaatggttttactaacagtttcaaaatttaaaattttggggttgaagtgtgggccaagctaaggtaattttggtaagcctaaacacactcttaaatgtgacgatcacaaatgcagttctaatgtagcacttaatggcatcaatatttacacctaccgcgttttcacaaaattacactatccacctggtacctaagtcttgtcatggacttacaggtttgcatgggttccaaatactggtttatggtactgtttttggaactacttgtgggactatattttggtgtggtgtttgggtagtgaagttagtttgacatgaagttttgcattggacagatctgctgtgaagcattctttgttaaagtgaatccatggttggaatacctgcttttcacttgagctttttgtttcttaatccttctgtgccttttttttcttttcttttttttctttttttttttttttttttttttttggacgatgggtgccagttcttcggcacattcactgggcccaacagtgagattgaaaagttgggaaatgcctcacgccataaatactaattgatgatgagcctaattttcctgtttctgcttttagatctccaagaaggagaagcttctctcgcagccggagcaggtaaatgactaccttttttggctacgttcttagaaatggcagtgtttctgctattcctaaacttttccaggtggcttagttaatgggaataaaccttggctttaatagtgaatcaagttgtaaggatgagtcagctttctttgagttttcaaaggctttttagaaagtatttaattttttaaaaaaggatctgtcacccaggctggagtgcagtggtgtgattatagctcactgtagcctttaactcctggccttggagtgatcctccctcttcagcctcctgagtagcttggactacaggcaagtactgccatacctggctaatttattttttgtggagatgggatctcactttgttgtccaatctgttctcaaactcttggcttcaagtgagcctcctgcctctgcctcccaaaatattggaattattggcatgagtcaccatgccagatcaagaaaatatttatgtataattttatcatacctcattggtcctaatgtttttttgcttgtttaggtccctttctagagataggagaagagagagatcgctgtctcgggagagaaatcacaagccgtcccgatccttctctaggtctcgtaggtaagatctttgataacttgtatttaagactttgcatacatagtatgctaaggcctgtcttctaagccataaattttttaccttaaagttctatttcgatatgtcactaaagtgtcaccaagttacagatgtaatgttttgttttctttttttttttttttttttagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaacttgaaagcctgtttttccttgcaaactcaaatctgtgagcttggtaccaagtccaggtataacattcctattggaagccatacttatattttcttgtaaagtgcttttgaattaataaaatattagcataattgtgtatagtcagttgaacccactgttaccattgttcttatcccatgggaagcagttggttacacgattcttattttataagaaacagctgagaggcactatggattagtcttctgaagtgaaggaaatatagatgtcacctaagtgatagttaacccattttttttttttttaggcatagaagccagttcagggtccataatatttagtgaccaacattttaaagtatagcagcaacctggttcttaaacacaaagtaagttgcccattaacaaatggcttttatctttagcatgaaaactttccacaggtctaaaaattgcttccattttataatttgaggtgttgcatgggaattctaagctgatccatcatgatgtaaaagttcacaatatggttcaaatgtaacagtgcagaattgaatatggaggcatgcataaccttcctcttagaaaatggcaggtgttgtaatttcaaatttttgtgcaattagattaaatcataatgcaacagtcttgtggcttagtttccttaaatatgctcttaagatagttttggattatgcggtattgactgtcttaaatatgaaagataagtcattgcattaagagttcaagctaaatggatacattaagatacagttcctaaacaaattatttatttccaccttttacacaaatcttgggagaattggtgtcaggaaggttcagccttaaagttaagcatgttcaagaaagacacttttcagacagcctgtttatttactgagagctctggcattgggcattttgtctttagtattctcacatagcctacaacctgttcctgttaggaacaagccaagatagctaagaagttacggaagccatgcaatatgtcaattacattgctttttataaatggacaacttatgtgggcatttttgggcagtatatgacttccttgcaggctcttaagttggaagggtttctgtaaaaaggacagttacgggtataatatggctaagagaaataatacagaacctgaaataaaagtaacttcaccagggagttatcctgacttaggtgacatacagtcccagttggcagttactttaaccaggag

SEQ ID NO: 17014 - DNA, 111424 bp, Human
tttcttaaaagaaaggtaaatctaaaaaccgtccagaattttcgatcctagtctagtaccacttacttgggaacaaatatagaagcacaggcaaccccgtccgttaatttggctccgtcattgtgcagacaaaaatcactgaccatgcatgccagaggtggatcatagttaactcgttaagactagaaatctacttgatagtgatttttatgggttcatctttaaaagtgacctcgctgaataaaagttcaatatttcttaaaagaaaggtaaatctagaaagctgtccagaattttcaatcctagtctagtaccacttacttgggaacaaatatagaaacacaggcaaccccgtccgttaattctgatgttgaacgtgtggttagagagcacactgcgatatgttacaggacctgagataaaaagcaaatttgtaaagtgtctaagtgttgatggagaaaaacacatctagcatatacggaaattttcttttgagttctctgtaggatgatcaccaactcagtaggtgaagccctgccctctagtggttatgggtgtgagaggacttctgttcaacattatatgtctggctcaccacggtttattaaaaccaatcgttcattaaaaagcacttattaggggtctgggtaagatgccgagcaagtgaaatgtttacgtgtgaaaaggcattgacactggacaaaggtacagctgctaaaagaagtgctcgttcattggcttcgacagctgtacgactggtttctaattgctgttccagcctctccccagttccatataccacaaacgaatgaaaaagattagctctccctggagctctctgaggctgaaccttgctctctcattacacatggtaactaagcacaccccttaaagaattttgggaagtcgccccgcgattaccggctcccgcaagaaccaagcagtcagtgcagggttttgcaagtgagagtgcgagactcgggaggctgctcacggtgctccagtccctggcaggagcatggacacctcgccccttccttccgtgggcctcaacgttgcctgctgagattgtgactgccaccccgacgggagcagcttcccctacagactttgtagagagcgcttaaacgcctcggggacagcggccatgactgtcagcttgggccgaccccgcggccgccccacgggaatgcgtggccgacacggggcgtgggcgaatctccgaccctcgcgttcagggggtgcatataaacgggcggacaccgtccctggggtaagggaggcgccagcaagaacaaggcgggccaccaaccccgagcgacctcctaccggacggatccaaacccaaacattgtccattccgggccgaagtctcggccttcacttcacttccgccttcccagcccgtgaacacgaatgcgcctgcgcgcacctctctcagcggaagtaatagtgacaaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttgggtgggtaccagtattacctcctgcccccatttctagaaacttccaggttctgaaggaaggggaggttcgggtatcccctggatgggggggcatctctagggcgccgccccgctggcgtgagctggggacgttgcgggcacacgacggggcgggtgcgggatcttggggaggggggctcccgagatagtggctgggcggggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggtaaaggcccctggccgaccggttgcaacgcggagttgagggtgtggtggtttgcttttaagttgtctttgtttttccacctttttattttcgtgagcttatttatttactgtgtatgtgaagtgtccaaggatttgcttacttagggtatccagcttttattttggtaacatggggcatttgagagattgaggttctgtgggtgactgagcttgattcagctttcttgaggaattcctgctctcttcagcttagggaatgagagggaagttttcatttcagatagcgtctgtgcatgtttaaatagctatttgaaaggaattactcgaggggaagtggaaatgggggacaaggggatggggctgcatctctgtatattggcgtttcaagcctcgatgtggtgtgtggcaggattcatttataagaaagcaagccatgttttattatgtctagcattggggaaaaaactcattatttttcaattcacaaaaaaaacccagtgaatttaatgaaatgttatgagatgagtgcttttcttaaagttccaccctatttcaaaacatcatttaggaggttgacagcggaacctgtttgttcactgtacactttggacacattagatcgtcattcacatgttacatgatccctttggcctcgttaaaatatttaatgcttttcctacacagcactgattatttttaaaattgttgaacaactgtgaataagtgattttttttccccctcctgaaacaacacttattctttggactgacttctgacttgtgcgtgatcatttttttttcttctgcctttaaccgggctgcaaaatactataaaagatacttaacaaatgacagttttttcctctggtataatttgttttaaaaaatatgtgtctggtataaaggagctgcagtcttgctggctgcttctaatttgtttttccattgttgagaatgtaagcttgattgtctgactaggactagtaattttgaaatgggtgtttcttatagatgcagtaatgtgttttgctatctgagacctctgggctatgtagggaatatgatgagaggcatgattatattgacaaattttactctggatggataattggcggaagacattttctgaaatactaaagtgtataactgcagaggagttatactgtctaattgggtcttgagaaacatttgaaagcagtgatgtttttggtgataaggaaagtcacttttctgagcctttttcctctcttttaagtttattgatttaagaaaggcaaatccattctgcacatgagacaaagaatgttaaatgcattcatatacttgtttcttggtagaaacatcttaaataacttctaacatttaatgtatgtttatgagcttgttttcagaatggtaccagatttaagagggtagcctaaagtaggtggattctttcatgttgcttttgtttcttgatctctcaggaggaagagcatgagtaataaagccgattctcattatctactgaggtgggagggggtggttgtgagataggagaatggtgcctacttgtgtctgtctctgtattttgtggccaaatatgaattttgtggtttcatagtaaaagattatacagttcttaaaaacgtgtggggttttctgtcccgttattcttgaccatcaagagaccatttttgtcagtttctccctatcgtcacatttttttttatatataaacagtttgaagaagagcctgtatatagcctagaaattttcaaaagtgactgaccatattaaactacatagattgatacctgtgcctttttattgttcacttgcctttttgtagttttcatccttctttgatatagtgtagtattaacaatttggaggtgtgaaacaaaaatggattcaagtcttgactaacttgtcttgaaccacttaaagctgtgtgattttaagtaaattacgtcacctttctgagcctgtatttcttcatctataaattgggattgataatctttaactcacagaattgagaggattaaatgagaaaccctgtataaattctcttgtgaggtaggaatgataacgtttaagagcttgagttgtggtggaaccatgcagactgatttgaatgctggattcgtcgcttaccatttggctttgtgcatattaaagttttctgtgcttccgtttcttcataaaataaagataatgatagaacctaccttatgaggttgttgtaaacattcaaacagtatctggcacatagtaagtgctcggtaaatgttaattataaattgcctagctgaatgtttgatacatactaataggccacctggcattaatattgtcatgacagttaaatgttggaagggggaacagtagtagccaaatgctcaaaatgaagttgtcattgttagttgagggataagtggagttaggtaaggaattttctatggcattagtgcttttaagcctacagaaaaagttagggctctaccaagaagccagggtccagtacagaaagagacaggtttggatttgaagcccgacaagtaatgttttcctctcctgaaaaatctgacaagttactaggcttctaagctttctcagcctttaagttatctcatctgtaaatgagataatgccctcttgcaaagttgatgtgagtaataaatgaagccgccagagcaatgtttgacatacagttaacttggatgaattgagtgatgctgctgttccctagtaagagtatcctccagtaggtatgcaggtagttacatttgtgggtgtgaacagtgtagaattgatagtgtttccctagagcatcagcatgaaggtttcttaggtagcttacagtggtgtggggaggaaatggtttcatccatgtgttggttccttcagcaatggtggtattttctttggcacttcggtttagattcttctggacttttttcctagggcccatttaaactttctcagcaaagcttgaccaatttttagctgtagactccaggatgtttcatgaacactttctgcttgtcactaggaacgtttaaaatgttaatttcctggaatttttggactacttaacattcagtcgtgagttaggattttatccagatcctttggaatttgtttttacatgtttatcacaaatctaaacagatcccgcttaggcatcttgagatgcacaagtaaacagctcttacctgatttttaaaagttaattgcatgtttaaagtgatagcttactagaaaagatatgtctagctggagaagcttgcacataggttttcctttctagtaatggatttattttttggaataaatttggcctttcccatagaaaattcagtgtgactttaatacacatgaaactttaatatagccttaaatgtttgactagtggatagaaatgtaatagtcttcaggatttcaggacatggttaatttaagattatagacagagctaataggtgtagagaacaatgccccaatcttttttgtttgaaaatggttgtatttacactttacttttaaaagcagtttcttaattcaatttcaaattgttaatcagctaggaatgtctcaagaaaaaattgcattactatagttggagaagctatagggaaaaagggatgagaagccaccttaattttattcctttaactgaaaataggaaaccaggttataaaaatatatctttgggtgtgggaaatatagtttatgttgtttgcagttttgtccataaaatgatagtcttaattagtactctgaaaaagagttgaaactaaaagagattatatatatgacattttgtaaactgtagtaatttaagccagaggatgctgtagagagtacttgtatgcaataaccttctgacagttggattccaaatacttgatttgtcttcatatttttgtcattcatttaaagtcagcagaattcaggtctgttaacgcaaagcattatgaaacaaaatagtttcctagggaacacacccctaggggcccaggactgattttggagatcttagttagccatgatctgttttgcaaggttaaattttgttttaaaggtgccaggaacactgtggcttgatggtaaagttagcatgaattttaaattacaccgttgttacatgtagcatcttaaaatatcttaaggatcagttcaagaggtcccctcacatttactttgttgaaacaaattctttttaataatggtttcaggcatcagttgtgacaaggttatctttatgcttttcatgtagacaaatgttggtaaaaggcagtaaagggtgcatcctgaggttaatgccatcatttcatgaaagaaaggatctctcaaaaaaaaggctaaattgataatttcctcttggatgtatatgactgctacttatatgcatttgttaatacagttgacccttgaacaatgtgggggttggggtgctgacccaccatgcagttgaaaatctgcatgtaacttttaactctctgaaaactaaactactaatagtctctactgttgcctggaagcctcactgataacataaacagtcaattaacacatactttgtatgctatatgtattatatactgtattcttgcaataaagtagagaaaaaaacttaccaagaaaattatgaggaggagaaaatatatttataattcattaagcagaagtggatcactataaaggtcttcatcctcattgtcttcgctttgagtaggctgaagaaaaggaggggttggtcttgctgtctcgggtgacagaagcaaatctgagtataagtagacctttacagttgaaactcatgttgttaaagagtcaactgtgtatcttctgtcttcaggctttaagttgctacgacaaaagtataaatcgtagaattacaaataaattacaccaattgtgttaaattaggttggtttagactaaacctgtgatgtgtttagaaaaagtttgaatgaaatgttgaaaagctgtcctagattatagacagaagacagtaatagtcggggtcagaagcattatcttaagatggccgtaactgggtgtctgattcaatttctatctctgctttttttaattctgctataggtattagagaatgtgtgaattggaattatttaatatacctgttagttgtaattgctttcttaagtaaaggccttttggtttgacatttggtcatttcgtaaacatgctgacctaaactcgtgtccctccctcagaaggaaatacgttaatttagtatgacatccttttttttccctttgtgcttatttatttatttatttttttgagatggagtctcactctgtaacccaggctgggctgggacacagtagcatcattatagctcaccaaagcccctaactcctggactaatgcgatctccctgccttagcctcctgagtagctgggattataagcacacatcactatacccagctaatttcttaatttttttaaagacgaggtcttgatatattgcccatgctggtcttgaactcctggactcaagcagtcttattgccttggcctcccaaattgttggaattataggcatgagccaccgtgcccagctttagtatgacattctttattcttttagaaagctttgagatattgatgcatccttatagaaattactttcatttatttatttacttacttaaaacagcttgataaagttggaaaaagcaggaccctaaataataaatatatttgccatcagccttttataggaaaactcagaaataataagtggaaatatttaggatgtcactcatcagactttttttttgaatatgtaaatgtgtttttttgaaaatttaaacacgcaaagtaaaaattaaaagttttggttaagttgtgaatttcagaaatttatcttggttatggtgtcctgaagttaaaaagaatagagcattagtacattagtacataaacgttctgttattctctgcctaagggcaagatccaactttgaaccaggtcctggatttcctctcatcttaaatcggagcctttttcatttgtagtataaataaattagccttttgatgctgtgattttatttgtatatgttatatatgagatttatatctctctttgtatgcaggcatttcactagattttgtttggccatctatttttagtgtttccctagcagcatgtttgctttacctgccttcatctaggtttctacatcatcaggggtggaaatattagttggcttaattaagcttgggagttgtaccttacttgctctgttgagtgtcagttctaccttcttttgaagcaggcaaaagcagttcatggcacaaatgccagaaatagcatgcaaaccactttgtagtggtatgcaaactaatttctgctgtgtccttttcttaatgcttgtgagggttactgtttacttaagagttaatatttggcttatgaaactagtatcagatgagaaattccagcatccctccccaccccagagaaagatgtggtcattggggactgctctgaagtctgccagccctctatcctaaaagttggtagatcagttattatatcttgatatgtacccctaattcatatgaggggccaagagagattagttactcctgatttcatctgttagaagataaagggagtgtggtttgtatctatattagagtaatgggaatgaagggtagggatggatgacagagatattttactcctaggaaaaatcagcaggacttggacagtgactagatacagagaattaagggaatagttgaatcagacatgactgcaagatgtcatttgggtcagtgaaggtgccattgattgtggttgaaggagtgagccgatttaggggctggctgaagggaatatataggtcagactgtcatgatgtgaggctcatatagctatgcatggagagaggtgttaaatcaagcaccaggattcaaagtgagctcttgaaggcagagacctcaatttgtcctttattcatcttgaacagactctgggacgtacctactgtcaattgaatgaaaatgctggcttcttccttctaagtggttctcatctcaggattgttttgcccccgggggacatttggcaatgtttagagaaatgctgggttgtcacaactcaaagtatgctactggcatccagtgtgtagagaccagggatgctggtaagcatgctacaatccgtaagacagcatcttctacctccccccgccaccctcaaaattttttagccccagatgtcaatggtgccaagattgagaaacactgttctaacaaacggcaaggaagttgactcctctaagccttggtttcctcacttgtaaagagattatgactacttcaggtttgttagaattagaccaggcagggtgtgtacaagtgcctggcatgaaagagcctctcagcaaatcctaatttcccttaccttacttgatgaatagatttaggggagttacttttggtcttttaactgctaatttcaaggcttcacgttttttttttttttttttttttttctgagaggtgagtgggatgcctaggaaacatagagtagcttttataatcttaatgcttttctcatggttttatcaaattatgattttgattatactttggtttgggtttgtactatttcaggattcagtatttagtgttcacctagcagtagacaatgaagttaaacccttagtgtagatcaatgaagttaagcccttaaattttactttttagcctgtaaatacattttatgtattatttattgctcacagaactgttattgtttggaagcaattttactattctttgaaatcaagaccaaaatgtactgaattttatttctcatggaaaatgctagacctcctatgtctattgcctttttcctttttatccatttattctaactagaccccccccgaagtcagaactcttccttagatttcctttttagggtcttcattaggtggctttcttttgcttgtcgggtgtctttttactttattttgtaaggtgttgaatattccctttattttgtaaggtgttgaatgtttcagtggtgttagggacaggaccaccgatattttcatctctaataccaatcccttagtgatctattccagtcatagcctcagtgtttaaagtctccttacatgtacatagttgtgtggcattctcatttttagggagtcactggaattctttgctgctatttctttccttttaggaaaaaaaccggtttactcttactatacattattttctccatctatagaatggaattactgtaggtaaaagtccttgagttcggtaaactatgtattggacttactaatgtacgttttattaattgcaggtggaatttagaaataacctgcctgtttttcatcttaaactaagattatttaaatattccattcattaattagttggttagaaaaattagcttttgaggaacaccacttaaacatggaaaataataacagagtacattttgtgacagcaaataaattatcggttaacttaaccctataggattcaaagttggtagctttaaatgatattaaattgtatttgactgtcaactgcttttaaaggcttacgtggctccccattgtacctgtagttatttaggtctggaagcacagggtgttaagaatgccaccataatgtcttttcataagggtttggtttgtcatagcctgtaaaattaggttcaccagttagctgctttatgaaatgaatgtcattggtcatggtgggggaggtattaggagaaggtataaaggaatctaaaaaaactttctttctttctctccctccctcccttctttccttctgccccttcctcccccctttcctttcctttttcctctttcccctttcccatttcccctttcccctttcctttcctttcctttcctttcctttccatcttctgtattgctagtaaaataattgttgctcactgaaggctttaaaaaacactggttgcatgcttaatataggatggcaacaaaatggacgggtttaaaaaatatgtagatggtatgatacccctttcctccatccttgtaccaaatttctttcaaacctagaataatttatacaaacagatgtatcagtagatggagtattatgcccactttttaatttaatgatcaaaaaatgccaaattcttcccagagtggcagtataattcagatgtagttaactgttggatgcaaattcaattatggtagaaagatttactttactttgagaggtttttctaaaatcttctaaaattatgttgatttttaaaatttgaaataactttagacttacataaaaggtataaaaatagtacaaagaggtcctggatatcttttgcccagttactcctaatgttaacatcttatataaccatagtataattattaaaaccaggacattcacatttataaactatcctttttctagttcaggatccaatttgggatcctaccttgcatttagttatcatcatgttagtctcctcccatctgttaagcttttcagtcttttttttctctcatcttttataaatgttactgacacttttgaagagtactgttagttattttttagaatgtttctcaatatggggttgtcagatcttcacccgtgattagcatgtcttatgatgggtgaagttaatgtgatcacttggttaaggctgtgtctgccagatttcttcattgtaaagttactgctttttcctttgtaataataaatgttcattttaaccttgtagttgtataataattagtaattcctttgtaattaataccttcctctagtggggaggtactgcaaatatactgtgtcccatcatacttatcatgggccagttttgcaatatcctgtgttccatcatactttacatgggcaagttttgctatctatcaatggttcttaactggcagcagttattactgctttggtctttgcttaatggcgagttttctatttcactcattcttactatatttggaattctacaattaaggaagtactgtcctctttacttattaattatccaattaatttatttacatggctttgtggatattttgccttatgggttaaaatccagtaattgttgctcaagtcattctcgctttggttattgagggcacttgaaaatttgttcctgtgtcttttctacaataccctctctcattttgtgagcactaatttactttctggtatcacatgatgttctgggtgtatcttgtatttttcctgcttgcaccagccatggaatcaaccatttttccagggagctgagttcattttactagagaatgatatctagaaaccaagatctgggtgccaggtgtgctccatgctactgggtgtcattgcttctaggctctcttagtagatagagctagcagtgtatatgtttggtaacatgtatgaacacatatgtttttattttcttatctatccatctatgtatataaataaaaaactgccagtgatgctgccagttctgttcttccaccatagggtccattttggtcttttttcctgttcagcccttttctctttctttgttacttccttctccaaaggtgagaaactgttctcaaccacagtatattgacttacttgtttcatccgagtacacacaaacaaaagtagttttagaattagtgacctattcattccctggtgagaaacacagttttaaactagagtacaatatttgtctttaactttatggtatacaggcaaattctgttttcagaagttacttgggttcttttcatccctgcctaagggttatgttagtcacttgtaataaaattaggttcacttgttattgtttgtatgctgttttaagttcctcctacatcctgtttcatcatagcacagtatccctctcccatttatttatgataaagatgtgttcttaaaaggactggatttgcttaaggttgggtacagctgtaattgctttgccagacagcagttaaaggacatgtgctttggcaatcattctcttgggcttgcttgcctggttccttagtttcagctctcatttctacatcgtttacacttgggaattgatatcagctgtggccccataactgtcagtgcttgaaatcatgcccatcgactaaatcttatttgttctgtatgcacagttttagacccggagccacctacagtatgaatactaattctctcatagctgtggtaaatcatgaagtattttgtagaccctgtcctttactgggtttttctttttcaagatagaatcacttaccacaaaatttgtcattttaaagtgtataattcagtggtttttagtatagtcacaaaattgtatattgatataattctagaacatttttatcaccccagaaagaaaccccttacccattagcagtcacttcccattctcccctttcgctagcccctggtaaccactaatctactttgtctttatggatttgcctgttctgggtatttcatataaattgaatcatacaatatgtgaccttttatgtctggcttctagcacgtgttagtacttcatttctttttgcgatgaaataatattccattgtatggatatacacattttgtttattcatcagtttctactttttgtcaaaaaataacactattgtgagcattcatgtatgggtttttgtgtaaacatgttttcagttttttcaggtgtatacttaggagtagaagtgctgggtcatggtaattctatctttaatttattgagtaactgccatagtggttgaaccattttttcattcccactagcagtgtatgaggctttcttttaattaatttctccacatcctctccaacattttgctgttttttttttttttttccattgcatcctagggggtatgaagtggtttcacattgtagttttgatttgcgtttcccaaatgactaatgatgtgtcaaggatcttttgcatggattcttcatgcaaaagaatgaaggtggactcttatctcacagcatatgcaaaaatcatttctgcactctgacttctaatctgttggtttataagtctttgcagatccaagtaccacaatgttttggttactgtagattttgcgataagttagttttgcaactaggaagtgtgatgtgcttattggttatttgtatatctttggagaaatgtctattcaaatcttttgaccattttgtaatttggttatttacttttttgttgagttgtaagagttctttatatatatgtgtgtacacacacacacacacacacacatacgtttattctggatactggataggaatatattctatacttgtaccagtatacaaagatgtttacctaagagtgttcactgcagcaatgtttataagataattatcagagatatggtttgtaaatatttctcccattctgtggattacctgttcactttctgaatggtatcctctacatcagaaacttttaaaattgtgatgaagtccaatttatatatgtgtttcttttattgtttgtgctttatatatctaggaaaccattgcctgattcaatgtgatgaagattataagaattttatagtttaactctcacgcttgatccattttgagttcatttttgcatatgatgtgacataagggcccaccttcattcttttgcatagaatatccagttatcccaatactgtttgttaaaaagactattctttttccattgaatgtcttggcacccttgtcaaaaatcaattgaccagaaattatgggtttatttctagactctgaattctattctgttggtttatatgtctttgctgatgtaagtaccataatgttttgattactgtaggttttgtagtaagttaattttgaaactggaagtgtgagacctttaacagtgtctgcctttcttttttttttttttcagattgttttgtctattctggatcccttgcatttccatatgaattttagaatcagtttgtccatttctgttaaaaaggcagttggaattttcataagcattgccttgaattgtcctttactttgagaatataatattcttacttaggtacaaacataagactttttgagtactatgtttgggtgtgaccttattctaggtaacaagcatttcacagaaatagaaggccaaaaggtacatgaaaagatgttcaacctcagtcatgaagaaatgcaaattaaaaacaaaattataatttttcacttgtcagattggcaaagattagagtgtagtgatgactagtcttggctagactgtggggaaaatagaagcttctgagtttgaagtttttgacacagtccctttggagatcagtagcagtagctatcagaataaaaaatatgaacaaccaaagtttcactttcagaaatgtattctgtacctgtacttgcacaaatataccaagaagtttgtacaggatgtttactgcagcaacatttgtaataccaaaagacaggagtcagcctaaatatcatcaagaggactagttaaaattgaagtactgcatacaatgaaatgccctgtgagccactgaaaagaatgaggcaggttagtatgtaaggtgacatggagtccaagatgtattgaatgacaaaatttgttattgtgtggttctattagaaattaaaaaaaaaaaacaccagaaatacttgtatacacacctgtatagaaaatggctggcagtatacacagaaatagttaacagagattacttctgggcagtagaactggaaatctcattaaatcctttctcattacttgactttttttaaaacaatgagcaggtttttgttttctgaaaaatcattaagaatgactcagtagtgcaagtaaaattaaaattaatactactctttaggaataaaatatttgtttttttctgtcagtttgattgttttatatataatatctgttggtctctagagcagtttgattgttttgtatataatccctgttggtatccagaggtaaatgcattttattgtgatttttattgctgtgtggaaaatggattagaattagttcttgggtacaaatatttaatagtatttggaaccatatttttcatttctacatattgtaagtatgggagaaaaataagatttatcttttaagagttgtgattgtgctagtttttaatttatcaaatgaagaatatttaagaatatttaattctttaagtacaaagaatatttaagaatacttaagagcattgaagcctgattatgccactgttctttgggttcatgctctggaacttaaggttcagtgaagaaggtaaccatttcatagtatctcccttaacaaaggttactgatacattttcagaaaccttagtaccacaggcagtaaggaggcagtgagatccctctggattttgccagaccattcctagaatttttaaggtgaggggaccaatttcccaccccatatagaaatggcaccaacatctctcctagaaacttcctggtgattggaaactttttatctgttgatgctggttctgtctttagggagaatgtcatgtttcatgtaacatatcttaaaatatttgaagatacctgtcatatcctttatttagaaatctttattgaaatccaattaatggtcaggtactgcccttcatacttctctaggccgaatattcctaattccttccactgatcatcttaagacctcatttccagaaatgtcaccatagtatgccatgcttggtagcaggctctaatgatgccctaaactgaatatagacttctcaaggtatggttggattgttgtgaaatagtctaggctcattgactcgcttggactaaaaagctatctttctcataatgcagtttaggataatgtttacctttttagcaacaggtttacactgagaatgcttttacagctctttaaatgatgtatgaggtcaacttaacccatgtgtttgtctgaattattattgtagagccttagcatctggtatgttagtagttggtttttcggtatagtagtaggttttatatatatatttatatttatatttatttattgtcaatagagttagggtctcactatgttgcccaggttggtcttgaactcctgggtgcaagtgatcctgctgccttggcctcttaaagtgctgcgattacgggcatgagccacggcacccagctagtagtaggtttttacatttatttctcataagtatacgtgtatgcttttgtaaatgttgaggtggtggtatattgcctcttctcgttgattctgcctgataatcagcttgttagaattttgttttggtttgtagttctccttgaagaggtccttcacatcccttgtaagctggattcctaggtattttattctctttgaagcaattgtgaatgggagttcactcatgatttggctctctgtttgtctgttcttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactttgttgaataggagtggtgagagagggcatccctgtcttgtgccagttttcaaagggaatgcttccagtttttgcccattcagtatgatattggctgtgagtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtagcagttcctccttgtacctctgatagaatttggctgtgaatccatctggtcctggactccttttggttggtaaactattgattattgccacaatttcagctcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtagtgatatcccctttatcattttttattgtgtctatttgattcttctctctttttttctttattagtcttgctagtggtctatcaattttgttgatcctttcaaaaaaccagctcctggattcattgatttttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaattgaggatacaaacaaatggaagaacattccatgctcatgggtaggaagaatcaatattgtgaaaatggccatactgcccaaggtaatttacagattcagtgccatccccatcaagctaccgatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccataacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggaaacctacaaaatgggagaaaattttcgcaacctactcatctgacaaagggcaaatatccagaatctacaatgaactcaaaccaatttacaagaaaaaaacaaacaaccccatcaaaaagtgggcgaaagacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacatgtatgtttattgcggcattattcacaatagcaaaaacttggaactaacccaaatacccaacaatgatagactggattaagaaaatgtggcacatatacaccatggagtactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgttgtggggtggggggagggatagcattgggagatatacctaatgctagatgacgagttagtgggtgcagcacaccagcatggcacatgtatacatatgtaactaacctgcacaatgtgcacatgtaccctaaaacttaaagtataataaaaaataaataaatttaaaaaaaaaaaagaattttgttttggttatgaggcaaggtgggtatccctctccagccttgagttaatgtcatcttggataagtatgctattcagtatttatctgagttgttgataaaatattaacagaatagagcctcgtggcatacctagtggtactgagttattaatactactggcccacctgtcagaaattatgcagtttagctgtgtattttcatgtgacagtgtttataaaatgtcttgttggcatcagaagactgtacagccttactgtacttaagacatgctgtttttaaatgattgttttctccttttccaaagttaaaatctgctgtatttatttaagatttttttggtgtgtgtatgggggaagaggggaggtggaaggatgaaaagattctttgcactaagtttgcttttggttaaaaagaagcctgtattcttagatcttaaatctagtctcactatactaaaattagtcccctaaactggatttactttgaaacttttggatgacctgactaatttaaatattgtacaatagttaagaaggaggacttttagtgttacacaatggttcggttcctggccatatcacttactagttttgttaatttctttttgtgttgggcacattacttctttaatctttaatttccctatctaaaaaagtagtaaaaataatgccctcttcagattgttttccgaggattaagtgaagtattagaaataaagcactcagcatcaagcactggtacttagcagcttaacgggcaaacctgctctttccctcctcctcctcctccttagtactcttcttcctattatgtttcctccaactgttactgtgataacatataaatgactaaatgtgaaatcagtagagttttagactttttttttaactcaaagcttcaaactaaaaacagtgtatttcttgcagatcctttaaggataaatagttgatcttttaaaatgaaagtgccctgtgaaagtttcatagctaaacatttttgttctttagtttaaggcttaagccatataggtttttttgtttgttttttttttgatttgttttaactagtcaagtgcatttcagtgagaagggagaaagagtagaaaggtgttggatctgtaactgactgtgaacaatcagttgagataactcaactgccttcagaccagccaagccctatagttttacaagaaaaaacccattcaggttagtaactcatgttgaattacttttggctactttgtgttcaataatatcattctggggtgtctttgtcttttttggggggcaaggaaatggggtcttggtattttgcccagcttgggcttgaactcttgatcttctgctttagcctcctaagtagagggtgtctttgattatatcttaataaaaggattggaagttgaagcaaggaattaaaaacataaatgtgaattactgatagatgttaggcaagtagttgtgtaggtgggactaacttgcttgactaagattttgattgcccatccctttcacgttctacctccctaccccataacataccttgaacatgaaaacatggggaacatagatttcaatagaagaagcccaattatttgtgaataagtatgagaaccatctggatattctgcagttgttataatacagagcaaatagagcattagcacctacgggaaagcagttggattgttgaatcttctttgacttgtttgttgctttggatgacaggagggttccttcctacctcttagtaaagattgggaaagaaaagagttaattgtgaacttactgggattaattcattctgggttttttttttttcccccccttgagacgatgtttcactctgttgcccaggctggagtgcaatggcgtgatcttggctcactgcaacctccgcctcctgggttcaagcgattctcttgtctcagcctcccaagtagctaggattaaaggcgcctgccactacgtccagctaatttttgtatttgtagtagagacagggttttaccatgttggccaggctggtctcgaactcctgacctcaagtgatccacccgcctcagactcccaaaatgctggaattacaggtatgagctactgcgcccggcctaattcattcttaattataagaatgtacagtttttgtttagggatatagtgttagttgaaaaattagggaaaaagtctgttacttagcttagtttttcatttatccttttatttagcagttactgagtaccagctatatgccaggcatagtgagtgttggtttgtgtgacctgcagttcttgtagctattgagtttatagtgtagttgagggaaaaacacgtttggatgagcagtgatagttacgtggtaggggactgagtgtgagtaatcggttcagggttgtcgcaagccaacacaaaaaagctcatagaaggaatgaggcctaaaagcttagtgtagggtatggagtgtgcaggctggacctggcttttgcctgcagaaatgtgctacaagcatttcagacaaagggactcagtggtagacctcttctacatatgccacttcagtagtgtggttttagattttatatttagccatttatatttagcctgaggcgttctgagtcagtccaaatccactgtcactaaataaatgggttatgtatcttaataacagaggattagccatccttatatgtgaagggcagcattactgggacatgtaaagcaaacttatttgtgacaacagaatatttaagtatagttaataaataggattcttatagtctcctattaggtaacattccttttagagatcctcatggagtatgagtatttaaagtgaggtggaggccaggcacagtggctcacgcctgtaatcctagcactttgggaggctgaggtgggtggattgcctgagcttaggagtttgagaccagcctgggcaacacggtgaaaccctgtctctactcaaaaaaaaaaaaaaacaaaaaattagccaggcatggctgcatgtgcctgtaatcccagctacttgggaggctgagacagaagaattgctttaacctgggaggcagaggttgcagtgagcagagatcgcgccactgcactccagcctgggcaacagaacaagactccatctcaaaaaataaaaataaataaaaaaataaagtgaggtcgaaactatgattttcttggaggacgggcccaaaaggtgattgattagtagggttaaagattaaatttgtgcttaaatttatatatatattttttctttcttctttttttcttttcaaagccattatgtattgctgcagtaccaatttcttttgccttagcggggaaacagctggtaccattgcaggcagaattcaagttccctgattaatgaagtggaggactgtttgaatctttaatgtcttacctttatgtgtaacttgacccctcagttctcctttttctttttttattcagccactcgacagctcaatttttctttttctttttttattcagctctcagttctctatctttttattgtccaaaaaccatacaaatggtgttttcttgcccacttttcttactcatgttgaggattggtttttctaaacatagcttttgtaaatcaatgtgtactgactgatttcacttccctgattatatccttaaagcagctaaggtcattggttactataaatgaagtacacacaagtccgtgacttgtgatggtttgacttaggatttttcaacttcacgatggtgtgaaagcagtagacattcagtagaaactgtacttctgttcttcactttcagtacagtattatttattaaatacatgagatagtcaacactttataaaataggctttgtattagattattttgctcaactgtaggctaatgtaagtgttgctgagtgtgtttaaaataggctatgctaagctatgatgttcgcttcggtaggttaggtgtatgaaatgcatttttgacttgttactttcaacttatgatggatttgttggcatattatcccattgcagttgaggagaatagtggattctatgaagataaacttaactaccaggtaaaagacatttcttttttttaaaagcagattaataatatgtgaacgcctttggatttgttttatctaagtaagactttagattttgttgtgttatagatggtttgcaattgtgtttaacacataacagctgggaatgagtgccagagtattatttctgaatcttgcttacatggtagtgtgtgctaaaaattaagatgtaaaacttttgcttttattttacctcgacatttaaaaacactagtaaaacttgggatcaggtgaaaacttttttgttttacttgcaaaaatattctcttaaaaatattgtggtaaagagatctagcctcttaatgaattttaaagtatacattattgttggctataggtacaatgttgtacagcagctctctagtgcttattcatcttgactgactgaaacttcatgagctttgattagctactctccatttccccttctcccagcctctgctaaccatcattccactctttgatttttatgaatttgtattattttagatagtggagttatgcagtcatttgtctttttgtgactggcttatttcacttagcatggtgtcctcaagattcacccatgttgtgccattttgtagaatttcttttttttttcaagctgaagttttatttaaattgtaaaagaaatggttcccaaaaaatgctggcgaataaagcaaaaggataagatatagtgctcccttcctacgagttagccagcctatccgagtacagggtaatatatagtacttaatgctggtagaattttgcagtagtttagaaagattatctgtgcctagattatgaagagattctcagtgtgtgatgcttggttctgggtttacaccttactgggcatgaacaagagccctctccttggccatagccaaatcccttgggcccaaagttctttgcatagcaccctttacaatagatttcaccttctttttcagtcaggagttgttgattcaagactcttcccacactttgcacatcggaaatagtttttgttccagggctttccagctccagttaccttctcagcagcatgtacggaatccccacatctggaacacttctcagcacctctgtatttctgagcaaatttagaagtctttggatttgcttgtaggcatgtgaggctgaacactctggcttgatgcccaggctctcaccacggtccatgttaagtatgccagcgccctggccataaactgtagccttttggcccatacttctttccatagcaggatttgcagtaaatctcttaatcatgaattgccactgtcttgctatctaaattattcctgcaaatcatgcatagaaagcagcagcagtgggccgggcgcggtggctcacgcctgtaatcccagcactttgggaggccgaggcgggcggatcatgaggtcaggagatcgagaccatcctggctaacatggtgaaacccggtctctactaaaaatacaaaaaaattagccaggcatggtggcgggtgcctgtagtcccagctactcgggaggctgaggcaggagaatggcgtgaacccgggaggcggagcttaccgtgagcctagatcgcgccactgcactccagcctgggcaacagagcaagactccgtcttaaacaaacaaacaaacaaacaaaaagcagtagcggtggaagctcctgccattacactgcacctcttctgcgtggtgcacggccctcccgcagaccccacacttgtttccacctctccacgcaggcattttgagttggaggcaggagcacgcatcacaggcggagctagagaggctgggctggagggagtgtccagggagtccgagatcgctagaattttagaatttctttctttcttttttttttttttattgagagagttttgctcttttcgccgaggctagagtgcaatggcgcgatctcagcttactacaacctctgcctcccaggttcaagcgattctcctgcctcagcctcccgagtagttgggattatagacgcccactaccacacccagctaatttttatagtagagaaggggttttaccatgttaaccaggctgttgtcgaactccttactgcaggtgatccgcctgcctcagcctcccaaagtgctaggattacaggcatgagctaccacgcccggcctagagtttcttttttaaggctacatagtattccattgtacatatattccacattttaaaaatcctttcatctgttggtggacattaggtttctgcagctatcactatcacattgtgaatagtgttgtggtgaacatcggagtggtaatatccgtttgagatcctgatttcattcttttggataaataccccaaagtgggacttctggaatatatggtagttctgtttttaaatttttgaggaagcttcatacttttttccatagtggctgcaccattttgcattctcaccaacaggattccaatttcttcacatcctcaccaacagtagttgtgttttgttttgttttggttttttgataatagttttccttacaggtgtgaggtaatattgtgttgtggttttgattttcatttccctaatggttaatgatgagcatcttttcatgtgcttactgcccatttgtatatgtttggagaaatgtctgttgatgtccttagcacatttttaagttgagttatttgtgtttttttactgttgaattattggagttctttatatatttggagactagccccttgtcagatgtttgcaaatattttctctcattccgtaggttgccttttactctgttaattgtttcttttgctgcgtagaagctttttagtttgatgtagtcccacttgtttatttttgttttggttgcttatgcttttggtattaaatccttgagataatcgccgacaccagtgtcatgaagcttttcctgtatgttttcttctaagagttttagtttcatgtcttaggtttattaaatcattttcagttgatttttgtgtatggtgtaagaaaagggcccagtttattttttttaggtttttacatgtagatatgaagttttcctgatgccattcctttcctcattgtatattcttggcatctttgttgaagatcagttgaccatatgtgtgtggacttatttctaggctttctttctgtgttcttgtggctctatatgtccgtctttatgccaataccatactgtttagattatggtagctttgtaatattaatatattttgaaatcaggaagtatgatgcctccagctttgttcttttacaagattgatttggctatttatggtcttttgtggttccatatgaattttagaatcgtttttccatttctataaaaaataccactggaattttgatagtgattgcgtagaatttatagatcactttgagtaatattggcatttaaaaatactaagtcttaacaaaacgtgagcataggtgtttctgtttttttgtgtgtcttgtttaatttcattcattgttttctggttttcaataaacaaacctgtcacctcattcaagtttattcctaggtagttaatttttttctattgtaaatgagattgttttcctaatgtccttttcagatagttagtgtatggaaacattactgatttttatatgttgattttgtatcctgctactttactcaatttgtttattctaacagttttttaaaaatggaatcttgcgagttttctttcttttttttttttttttttttgagacggagtctcgcacagtttcccaggctggagtgcaggggcacagtcttgggtcagtgcaacctccgcctcccaggttcaagtgattctcctgcctcagcctccgaagtagctgggattataggtgcctgccaccacacctgactaacttttgtatttttagtagagatggggtttcaccatgttggctaggctggtctcaagctcctgacctcaagtgatccgcccacctcggcttcccaaagtgctgggattataggcatgggccactgtgcctggcccaaaagggacaattttactacttcctttctgatttggatgtattttttttattttattaagcatttaatttattgcttaattgctttggctaggatttccagtactatgttgaactgaagtagggagagtgggcatccttgctttgttcctgatctttcaggaaaagtttctgttttttgctattgaatataatgttggctgtgggcttttcatatacagtctttattatgttactttctttttattccttgtttgtagagagtttttataatgaaagggcgttgatttttgtcagatgctttttctgcatctattgagatgatcatgtgatttttatctttgattctgttaatgtggtatattaatacattttttatatgttgaatcatccttgcatcacaagggtcagtagatttccctggtatgaaacccacttgatcatggtgtattacctttttgataggctgttagattcagttagctagtattttgttgggaagttttgcatctatatttattaaggatattggtctgtaattttctttttttgttatattcttcccttgttttggtgttagggtgatactggcttcatagaatgatttacggaggattccctctttatctttaggaatagtttcagtaacggtagtaccaaatttctttgaatgtctgaaataattcagctgtagatccatctggtactggactttttttttgttggcaattttttcattcctgtttcagtctcaccacttgttattggtctgctcagagtttctgtatcttcctgatttaatctaggagagttttatatttctaggaaattaaccatctcctctggattttctagtttgtgcatgtaaaagtgttcatagtagccttgaatgatcttttctatttctgtgttatcagttgtaatatctcctgtttcatttctaattgagcttatttggatcttgtctcttcttttcttggctaatgttgctaatggtctattgattttgtttatttttttttaaagaaccagctttttgtttcatttattttttgtaattttttgtttcaatttcatttagttctgctctgatctttgttacttattttcttctgctgggcttaggtttggtttgttcttgttctctagttccttgaggtgtgaccttagattgtctgtgctctttcagactttttgatgtaggcatttaatgctgtgacctttcctcttagcactgcttttgctctgtctcagaggttttgataagttgtgtcactgttacccctcagttcatagaattttaaaatttccattttggtttcattattgacttgaagtcgtcattcaagagaagattatttaatttctatgtatttatgtagttttgagggttcctcttggagttaatctccagttttattccactgtggtcagagaggatacttcatataatttcagttttcataaatttattgagtcttgtttaatggcgtatcatatggcctgtcttggagaatgttccatctgctggtgaaaagaatgtatattctgcaattgttgggtagaatgttctgtaaatatctgttaagtctatttgttgtagggtatagtcttaagtccattgtttctttcttgactttctgtcttggtgacctgtctagtgttgtcagtggattattgaagttccctcactattattgtgttgccatctgtctcatttcttaggcatagtagtaattgttttataaatttgggagcttcaatgttaggtgcatatatatttaggattgccacattttcctgttgtactagtccttttatcgttatataatatccctctttgtctttctttttttttttgttggagacagagtcttgctctgttacccaggctggagtgtagtggtgcgaccttggcacactgcaacctctgcctcccaggttcaagcaattctcctgcctcagcctcccgagtagctgggattacaggcacacaccaccatgcctggctaattttttgtatttttagtagaaacgagttttcaccatgctggtctcgaactcctgcccttatgatccacctgtgtcagccttccaaagtgctggggttacaggcgtgagccaccacacctggcctcctttgtccttttttaactgttgttgctttgaagtctagtttgtctgatataagaataactacttctaggccggaagtggtggctcacacctgtaatcctagcactttgggaggcataggtgggtggattgcttgaggtcaggagttcaagactagccttgcaaacatggtgaaaccatgtctctactaaaatacaaaaattagccaggtgtggtggctcacgcctgtaatcccagctacttgggaggctgaggtgggagaatagctgaacccaggaggtgaaggttgtagggagtctagattgcatactgctctctaacctgggtgatgaagtgagactctgtctcaaaaaaaaaaaaaaaaaaaggataactacctttgcttgcttttggtttccattttcatggaatatctttttccatccctttatcttatgtgagtccttctgtgttaggtgagtctcttgatgacagcagatccttggttcgtggatttttatccattcttccattctgtatcttttaagtggagtatttaggccatttatattcaacgtgagtatttagatgtgaggtactgttgttttcatcatgctagttgttgccttaatcccttagttttttgtttttgttttttttttcattgcatcattgttatataggccctgtgagatatatgctttaaggaagttccattttggtgtattttgaggttttgtttcaagatttagaacttgtggtgctggtttggtagtggcaaattctcccagcatttgtttgtctgataaagactttatctctccttcatttatgaagcttagttttgctggatacaaaattcttggctgataattgttttgttgaaggaggctaaatataggaccccagtcccttctagcttgtagggtttctgctgaaagatacactgttaatctgataggtttttctttataggttacctgatacttttgccccacagctcttaagattctttccttcatcttgactttaggtaatgatgactatgtgcctgggccatctttttatgatgaatttcccaggtatttttgagcctcttgagatttggatgtctagatctctagcaagaccggggaagttttccttgattatttcctgaaatatgttttccaaactttcaaatttcttttcttcctcaggaacaccaattatttttagctttggatgtttaacgtagacccagccttcacggatgctttgtttatttttttttaaataatttttctttatcttggcagattgggttaattcgaaagcattgtcttctgtctctgaagttctttcttctgcttgtttgattctattgctgagacttcccagtgcgtttggcatttctctaagtgtgtccttgatttccagaagttgtggttgttttttatttatgctatatatttcactgaagaattttccttttatatcctgtatcatgtttttgatttctttaagttggacttcagctttctctggtgcctcctttgattagcttaataattgaccttctaaattctttttctggcaattcagagagttcgtctttgttcggatccattgctggtgagctggtacgatcttttggtggtgttaaagaaccttgttttgtcatattaccagaattgtttttctggttccttctcatttgggtagactatgtcagagggaagatctgggattcaagggctgcttttcagattcttttgtcccatggggttctcccttgatgtggtgttctcccctttcccctaggaatggggcttcctgagtgccaaactgtagtgattgtttttgctcttctgggtctagccacccagtcgagctaccaggtgccaggctagtactggcgagtgtctgtaaagagtcctatgatgtgatccgttttcaggtcttgcagctgtggatactagtacctgctctggtggaggtagctggggagtgaagtagactctgtgagggtccttggttgtgtttttgtttagtgtgctggttttgtgttggttgtcctccagctgggagttggcactttcaagagcatatcagctgtggtgctacagggaggatgcacatttgccctagagacacttggtcaagtattcaggtttctcaggcagtgagcaggcccatagagctcccaagagattatgacctttgtctttggctaccaggatggctagagaaagactacgaggtgggggcaggaataggggtgtctcagcctctccttgggtgagcttgctgcagctgctgttgcggggggtggggtgagggtgtggttcccagtccagtggagttatagtcccagggggattgtggctgcctctgctgagtcatacaggccaccagggaagtgggggaaagctggcagtcacagaccttaccttgcttccatgcaacctgtggtcttaaaggctggtctcacttccatcatgcctccccaacatcaccaagtctttttccaggtagccggttaccagggtggatactttgccccagaccacaagcctcccccttgagaaagcaaatggactcatagtttttaggcctcccagagaacctgcagtggtgatccaatttcttcaaagggtctgtggattctcttggctttcctggtttgttcctgtggtagttcttgtattgtagcaaaagttcatgatgtgagtctccacatgttgctctgtctgtcagaatgggagatacaagctagtcctgcctcctatccaccatcttaatttgagcatctagatatagtttcgaataatgtgtatctacctacaaagttcaggcatggaacgaggcaaataaaacaaacacaaaaactggatagcaaaactactccaatgaggagataaaggttttcaaaaagtacttgaactggaaagcctaggtgatactaaaacattaaataaaatagtatatccaagacccagtatgtgttaatatatgggataaccagatcgttttaactgctctggctaatcctcatttctataaatatgtagacaaaactagcactgctgtatggtaataactaccagtatactgctttgtcctttaaaatgtgtctgccatactaggctcaaactattaaaccaagtttttctactaaggctaggaatgtcacatgtatgcagggatgagaaccttatcacacacactcacgctcacataccaggtctctcagcccttgggcgtcaccttccaactccatgtgtattttatgcatgtgatctttatatgtgttctttcgctgttttcctatcatgtgaaacacattaaacatctcaacacatttgcgcctggttttggttgcccagtagtattcttgtgtgcaatgaaaccagtgagcaagtacacatagtaggaattataccatcttggtagaaaacagctatataaacacggatgtacatatttcactggaaatctcaaggacccacctcttcagtctgtagcagaagtctgcttgccacatcagatccttttacccttcacctctattcttggaccccaaagcagggccagtgcttttagttttgtatctggtgtcctcaaaatgaatatggaaagttcataaacactatataagtactatgtgaatctggttgaaaacaggtaaaacaacaaacctacatatactaactggtagttaaatttatttcacaagaaaaccatctttaagattttttttttaactttttttttttttttgagacagagtctcgctctgtcgcccaggctggagtgcagtggcgtgatctcagctcactgcaagctctgcctcccgggttcatgccattctcctgcctcagcttcctgagtagctgtgactaccggcgcctgccaccatgcctggctaattttttgtattttttagtagagacggggtttcattatgttagccaggatggtctcgatctcctgaccttgtgaaccgcccgcttcagcctcccaaagtgctgggattacaggcgtgaaccaccatgcccggcctttttaactttttaaaatagagaaaacagtatattccttggggaaagatgaaggattgagaaaaccagctctgggtaaaaattattatgactgcatctggagttgattaggcctgcctaggaaagaaacaggcaactgctatatgaccacaggggacagccaccatctgagtctcagcagactagttcacacgccatgcaatgttgctgtatattcaaattgtaaaaatcatctagcttatcatgaaacaagctgcatttatcatcagagactgtcaggtcatcatctccacctgcagacagagcttaagcagcatctcacctatctcaaagatgacagactcttgtcactgttgtcaaaggggttgctgttctgtttcctcagtgagctcccagagttggttccttccttgggccctgtatctgtttatgttcccattttctgtctctggctccttttaccaccatcagggtaggcagacttggaacaattctctccaaatgggcagcttccatgttcttcgttaaaatacctacatgccttatcactcttcatctccttgtattcctgaaatgagtttctgctaccttctactccacgcagtactcatgtggaatgacaaagttaaatatggcctggcattctgggatggactttaccatcttgcttttctgttgcttagtactcctccacttgtgaacacacttgaggtgcaggtgtggttgcagctggagagcatctcaaagcagccctttatatatttagagagtatcatgcccctttagtgttttattgtttattatatgaaataataccgtttcctactctggagatttacagctactttgagcccatggaatacccccaaagggttttatgtaaagtgtgttcaaatgtagaccctatctatataccaactaccaaaggattagttgagaaacattttatgagtaaggctgtcatattgcatgctgggtactagagttagcaatttccaatatattattgatagaaaagtaaacattaataggaaattatcatgaactgactttactcaccttgtttagtctgtattgaccttgttggaagaaaagtattaatagctgtcatttgagctcttactagtggtaagtcaaatgctgtgttagtgtatttaatcctcaaacatctctgtttagccatattatccccaggttatatatatgaagaagatgaggtttggggatcttagaaataagagattttattgatctgtcactgcaggcagtgtaaatatatttgattcttcttaattttgctttatgatctcacaagatgaaataactatgtcatctatttcaattctcattgttttaagatttaaatcattttggggggaatcttctccaatgttttacttaggaacggttcaatgaagtctttcccctgtcctagtttgttttatagatttgaaataagggcatttcagtggctctaaaacatgtgtgtagcttttgtaaaattcctaatcttttctctaagtttttacatttcttgattatgtaaaaatattatgctataaaataatttcagtaatttgcagtaaagaaaggtaatctgtctctagtttcctcatatttattcaccgatatctcctcattaaaagttgaaaaatactactgctctttgttttaaagtatttaaacgtccaactgtactttttacataaataagattagaaaacatgaatttgattgttccagaaactcagtcatactgagagaagactttttttcctcagcaatttactattttttggagtaaatgcaaaaagcctttatgtgtgcaggcctctgtaatgacactctaatgtagtagaatcttctttgatttcatttgcttaaagatactgctttaaaagttttagggaaatattttatcctaaaaatgttaattatccaaggttgaaaagatcttacctgacagcttaaaaacttgtatctgggcagtaagatgataattttagtttcagtattattttaattgagtggatgtgtggcaattcaagtgttttcgtctcttaagtttcagtagtgggcagcttttgtctcccttctgttttcactcaaagcattttgtctgtaaagaatctcagcttaggactcaaaacaagtctgtgttgaggatttatttctagagttgtgttaaacagttttctgtagctatagataattacttatgaagctgcatcaagtacgtaccttgattactactatctcgtgactaactgcttgttcacagccttccccacccttcccaccagctccccttcactaacctgtgcatcctttgcttgtctggtctcttttacttcttgtttttctcctagtttgtgaatagctcttaaagtctgacttgttgtcatggtgcgttgaaagagtagccagttgtcttttctgggtagatcagctatgagctgactgactaagaggagtagttaaaatggagaaagcttagctgtactttgtcttgcatgttaaacataatgagtttagaggattatgattatttgtaatcatcaggatctgctagacaggacatctgttttactttttactcttatgttggtggagaaatagcgtgcttttcattcaatgtgaaaattttgtgttctagctgggcaccgatggcttagtttttgaaatgtaatttcttgagaagtagcatgtggttagtataaaattgtctttcctattaggactagctacgtaattagtctgaaatatttttctaactggaaaattagttgctgtgaacttttggatttttattattctagactgcattacacttgtttgctatattcaaatattttttctttggttttacttcctaggttgcacgttttcaaaaaatacctaatggtgaaaatgagacaatgattcctgtattgacatcaaaaaaagcaagtgaattaccagtcagtgaagttgcaagcattctccaagtaagtggttagtggggaggaagggactagatggtgtaaagtcagtcacttagactctataaaacagtgctgtctaatttacttttcttcagtgatagaaatattctgttctgtgccattcagcatagtagccacaagttgaacaggactgttgagcttgacatggggttaaacttgacagaattaaacatgactatatgacttgaaatgtggctagtgtgatggagaaactgactttaatttaatttaaatttatttaaataactacaggtggcttagtggctacctgattggacagtgcagctctagaacataatagcttttctaggaactatattagtgctgtgtaaggattggttggattaggaaaataattaacgtaagtagtggtaggagtttatctttttttgataagggttttctaaggtaaagtaaaaacttaagtacaagtttagaattgcagataatctgtaattgcttatgtaggctcttcctggttttcaaaagtagtatctatcgaaacatgaaaaagataatattttttatttttccttcagcagtcacatatcttagtgatagcattaaaaacatgggtatccttttttaggtttttgttgttgttgttattgtatttatactctgctttaaaaccacttatttgtaatatgtttgttttgaaaggctcctttattggactctattataataaccttttggtcagggcaactattttgggggtacagataattttattctttaatagttagaatactaaatcatgagagagaataactgaaggatgtaggtagtgtttatagaacataaactgttccaagaagaagttcatctgaacttcactgcttttgagtaatttaggaagcacaaaatttgagcatgaaataattacacagtccaagagtataaattaataccaaccccagggttttgataggcccagagaacaaggaagacatttatggcccattgaacgttctttgggagaaactaattttagaaaatggcgaaacaacaatgaaaaggaaaaagctaattaaaatgtactgttatgctttctgtaagtcttgtggctgattgtgttatttttctccctaaattttgtttgtttggtaaactctgcctttttgtttacattttttttaaaaaatcaattttgttgagatataattcacataaaatacaatgtactttttaaaagtgtacaatttgcattttgacaaatgtaatcaccaccaccattaagatagaacatttttatcactccagaaagctcccccatgtccctttgtaattaatccctccctctctatgtgtcacttctggtcccaggcaaccactgataggttgctctcataatagactagttttgactgttgtagtttctgtaaatgtgataatacattatattatgtgcttttttgtgtttttcttttctgtgctaacattttcaataactttcatgtataaactctaataggctgatcttcagaatggtctaaacaaatgtgaagttagtcataggcgagcctttcatggctggaatgagtttgatattagtgaagatgagccactgtggaagaagtatatttctcaggtgagatacttttacttcctcttctactgtgtaatttattaatacatggacttctgttatgtagttgcttacttttgtgatactgtttatggagaaaggaaataatttttagatgttttttacctaaaatttttcatttgttggggcttactgttaggttggaattcctgtatttttagtatgtaaatcttaaagacaacattttccatatgggtatattacacaaagataatactgttgacagtagtgtcctttgctgatatcaaacctacactatttaaatgataggactggcaatattttttaaggtaatcatggccagctcagaaaactagtaaaaagtaagttaggtaagttaaactcaggctgcctgggtacaaattacaccttcatttcttaccagttgtgtcatctttattatcctctgagccttatctataaaatggtgatgataaccttacgggagatagttagctctcagtagatgatagttatttatattttttcatcctaaattttaggaaagacttattctagactgcttttatcttgataacgattgtgttaatgtaaaaagttacaggttactatgattagttttgaagtaattaggttggtttgctaaacaaatattttttgctaaaaacttctttttagtaaatgtctgtgccttttaacctgcggtctttctaaaacgatctatgtttaacttttctaaagtgccttttctgctaatgagcttaaatttgccaggcttaattttgcgaatgagtttgtctaaagtagcaacactggaattttaaaggttggatgaaccttgtgtgtatatgtcttatttttatggaatattatttatatgtgtctttgtattttcatacttaccacattcccacattaccaaagacttcagaaagcattaacatagtttactctggatttataaattgtaatgatttgacttatccctaggcagtatgatttaatgttttactttcttgatcctgttaccaaagctagagcacctgccccttgggattcctgtgagaattaaatagtgcctgtaatgtagttaagcacaactaaacaaataacagtaaatagtaatcgtaatcacaaagcactgggtgattattcctctgcagcctgccatccatcaagtggtgtgcttagtaatgtggcacagcttttttaggggaaaataaaaaagatcatgggtcttgccctcaaagtgtgacgttaatagctaacatttttaagaactttttttggtttacacggtgctttaatgtacattcttagttaatccttataacagttctttggtataaggttctgttttaccagatgaagaatctggagcttaaaaagattaaggtgacacacagatgccagcaactggattcaaacctaggtactctgactcagtcaggtttgtggttggtcagccctgaaccatattgcagttgcagtgttattttattagggcagtttaacttattattttttaaaaatcctcgttagaatcacttggggagtgcttaaaaaatgctaaagcctgggccttatgcctaaagattttgatttaattaacttggtgtgaatctgggcattggtattgttaaaagtttcttataggattccgatgtgaagaaggattgggacttgttccagggaatggaaccataaaggggctttggaggtggtggcatgtaacctcagagctatggtatctaagggctggggctttctggtgggatggattctttttagcctaattactttgcaactttgacagtgatgtaacactttagcagaggaagagattctaacatcagagtttcaaggaatagaatgtccaactggaagaatttggggttgactctggtgtgaggtcatttaaatgctttctgatcaggttgatgctatagtcctgtttctttgatatgatttgctgtggtagatagaaaccaggaaagctagccttgaggaaaatcttcagtttcttttgtggagaggagggaatttttctgtgatatgtgagtcaaccacagaattgtaatctacaccattgtacttgagaaatgtttgaatctcagtgttctattcagtatttcgcccaaatttttagcttaaaaatcatcttctcctgctttttctagcctcagtagaaattcagaacagctgtatttcttaaattaatataccaaaaattgctgtatactataaggaattggttaattcttagttttaagtattgctatttaattttttttttctgaaaaggaactgttaaaaagcttttaaatgtagttaagtataaacgctttttttgttaattgaagagatacataaaataaactgagtatagacttttgtaattttccagtcatgctcttatggttttttttttttaaagcctttgctgagagaactgtcatgtacaaaactgtgttgaattgctgtttgtttttactttcagtttaaaaatccccttattatgctgcttctggcttctgcagtcatcagtgttttaatgcatcagtttgatgatgccgtcagtatcactgtggtaagaaaaaaattacatatttttaatctgttgagtaagtgtataaattgggattggtttttattttggaaaataaattgagaagtgctctcagatttttttcagtgtccaaattctgcttttattttattctttttgttgcgacagtttcttgttgtattgcccaggctagagtgcagtggtatagtcatgactcactgcagccccgaactcctgggctcaagctgttttctgcctcagcatcctgagtagttgggactacaggtgtatgctaacacccccagcaattttaaaatttttttgtaaagacagggtcttgttatgttgcccaggctggtcttaaactcctggcttcaagtgattctcccaccttgacctccccaaagtgtcgaaattacaggtgtgagccactgtgcctggctcaaattctgcttttattatagttacagtaattttgagtaatgttcaaaagtccatgattagcacacatgaaaattctttaactggtaattttcacaaatatgaaattttataattatctgattaaattttaaatttatttcactttgcagttgagaatatattttgactagttgtgaactaaagcctgacatgtgaaattaaaaatattccttatagtgcatgctgtatttacagcatacatttactatatatgattttattctttccagctaggttattctagctttcattgaactgttttctcatctttttccttcttgctccatttcatttttgtataaaaaatttgtagcaagtaaaagcacttatgcttaagaacactgtagatgttattgtagagatgcagctcttgaactattgcttgcagtatcccaggtatccctgagacctgttcaaggggtatgtgaggtcacaaccattttaataatactaaaacattatttgtctttcaattatagacttttggcattaatggcacaaaaacaatggcaggtgaaactgttagagccttagcacaattcagagtaatggcacccaactttgttaacagtcattgttttctttcatgtttcttaagaatgttcttgataaagcagtaaaaattaattttattaaatctggacccttgagtacataccttcataataatttatgtaatgaaatgggaagtatgcatgaaactcttttgtatattgaaatacaatggttgtctcaaggaagggtgatgattgtgaggcaaactagccttgtacttgaaagactgactcatagacaaactatgggtgttaggacttgggtaaccagcagattcttatttttgaaagtgaattaaatgagcgaatcagaccaaggaaaggcaactggcagaatttgttgctaatgataaaattcaggttttcaagcaataattagggttttggaaaatttgtatgcactcttatgggttggatagcatcccagtatttaagactttattccaattagatcagtagtgatttcaacaaatgtgtgttttttttaaaaaaaaaattgttacgaaatgtggtaaccttggggaagatttgggcaatcttggggaagatttgaataaccaagtgaaccaatatttcccagaagaccaatgcgtgacattacaaaatctgaaatggtaaaagatccattcaaatgcaagataggtcaatggatttcgatataatagattatgaaaggtgcattgatacagttttatattctacattgcagattacctttaagtaactagcacttgagttttggtgtagtagctaagaagaatatccacaatcatctgaaaaagctgttaaaatactcctccctaggctgggcatggtggctcatgcctgtaatcccagcactttgggaggctgaggcgggtggatcatgaggtcaggagattgagaccatcctggctaacacggtgaaaccccgtctctactaaaaatacaaaaaaaaaaattagctgggcgtggtggtgggcacctgtagtcccagctactcgggaggctgaggcaggagaatggcgtgaaccccggaggcggagcttgcagtgagctgagatcacgcccctgcacaccagcctgggcaatagagcaagactctgtctcaaaaaaaaaaaaaaaaaaaactcctccctaaaaaaaataaaaaagaaaaaatgctcctcccttttccaccgtatctgtatggggctggattttcttcatacactttagcctgaacaatatgttatagtaaatggaatactagctttctagaaagtcatatattaaaatataaaaatttaaaacactgctatttttctcacaatttttttggaaaatttatttttcataaagttatttgtgttagcatgtaatgaggtttaaaattttttacatgagttgatgagtagaaattaaaactgactagttgaaaaatttgatatggtaaatatcagtatatataacccacttaaaagctggtcctcaatttgtgagagcataaaagggccctgagatcaaaaagttagagaagctgccctggtaatggcaagccactgtaaactgttagcttctttccccacaggccttaaggtaaagttgtgatttcttttccagctgatctcagtgtttaaaatctgttattgtgggactgcagatagttagaaaaataaaatacagttaacagttacttctcaagttaatgtctgatttaaaagcctgtttcttttgtttaggcaatacttatcgttgttacagttgcctttgttcaggtaagtactctattttgccaacatgaaaatggtatgttaattgcttaaaaatcaaggtgtcttgtggtagaacctaccgttattggggggttgtaatgcccatcagaacaacttattctttgtttttcaagtaatttcagatacagacaactcttcagggaagcttgtggtgtgggactaaggaactgctttgatttaggtagtgagatgaagaaaatctagttttttatttgataatgttaaggataactgaagcagatggaaacaaaaagcatagtaatagaaataaaatccagcagtaaacttttttattttttcaattaaaaaattggaccagagtttatagtttcataacactgttatgttttaatgcctactagagctaagtctagatgaaacaaaaaagtatagaattaaaaggtcgatctgtgatgtaccatttgaagaaaattccacaggtttctgtgactgattcccttagccaaatgctacacttgtttgctgaatttatcacttaaccttattttatttgagtctgttttgaggaattaaaatggttctactcattgttggcatgacctcctctcccctccctttaaaacaatttctcattcctccacaaaaggggtgttgtgatctgaatcaaagtaattcaaacagtaaataaaacatatgtaaagtagccccttttaaaaattactatgaataatgtggagatactgtcaagatttctattaataagtacagacaaataaaaatgtaggcttagttttatgtttatttaaatatctgaaacttctgtagattttagaacagtgtttcacaatatcagcagatttcctttttagctagaacatggttaacaagaatagaattattctagcttagagaaaaatgtaatattgttgcataagcctgaagttcgtgctgttttgaatctgaagcctatactttgaataactatggttgttcttacatctacgatttattacgtgggtatttcttgtcactatcccagcctcttaaggtaatctctaacctagttgttattagttctgtagtaacccagtgtagaaagccagttggaatcagatcatttgcagtaggtttgtgagctccattagtagactatcagggttccgcttttaggggaatcttcttgcttagacaaatgttgcccatggtcaggtggagctggttagtctagcataggtcatttcaggctaaccattattcaaggcagctattcattcagccaagtgagtgatatgacccactggaccactaactggaccttcttgcgtctttaagaatgtgtcagatatgtggagtgccctacttcagaaggattcctgcaaatagtatcactatgtatggaagaccttagtaccttgttctctttgatcactagaaagcccatgttttcaaaaaacaccacaaaattgtgattttaacataagtcaatatggaattttacacaagatagtgttgttatacacattaaatgctatggctgagactattaaatatgtttatgataggtacatttgatagaaatctcacaaaaggatgaaaactttataaaaagcctagtttcaaattgctaggtctgattcttacacacatgtgacccatcaccaaatatgcctgtgaaaccaacaaaatagtctataaacaagtaaaaatcctctccaaaaagatcctatttactgtcagttgaacttatcataatgctttaatcaaaaagctctttatcaaaaatgtataaaaaattcttaatactttatcattatttgttatttgtgctatattacttgtgtcttaagagggctttttatattcctttttatatttatgtcctgccttttttccgtgtgtctttgcaatccccattccccacaccactgtacttcttcccagccataaaaatagctaattgttttatatagtcgtaatgaagtcaccttacaataaatttgaaaaatgacttttaggcatttattaggttttaggtggtatgtttaatgatcattttgatatagaggtatctttataattgtagggagtagaggctaagaaaccagaagacataagtaaagattgggcagcatctatgtcatttattactgggatctaggattgatgggtattttctagcatattacagaatttttgggtaaacttccaaattccttaatatccttcatgtgtttggggtgttgtcttatgatttttacatttgtagattttccttatatttgtcactctaagattaagtagagactgattgtgttctaagttattcttacatagccttgtgttttctatttgaagtttgtgatggataggacattttgactagtactagcactgcagtcatttcaaaacattcccaacccttctacctccactatttgcctctccctcttttgaccttagattagaagattcttttgcttactacagacatgaggcaaaaatagcagtgatgtgtgatgcaagactgctcatggaaatgtggactaagtagtattgtgagttgaaggatgtttctgactgaccctcagctatttgttatctggatggaagaaggctagaaatcacattgttagaactcctgagaattttcctttttggatacacaggttgatgggaactgggtctgtcagtatagagccagccacatcttactccttgtttatcccatgtttgttctaatggtttactttgtaaaccattgctgttagcatgggcttaaattcctaaagcagatgttgtttacggttaattatctttgacttctgtggtcattagacacttaacataagattatctaaattttaaggctcaatgacttaaaacttttaatgactcaaattatgtactctttggacatactagtcagttttcatttttattctaaataaccttaggtttgtacattgaatattaaaatgtaaaactgggaatatttaattatcaaaattgatctctacatttaacattttaaaataagggacaagcttttctgggtaagaatataagcacaagtaaaggaaaagatgagaattgggggaaattttaaaataatgattgagattaataagtctaaatggaatatattcatgggagcaaaattaaattctacttttttttgtttgaataggaatatcgttcagaaaaatctcttgaagaattgagtaaacttgtgccaccagaatgccattggtatgatcctttttttggtatggatttctgcccctttaaaaatagaagttgaatgtgactagtaccgtacatattgttatccccactttgtctgaacataaggaagatactattaatctgacacaaaaagttcctggtctcattaatgtagcaaaactgtaccattgaaaactttaaaatccgagattctagagacatggatgtatttaacagattttttttttttttttttttttttttttagatggagtctggctctgtcacccaggctggagtgcagtggcacaatctcggctcactgcaagctccatctgccgggttcacgccattttcttgcctcagcctcctgagtagctgggactacaggtgcctgccaccacgcccagattatcttttgtattttttagtagagacaggtttcaccatgttagccaggatggtctcgatctcctgacctcgtgatctgcccacctcggcctcccaaagtgttgggattacaggcgtgagccaccgcgcccggctgtatttaacagtgtgtgtgtgtgtgtgtgtgtgtgtgtgtgtgtgtgtgtgtctgtgtgtgtgcgcgcacgcgcgcatgcatgcgcgtgtccatgcgcaagtgtgtgctaagccctgttctgggtatagtgattcacaatcaaacagacccaggtgattcaaaaggttgcttcaatttgcacattttacatttgaacaaataatttgtttttcaagttattttctgtcatcttggcatcttaagtgtttagaaacagtctttttcttggttcttatatttgccttttcctcagacaagcctactggaaataattttttaagacaagttgcatgaattttttttttttaaccatggttgtttctatttcgtgttacagtgtgcgtgaaggaaaattggagcatacacttgcccgagacttggttccaggtgatacagtttgcctttctgttggggatagagttcctgctgacttacgcttgtttgaggtaaatttgggatctgattgtaataagtgaaaatacgtggatgtagattaaaggataaacattactagttttaaggaattaacacatagttgatttgaaccatttggtattctactttaaaatgtgacatatataaacttttttttttccttaaaatgtatctgtctctactgtaacatcttttgaggtgtttgtttagtgaatcagcagatctttatagaaacctgcatattagggactgtgggagatacaaagatgatatgacagaatacttgtgactagggaacatactatgtgtacacaaattactcaccataaaatagaactcagtaattgagtaagagaagttcaaagaataggatatagacatttaaagaagggagaggttccacctgatttgaatgagatcagaatatgcctcagaccacatggctttggcagtgataattgaagagtagtactggacaaagatggggaagacaatgaagcaacaccattcaaatcactatgaacattccagtgtatgaaactctgttgggacatggtaagggtagaaaacgtgtgatggaatcagatttcagaggccttggatactaggcttaacttcagatttttttggttaggagttaccttttgaggctcctgtgcagttgctaaataatgttatccttaatctggctacagtgtgtagaatagattgaagaactggaaaatggagataggcacctagtttaacaggctttcaaaacccattagtatgcaggtcttatctaccattggaattaagctgtttgttaacacctgcagagcagtcagtctttaaatactatggccaaaagtatgagtgttctcatagatgctgtagaaggcctgaaaaacctttcagactgtaataagaacaaacttggcttaatctttcagcagaggccttttttccaaatatttgaaatttatccttagaaagctactggattgctttaattgggtgactaggaataattgataatattgcaagtgttactaattttacttcattatcctttttctcgtctttgaggtctttttaatgttaattcttttctactcttctttccttcagttcctaatattttgccgatgacaataccttgaattattcttcctcagagattaagtagtcttgtcacttggcataagttttcttccccctcccccagaaaaccctaatttaaattcatggagttcatgccattctttattctgggctgctgctcttccagttgagaagcagaacttctcattgggatagttagaagatggtgtttctcatttgcatggttcgagaaatataatgatagaaacttcaaaacaccattaatgcttgctaaactattttagggttttcatttaactaagggttaattgacttgacagttaattatttcaaagttcacatgtaaacaggaaagaaaacctgtcagtatagattagtatgtattttatctactcagcaaatatatattgaaaacattgtgaattttttatttttgtttttgagatggagtctcactctgttgcccaggctggagtgcagtggtgcgatctcagctcactgcagtctccatctcctgggttcaagcaattctcctgcctcaggctcccaatagctgagattacaggtgcctgccaccacgcctggctaattttttagtatttttagtagagacggggtttggctgtgttggccaggctggttttgaactcctgacctcaggtgatccacctgcctcagcctcctaaagtgctgggattatagtcgtgagccaccgctcctggccgacattgtgaatttaataagaattataagcatatgtcttgtggagtaatttattagttattattgttttccccctacttgttaactttgcaagcacttcatcagcacgttttattctgcagtactgtagttaggttgattttgttctagttaatccacttttacgtatatagttgaacattttttattctctctaccttaattctgccttatttgttttgcctgttacttgctaccccaaacagacttttgcaactactttgactgcagattgaaataactttccttaaagagttggggatcttttatccatctaaatttaaatgtactgacttaggatatagactgataaagtcagtttctcttctggacacagaagctgctagttttttgaaagtaaattggcttattggagttttgttggctcagtttggctgtggtgatctttggataattttgtaaggctagctggtcatttgatactactgtatgaaataaactgtcattagggtttaaaggaaccagaaaactccttagtcagctttgggatatcactaatttcttccaaagcacatagatttcactttagagaaagcaagtctgtgaacttctgctatgtagttagttctcttacagactaggcctaaagccacagttgcaactttagtgtcatcattttgtaactgtcataaattttagtgctttcagagtttgactgtaaacttgcctgggtccttagcagcttcttgttagcacattcagtgacttgactgttgtacaacttttatctggtacaacttttatcttcataggttgtgtcttagcttgggttgctttaacaaaataccatgccatttatttttcacagttacggaggctggaagttcaaggtcaaggtctggcagggtttggtttctggtgaggactgttgctagcttgagatggctatcttcttgcagagtcctcacatggcggagacagcaatttctctctcttcctcttatacggccactaatggcatcattaggactagcctcatgaccgcatctaaccctgattacttcccagggccccatctccaaatactataacattgactgtagagctatatagcatgtgactttttgggatacatagttaagactgtaacaggttgagactgccattttgtttatactttttaaagactaatattaataacttaaggaattgtgtagtttttcccttgcctgtgtcaggttttcagaagccagtggttgagccaagatagttttcccttggtatccactgaggatcggtcctagtagatccacagagagcaaaatccaaagatgctcaagtcctttacatacaattgagtagtatttatatataacctctgcacatttttctgtatactttaattcatctctagattacttataactcctaataaaatataaatgctatgtcaacagttgttatactatatttttaaaagttcgtattttttttactgttgtattttttttattatactttctttgaatattttccacctgtgattgcttgaatccactgctacagagggaggactatagttggtggcagtggcctttccagcaggagcctgagaggcactgatggagctaggacagtaaaacttagaggaattgagctttgggcatgttatttgtttttttttcccccgagggtttttattttaacttttagtgttgagaagaggcaccactggccaattacttgatgataaccaatggattggtcggacaatgactttagatgaagcaatcttattgactatgtatgcctggataacagtacattttatttttatttttatttcatttatttattttttattattatactttgttttagggtacatgtgcacaacatgcaggtttgttacatatgtatacaagtgccatgttggtgtgcagcacccattaacttgtcatttacattagatatatctcctaatgctgtccctcccccctccccccaccccacgacaggccccggtgtgtgatgtttccaaccccgtgtccaagtgttctcattgttcaattcccacgtatgagtgagaacatgtggtgtttggttttgggtccttgtgatagtttgctcagaatgatggtttccagcttcatccatgtccctacaaaggacaagaactcatccttttttatggcttcatagtattccctgctgtatatgtgccacattttcttaatccagtctatcattgaacagtatgttttgcctttgtgaaaacacagcatatttttggtgttgttccaggtaaagtctatatcaatatttggataaagaactctttgtaagaaaaaacagcgtgagggtcagatggaaaaaggttgtgggtttttttttttttttggtcttttgaaaatattttacttctctcagctataactttctaagccgaataatacatcgcttgaaatgatagcaagattttctttcatttgaagttctgaataagtccattgacactttgctttgtggttcatgtgcttatagttggcccccatcatttttttaaacctatttttgatctgatgattttctaaatgtatcagacttctttcagagaattaccacttgggctagcaaccaagattaagctgtttttatgatactggattatcagaccattttaatctgggcagaaaggttagttctattaggagttagggtctaactggggccaagctcaggaattcaaacttaagaacacgccagtgggcattatattgtgagccattttttaatctcatgaatccttgtactttgttatagtatagcagtttggctcagtgagtagtttctggtgttttcagggcttgttcctttctgttccctagttctaaggagaagtaaaaaccaaagataatgggcatcattgagccagcacagatatactttagctacctgccacctgaaggagtcagaaataatctccttgactggaaccccatgtagccattatgttcctatctgtgaggctcacattcttgcccagtctgttgttaagacccgctaacaagcagcttcctccacgttgggtaaatccattactggagcaatcactctgtgtcaagcattctgatttcctgagttaataaaatacatgttccatttactcaatgaaaaaatactctggtaaaacccaggttacaattctgatttggtttggtatgctttttcaaaaaagaatgttttcaaatatttgataaaatgtaagcatgtagtgatattttaaatttacttatgttggtaatgaagctaatttaggcaattgtaatccatttcttaggaaatcagtctgttatgaaaccattttcgccatttagcacatatttgaaaaccatgtacagcacattgtatcaggcttcagggcttagaagtgaaaaagacagtttgagccctctccattggcagacaccagcttgcaaacaactgtgattcaaagaatgatatgtgtctgctcatgaaatgaattgaccatgtgagcctaggcaagccgcttgattttttcaggcctgttttgtcactgtgacacagagttgccctagagcaatgcattccaacttctaatgtgcctaggaatcagctgggctctgttttggtaggtgtagggtggggcctgagattacgcatacttaaccagctcttagaccatgccaaaagcactggtccatccaccacattaaaaaaaaaaattattaaaacagcttttttgagatataatgtgcatatcatacagttcacacatttaaggtgtatcgttcagtggttttcagtatattcacagttgtacacccatcactacagtctaattatagagcattttcatcactctcaaaggaaaacccttacctcttagcattcattctgtattttccctgcctctagcagccactaatctgcttgccactgaaatacatgtgcctattctggacatttcatataagtagaatcatacaatatgtagtcttttatgtctggcctctttcatttaatgtaatgtttttaggtacttcattcatgtatgtcattgttttttactgccaaataattttccattgtaaggatttatatcacatagttggtgaatttaatccatttacacttacagtgattactgataggaaaggacttctgttgttacttgttttctatttgtgttatctttttatgttcctcagtttctcctttgtgcccttctttgttttttttccacgcccctccaattgattttttttgatgtaccttttttattccctcaaattattttctgtgcatactgtttacttattttcttagtgattatatgtggattacaatgaacatcctaatcttataacaatctatttgaagtgatactaactttgcttcagtagcatacaaaatcgtacagcccacacctccctcatctttgttatttttgcaaatgacatctttatgcattctgtgcccattaatatagatttataagcattttatgcatttataagtttaattatataggaagcaaacacaggagtcacgaactcaacatacaataatactgacttttatgtttacctacatagttagcttcattggaattctttatgtcttcatatggctttgagttactttctactttcttatttcagcctaaagggctgtctcttagcatttcttatgagtcaggtctgactagtgatgaactctttttgcttttgtttatttaggattttaaaaatttctccttcatttttaaaagataatgttgccagatagaaaattattggttgacagttttttttttctgaatattataaatgtctgctctttttggcctctgtggtttctgattaggattattaatcttaatgaaaattctgttatgtgataagttgtttctgtggctgttttcaagattctgtctttatctttcaatggtttgattataatgtgtttaattgtggatatctttgagtttattatatttggatttcattgagctccttggttgtgtagatttatgtctttcatcaagttggggaagttttcagccattttatcttcagctattctttctgtcgccttctcttttttccttctgagattgtactggcatacctcattttatcatgcttcaaagataatgcatttaaaaaaatatattaatagatttgtggcaaccctgtgtcaggcaagtctgttggcaccatttttccaacagcatggtgcttactttgtatctctgtgtcacattttggtaattctcacagtatttcgaactttttcaatattatgtctattatggtgatctgtgatcagtgatctttgctgttactgttaaaattgttttggggcatcattaacgatgttcatgtaagactataaatgtaatgagtaaatgttgcgtgttttctactgctgctctgcccgactgctctttccttctccttgggctttcctgttctctgagaaacagcaatatggaaattaagccaattaataaccctacagtggcctcttaagtgttcaagtgaaaggaaaaattgcatgtctttcactttaagtcaaaagctagaaatgattaagcttactgaggaatgcatgtcaaaagctaagataggctgaaggctaggcctcttgcctcaaacaattagccaagttgtgaatgcaaagaaaaaattcttgaaattaaaagtgctattccagtgaacacacaaatgataagaagtaaaacattcttattgtggatatgaagaaagtttgaaaggtttcgataaaacataaaagcagccacaatatttccttaaaccaaacctaatccagagcaggaccctaactctcttcagttctgtgaaggccgagagaagtgaggaagctgccaaagaaaagtttgaagcttgcagagattggttcgtgaggtttaagaaaagaagccatctctgtaacatataagtgcaagatgaagcagcagatgttgatggagaagctgcagcaagttattcagaagatgtagctaagatcattgaggaaggtggttgtaccgaacattttcaatgtagatgaaacagctgtatcttctgaataactttctgtatactcgaatcagaaagttagcaatttatgtaagcatctaccacgggataaaattaatttcatatatcgttttcagtaatacgtaacataacacttggttggtttggctttgagtgttagtaagttaaatacatgaagattttaaattacatttttcttcatttgcataaacagtgaggtatgttaatttttgagaacagaagtaagaaattttatcatgatcaggcagctacaggtgaatattttggaagattgttttctggggagagaaatccatttctaatctgcattttaatgatttgcttttaattctagactcgagaggtgattgccttatcagtgtaccgtatgtcaaaccgttctttagcttaagaacttatttgtagctgccagttgttccatattaacctgaatttttaaaagtactttctgcctttcaggaaacctttgtgactggcatttgatttctttctctctagtgttttatgggaataataatcttgtgaattttccaatcatttttattgtgtacatgttaaatatttagactgtggattatatagtcgtcttgattcttatttatattctgatttttgaactgttttatagcatattcacacctccaccagactgcttgaagaagaatgaaagtgaaaatcagttttcttgttcattaacaggtcttctgagggtttaatacttaaacttctggctggctgtcatggggctgcctgattctttgatttcactttatcctacctttccctctctcatgaatgcaatgaataatgactctaatatctttcttctcagacgaattaaattgtgactttattaaactgtaataggcttgcctaatttattaaattccaccttttctttccctctactccctcaaaactacttcctaggaaaactcttgcaatcactattaagagaaaataacttgtgacttagaaagtattcgtattcaacagatagttgaaatctttgcagattgggacattgtaagatttagacaaatttcatgatcatttgagttttagttgcaaatttataatgatataggaaaaaattagggtcctgagctcctttttcttccacatcagcttgtctgttccaccagacaagggctctcttaagtgattgttgttctgaggctgaaaccaaagagctaggttgctgacagagccatgaaatcatgcttttctctttttaaaaacaacagattaaaaaaaaaaattccttctctgttagtcacttcatgttagtatttatccatgtttaagatttacatttaaagcaaaagtcttcaaagggaaaacatgagttttacttctcttacagaaggaattctgtaaatttctacaagtatttttaaatattagtgggtctctttcctaattaagatcttggaaagttacgtgcaactctgactgttgtaacaagcattaaatatgagcttgctaaataaaatgaaccttatataaatttacttgtaattcagataatacataattttttacatatctttgctttatgtgttatactgtctttttctataagtggttacaaaattggggaggagaaataatttgcagattgatcctctaaataattaagaggaatctggagttaaagtctttcaacactggaattttatctgcatagtgttgtacctctataacgttggatgagttacttaacctttcagtgcctgtaaaacagataataatagtaattacttgcctcataggagttgttagtaggattaaatgtgataatttagcatagatatgtagcatagtgcctagcagatggtaagcaatgaaatgtcagctgatttttagtattggcattatctttgaagaagggcccattttaagatttgtttctcttaccttgctaataaatgtgttagtgtgaaaagttaaatagttccaaggttaacgtggaaataaaagtcaaataaatatgtttctttaataaagaaaaattcacttgcctttgaacatgacaggtgttttttaaatcttcagttgcgttaaggtaatgaactcagatttattaactggtttgtgtttgtatacacaattaatgttaaatgcaaaatcctttaaagtctaaatgactattgatctgtattttaaagaataatttttgtaagcttattttgatactaaaatgcattccactgtcatattatctaaacttctgggaaatgctagcacaattttgtctctttggagttatatttattttcatgatgaatattttaaaacttaacaacctattgtaaactgttatttttgcagttatgtttgcctaacacacaaacacaccaagcatgttcctgtccccaaggtctttgtactttttgttgcctttacatgaaatccactctccctaattatggcccagccttggagctctcaggtctgtcagggctctgcagaggattacctggttttggggaatgttttcttctaaaatgtggctctatctttattatgtttgttgttttccctctacctggcattatgttatatactcgtgcttgtttaaaatcactttcccattaatatccaagggtagaaactttgtttcattcactgctgattatcctactgtgtatgataaagcacagggcctggcacattgtaagcagtaataaatatttgttaagtgaatgtaggaatgttgttgatcaaattaaaacagttttgttgaggagatgaagattctgtgaaccaatttttaataatcattttacgtgaggttatttgaggtttttatgctcagaagtgaaccatttgaaaagatgtaatttataacttttcaccccccaccaaaagaaaagaaaaagaagatttaaatttagaatacttggtacatagtgtgaactgagagttaagaaaggcctgattgagaatactgactcagcctaaaatatcagtgatactgtgcagtaatttatcctgttttcttaccaggagcttgctcagtgcctaacactgatagtcagtaaatgtttgttgggtgaatgaatgagcctgtaaaatcagtaaagtcatgaactaattcctagtttcttacagagtatcctaaggacccttgaataaatgcttctggaataaaatggatggaaatttgcaacagaatcacctggagggcttgtaaatactgtctgttaggtttactttttccaccctgtgtttgaggtggagcaaaggactcttaacttctaacaagttctgaggtagtggatgtgatgctgtcctcctttcagaagctttgctgtatatctgtattcctgttgaggtgattcatgttaatgtattgaaggttttgagagcactgcagtagaggaagctgtttaactcttaactatttctgacttacttggccctagtcctctccctcacttgttcgtatgtatgtatgtatgtatgtatgtatgtatgtatatatgtatgtatgtgtgtatgtatctatactcataaaattgttttttttttcttttttctgtatgcttgggtaggtaaatactgtgtcaggagtgaagccttcaaaactgagccctgttgcagagttggaagatattatgatagttatgatctgcatgaaagcatttgtatacatttttgagtcttgcaaattgtaatttggaataaacggcatgtataacaataatgattttatgaaaattgattccaaaatgatgaaatgatttctaagtaacatttttcccctttattcatttatcactttcagtcatcgtcgatggttttaatctgccaagccatatttccagaactttaggtacttgacaaaattaggaaataatattttgtcatgaaaagttgagttttctctagatgaagattgagtcttagctagtgtcaaatttttcctagttgtattttcaattttaggctaatctagtctcatggtacagcattctactttgcatgtcttagattttgttgacttaattgtattttaaaatatgattgtactgattctggtcttttagagtgatggttttgatacaagatgtggctaatcaatggaaaagggatgtttgaggaagaagtgatgatggttatgaactctagagatgttaaatgtagcacaaaatttgaatctgggattctttatgttccctaaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaaggtaaatttttttcctgatttgaaaaaagcagttcctttgtttgaaactattttctcaattattttttgctgattttatgtggaatttttcaaatacatgacaaaggataaaattgaacttaacccattacatctatttgtgaaactggggagaatctgtgtccccaaagtataatatttccgtagttctgctatttcccagataatggataatcctcaatacctgtttctttttaaagagagaaacagtgttttcatggatgtgtttattattaaataaattttaatttagttaatatgatactggctataataatctgactatatgttgttcacctgttgatcgatttcaaatgcttcctttcctgaattctgatactccaccagtgcaaaagacaccattcactaggggtaaaaagaaactatattaaatgtctcctattgagtataatacatgtttgtatttcagaaatactaatataggcaaaaaataggcctcagaattgagtctgctatacgtttttttttgagacggagtctcactttgtcatccaggctggagtgcagtggcgtgatcttggctcactacaaccttcaccttccaggttcaagtgattctcctgcctcagcctcctgtgtagtagggattacaggcatgtcccaccatgcctggctaattttttgtatttttagtagagatggcatttcaccatgtgggccaggctgatctcgaactcctgacctcaagtgatccacccgcctcggccacccaaagtactggcattataggcgtgagccacagcacccggccagcaatacgtttaatgtaatgtttgtttccagagtttaaatcataaggggcaaatgctaatgacaggaacataaaaaagtaaatttgctgaggaaatcttaggagtgtgtatgttagacatcttcactgtaggtaagactttgaaagttgttggatgtgtgtgtgtatgtgttttggtttacatttcatctggatgtaaatgtattttcctgtttttccccttagggtgttgtcattggaacaggagaaaattctgaatttggggaggtttttaaaatgatgcaagcagaagaggtgagtacttaatatgttaatgatgtatttgttccaaatctgaaattcttcattgtaagtagagaatgttggattattttatatactattgagagcagtattttattcagaatggaaatcagttgtctctgtttagaaacataattggaaagcctgtaattgaaaaggtctaaattgatgttgttagtattctaaaggattttgagctttactcattgtttatagcagaaaaaggcttatagccacttatttgtagatcttattattttcagaaattagtgttgtggtaattttaaggattagtaattagtatatttgtaccttggaatatgtcttctatcaaattttttcaacttcacataattccaagtaagggtggcagggaaaagattgccaagtaaaataacctacaagatattctcggctaaaagtattaaagatgagttcattttaaatactttcttattataaaaagaagcttcattctgcaaatgtcgtgttctccccaaatcctctggatttctcaggtaacctgccaaaactccagtatgcgatgcaaagtgggaactcattccaagaggcgtggcagtgaagggatgaatagagaagagggttagcagttgagggaggattaaaagacctgggttactagcatgtttgtggataccaaaagggaaaaattggaaaagcaagtgagagagcagctgatggtaatgaagtcctgcagtggttggtaggagggagaacagatttttcctcaaaaggaagcatagagagaacggaccttttcaaataataaacaggtttttaaaaatagagaatttctgttcctcactgtgtgaccttgggcattgtgtaaaatctaagtctcagttttctcagtgaaggtgattatttaccttatgggagagttgtatggttaacttaggaattgctttgtcaagcacttagcaagcccctggcacttgataaagcttagtaaatatagctaattgtggtgacactcttcttcaatttatcaaggcaccaaaaacccctctgcagaagagcatggacctcttaggaaaacaactttccttttactcctttggtataataggtaagagaagagtgagtatgtatatatttttatttgagttttgttttttgaatgtgaagggtggtggtattctagttttatttattggcttttcttttttttattaagtttaatactttttaaaattataagactactagtagccattgttcatttcaacaaagaaaaaatagaactctgattcttgtaatcagaaaatatttcttgaaacattttagtatttgtctttctagtcttcaacaagaatgtaatacgatagttttatggactgcttttctatttttatttcacatatcctgtcataaaactcttgtcattaaattgatggtcacataaaacaaacataaaggttgtatagttttctattttgtgggaaaacatataagaagacctcttctagacatttaggattttttgagggtttttttttggtcatataaatacttctttagtgtggtgtcttctggtaaatacctctcttttttaaggaaaaattcttagaaataaaattatttagtcaaaggggatccatgtaacttttaaatttttggccagctttaagtattgtcattaacttcaactgtaaataaaagagttctcattatttgatttcacagttcattattagggaaaccgaatgctttgtcatgtgtgggttgatcatttttatttcattttatgacctgccaacgatttcttttgtcccttttcttgtgtcttgagtcttagattgataaaagctttttatatgactagattatcaatctttttgttgtataagtttttttttcccgtttaagttgcctttgaggcatgtggaataaacttggtaagaggacaatatatgtaattaaccatttatgcctagtgttccattattggaatgctaagcatgtgggacttatttatatcctactgctcaaggtcattgccaaggtctggttgcaaaaattcaaaaaattgcaacctcagacacaaatgggttaaaacatccccttttccttgagattctgttatcaccctcctattgataatctctgcaattaagttggttttgttctgttcctaaagattttcccaacctcatgtttataagaacatttattaaaacattgttgtatagttttttatttttgacattttactattttatttaaaatttattttagtacatggcttaaggcagagttttaacttttttactcaagttaattatcccattaattctgtaatccagtctttattcattggattgaagtcacgtttttatcacacattaagcacttgcattaattttggagtcttttctcctttaattttcttaccgtgttaattattccagctagtttagtatttcaaagtcagtaatacaatttttttatttgagatggagtctcattcttgttgctcaggctgaagtgcaatggcgcaatcccggctgactgtaacctccacctcctggggttcaagtgatttccctgcctcagcctcccgagtagctgggattacaggtgtgcaccaccacacctggctaatttttttattgtatttttaatagggacgggattttaccacattggccaggctggtctcaaactcctgaactcatgtgattgcccacctcagcctcccaaagtgcagggattacaggactaatgcaattttaaagcaatatttctgttaatacaatattagttgaaataactttgtaaatagtaattctgtttatccatctatcttcattgtaaacataaagtagaaggtaggaagttatcttagttatttttgttttactggtgtgtatgccctcataacttcttccgtttgattattgctcattttctagaaattttatagtgaatttgatagatcgaatgacattctagccaattaaatctttgtagtttctattagcactataccataaaccatttcaaatttagtaataaatatgtttcaactttacgatctctggttatatgttagtatattacattggacataatttttcttgccaaggtcaagagctagatcaggggtcagcaattgtttttttttgttttttgtaaagaactagatagtaaatattttagtccatatggtctctgttggaaatactttactttgccattagcatgaaagcaatcatagaaaatatgtaaataaatgagtgtggctatgttccaacaaatttcatttacctaagcagacaggagacccacagattatagtttgctgacccctggtataatcctttggacataatttctttcatcatgatagtatttgggataggatcttagaaggttgctatttggataattattctttagttatataaagatgaaaaaaaaaacttgtcttaaatgttcatattgatttgcagtcttgagatagcttattttatcaaacctctcgtgaatctgtttgctttttcctcacaaacctgcttgtgcgcccctttccccctattcttttcaaagataaaaggttaaagcaaggagtattggtttaattgatttttaaatttttgaaatgccataaaagtagtgatttttagatgttaatgcagttgtaggtgcttaacgtaaggcacatcactttttgagccaagtcgtaagtgtccctttgtgtgtagtatggatttgctgagaagtgtctggatattgtgttatggaaaataaagttttagggtttaattttgcatatttgatattaaatagaagacctatatgtttgctgccaccttctttttttcattgtatgaacatactggtaatttttaaaaaaataataaaatattactgctttaagggatggtaggagcagtgtcaaccaaaagtaaaactgtgtgtgtgtgtgcatgtgtggtgtgtgtgtgcacacatgtacgtatgtgagtatgcacagcattcacattaagcagtgttaactttaacctcccctgtttaatggatttttataaaatcttctaattgtgatctgatatgctttcccttttttgtcaagggacgttttagattccttcagcttgttctgttccttctaggtgattgtatgtaaaagggaaaaataactatttaattatctttcaggaatcatcatgttggttggctggttactgggaaaagatatcctggaaatgtttactattagtgtaaggtaagtctcaatactttataattggagtctcttttgcctcttttatttctctaatggacatagcttacgttttattatggagatcagtattacatggagcccataagagtataacatcgctacataaatagttcagaagtcatatattaaaattatccttagaaaaatgaaaatgtatgtatatggtaatgaagaaaacccatactagatgtctggaattactaatgcattattgcctttttatatataaatatacaattaaggattgtcaaattgaaaactagcaacatgaaagagaaagttcacaatatagaaattgaataatcaatttcagaggaaaacgaaacattgaagaaatgatgacaaatttaaaaaccaagtgtttgtattttcagagacttgtgaagaaactgcatccatgagataaattgttgtagaaaaggatcagagaacaaaaagagtttttagaaattaagattatgattgttgaaattaaaaattcaattgtaggggtgtaatataaattcaaagaggtctccccccaaaaagagtaaaaagtcttagaatgagataaaatgatgaagaggaataatttcaggaaataccacttgtaactaattggagtttcaaaaattacataagatatgacacacaagtattttctcaagctaaggcaaaaagtaagtctttatagattgaaaggattcactaaataccaagcagaatggaaaaaacttcaaccttgatacataattgtgaaactaaagaagaaaagtcaggtcatctacaaaggaagggtaactacgctggcatcagacttctcattagcaactgcagtttctaccacaggatctttttgggttcttctaaacattccaactcacaagactttcacagaccacatctgatacctgtgccctgaacacagcagggtaacttcaggcagccttctcctgagagtccgcagcagtccatgtagcaattcactcaagtacaaggagataaggtcaaccttgtgagtgtgggatctaccttgggttaaaatatctcgtgttctatgagagacgtattttgaaacatgcatttccagatgcctgcaaaggacatgtctagttacaagttactacacttgagaaactcaaagctatgatttcctataagataattataactttcctagtccagagagattttattagtcaggggatcccttaatcatagcagtgttatctagcagcatacttgacatattattcttaccaggtcactaggtgaacagaactagagttaatcaaatccagaaggggaagattattttattaactgttcatccacagcaacatcagattgcattagaataagtggagccgtggtaacaaattaggggggcaattgatcataaatctgtaaattgggcctagccaaaggattggtccaattagtgacaaataggtaggcaagtactcagaacattcatttcctacccatccttatatgaattccagcaaaacaagggtgaaagaaaggaagatgataatagacataagaaagggcaagaacttacttaggcatctaagaaaaagaaatcctggtagacctctgttgtaggcatatgaaatatttcaaatattagaacaaaagtcaatgtctttcaaaaagaaaagtcaaatagattacaaggaatcagaatgaataagaagtaaaaagatatttgtgatatagtgaaagaatgtgtttttttttttctcaagggagggggtgaaaatgcaatttgaaactcttggtttaaatttgtgtttaaaaacgccatgggttaaatataaaatacatttaaaatggggaataagtttgagatattaaacattgacatattatccattggatcatttttagtttttgaggatttgggtttttttttttttgagttctgtttgtacagattgacatatcataacttctgttctttcttcaaggtcttccaaaggacaagatacttaaaaattttcaaatagaataaaactcattctattttgcaattctgttttgcagtatggatccattggaatcttttataagtataagctacattatgggacctttaatgatcctatttttcctctttcttgaagtattttacaatttcttcaccctaggaattattttaacaattatttgcaagagtgctgaagatgactaaaacaataagaaagcagaaaaatgatggaatcattgagaaggttgatgtaataataaagtaaataatcactattctcttattctttagttttcttattgtgttgcctaaagtattgcatcatttaagaaggtgtaaaagaagtctaaaggcacaatctttaggtttgtttgttacagctttcattgaacaaaaatgagaattcagaatttttcactttctactataatggcaaagagaataattgacagagaagacttttcacaattattagacaaatcagaagatcagtgcaaagagccaaatagaagcactgtaggccgtaatgatgtgggtgaaattaataatataagtgaaatctcaagactgagtctttggatgatgatactctagatcttctcaaacaccttaattttgatgagtgagcaatctgtttttaaggacaaaaaagaaacaggtattctcttccagttaatcattctgcagcaaggactctatcatgtagtagttttcagcaagaatctggaccatctcttttagctaaacgaatgcatgaccctatttcattcatcttttatgatgcttgtttatcagcattgacttcatactgcttttaagtggagaaatgctgaaggctggtatgaatataaaagtgattaaaaggaaatagattatgcagaagtagaaaaattcattggattcatcattgtaattggtgtttataaatctaaaattgaaaatgttttgcagtcatggaccaaagaagataactgttctcttttcaacacaattgggagccatcagtggttttagaagtgttgcaatttgacagaacaaatgcaagaaagaagaactagattaataagctagcgcctgttagaaatattttttgaaatctgaaatcaatatttataagataaatatgttccaagttcaccaaaagcagtagatgagcagttagttgcatccaaaagatgttacccatttcaggtatagatgccttcaagtccaggaatagttttgggttatcattaaaatgaaaatttagagtgaagtttttttacaatttaattattcctctgcaaagttttgctaagatgacttaaatataaaagattgaaaagattcgttgtatctagattgtaagtgataatgcctgtttttccttaatggaagcattaaaaaaaaaaaaaaaaagaaaagaaaaaagaaaaaaaaggattccatttgaactaggaacattctctttgagtagcccaaaggagaaaaggaagtattaatgataatacatatttcttgactcttcagtgtgtattgtttagccaataatgttgttgcttatgtgctttcaactttaaaatcaaccagtaaataaagcatgaaaaagtcaattacggttatagaaaaggatgctaatgtactagattatgcaaagaaaaagttggtaatggaaattaggaagtagaagcagcagagggaacagtggtagaatgaagggttaaattgcttatgtccttatttctagcagatcaagaaatagtatttggaatggcacaaagaaagacttgttattttttaattataaaaggcgagtgaaataattctttaaactgtgataaaatacgcatattataaaatttacagttttaaagagttaatttggtggagttaagtatggtcgcaatgttttacaactgttaaccgctatctagattcagaaccttttcatcatgccagaagaaaaccctgtacacattaagcagtcactccccagttttcctcttcccctagtccctggcaaccactcactaatctgctatctctatggatttgcctattctagatatttcatataaatgaaatgatataatatgggaccttttgtatctgtcttttttcacttagcataatgttttcaaggtttattcatgttgtagcatgtgttagtacttcattcctttttgtggctaaagtaatactccattgcatggatgtcacaattttacatttatcagttgatgaatatttggcctgtttccatcttttggctatcgtgaatagtgttgccgtgaacattcatgtatgagtttttgtttgaacatttgtagttatctgtattttatagatgaggacagtaaactacagagctagattagtaagtagcccaggatcacacaagtaagagatggtgaagccagggatacaaatccaggcaatttgatgtcagaacctacattttttaaccactgtgcttaacctggcagctactaggtatccagtaaatgttaactttctcttccttttgagaagtttattttttaggtattgactatattaattttgcgttttattaagctttaagtaacatccaatttaaattttgctgtgagtgctgtttaacctacattttaatactttgtatatgttggttatagtttggctgtagcagcaattcctgaaggtctccccattgtggtcacagtgacgctagctcttggtgttatgagaatggtgaagaaaagggccattgtgaaaaagctgcctattgttgaaactctgggtaagtctgtgttaagagcattcttatgcaatgatgcgtaagtttatgtcaatagtgaatcatctcagagttttacagtttttatcttagagatttgcataatgatgtttggcttatggcaaaattggatatggttttaacaaccaaaaaaggcaattaaaaattcctatcccttaggtgaggggacttgaagagaaatctttctacatcatgttctaatgcacaaatcatgttaagaaaatccatacaacaactgaaatcttggagtaaaattaatagaatttttttcttgtgacatgtcaaagaagataatgtattattacagatcccaaatgtcatacttgagttgaatttgcctgtaagaacagtaaatttacagtagttatattgctgtaacaaaactttatgtgcaatatgctttgaaactccaaaaatgtactgaatttaatttctagtttgtattttaatatcttctccatatatgagaagctgaaataccttgaaaaatcctgattgaagaaattatacgggtttatatttagaaactctccaaactttctagaaaagatgttatataagatcattacataaagctaatgtgaagtagctttgtagaaactaactgtatataaataagaacatgtcatcatctaatttttatttttaatttcagaaactgtaccttatgctgaaacaagcataatgagagaagttaatctaaaattaacaatgagtttgatttctataaaattcagagaagtaggacaggattctagtctttgatttgttttttaagtgaacctatatttctccttgattcttttggtgacttgtaatgatttaattctttaggctgctgtaatgtgatttgttcagataaaactggaacactgacgaagaatgaaatgactgttactcacatatttacttcagatggtctgcatgctgaggtactctataggtttttaaaaacaaacaaaaacagtatccctttaagaaacttggtgtttaacattcctaacagttccagtgtcttaccttcaaaagggctgtaaattagtagtggagttattttctctctctgtgattttaccaagtctttgtctcattccacttgtacacttgttcaatccaaaaactttgattcctccttgacatctctctttcagtcaccccttcatctatccataatcaaatcctaccaattttgacttcctaaagaattttcccagccatctactttatagccagcttctttaagttaccgccatttctcacctgccattctgataaagctttttgactggtctttttccattcttgatgccctcactccataagcagtttgagggatctttttagaaccaaattttaagcatgtcactccataaattaaggtactccaatggttttccattgtgatcaggatcctgaactgtggcgtctcaaagccgtacatgttctgtcccttattttctcctctacccttatatgctaccctttgctttctgtgcaccaagtatactggctttatagttctttcgatgtgacacaattattcctactttaagaactttgctgcctttgtcactgtttaggatagtctaatgcctcttcatcctttgcaccttaattccaacccacttcttcagaacacccagaagtggccctatgttatatgttgtcttagcatttcatacctcttagtccttatcttaggtaaaattttctgtcccttttccccattataagagagcaggagctatattgcctagcacacagcctgcttcatagtaataaatactcgataaatgaatgaatgaatgaatcactttattttaacaattatatattgatacattgtctcttaagtgcacatcactgtgcagtagttcttcctgaaggtgcttatggacaggtctaatcctactcagtctatgcaggatttctgactggaatgctcttaacactacttatgttgggtacagtgatttaaaatgtatttatagctaattcattgagaaaaataagcagtaggcaaattgacagaagttgtacttgggtttatttacgtccattttacataggttttgaaaagagactcttgatatttacggtgttagatctggtcaaagatcccccatgctgtgttggtgaatgtgccctttctggatgattcagaagggtcattgggattacatgtgcttatatgatccaggtatggaaggtagaatattagtttttcttttgttttaaggtcatgctatatgtaatgcattaactatttgttaattgttttatctctcaattaatgtcattaaacattttttatttatttttatttttaatagagatggatcttgctttgttgcccaggctggtcttgaactcctgggctaaagtgattctcctgtcccagcctcccaagtgttaggattacagatgtgagccaccacacctggccactaaattgtatgatttttattgtgaaatttcttttcgtttggcttggtttgttctagacatatgatataaatacctggtttgtctctacctctgatttttaaaattggtgtgtaatatgctgtgttaaagtgatttgtaagtgctagcatatatctcaatgtctccaggcctgcatgtttgcaaaaagaatactgcttttgtctaagtcacagctttgtgttgtatgttacatatggtaatgcatttgagttctttgcaaactgtagtatgctatataagtgtaatgtcatataagtttaagcttacttatgtatattttcatagcttattcttttaacagtatattgtaattagaaaacaatgtctttttagattaataattgtgatgagaattagaatctatatttctttactaaatgtcctttttaaagacaaattttaatgcttttctaggtgaacacttttaacagtgtcattataaataaaatgaacagaactcattatagtttttgggttttataggtcttgtcaccaccaagtgtttgtagtgtttgtattattgatcccactttgtgatctttaggttactggagttggctataatcaatttggggaagtgattgttgatggtgatgttgttcatggattctataacccagctgttagcagaattgttgaggtaaatatttttttttccaagatggtgactttcttcataataacttaagacacagtgataggttcatagtttatgtgtatttttcttaggcgggctgtgtgtgcaatgatgctgtaattagaaacaatactctaatggggaagccaacagaaggggccttaattgctcttgcaatgaaggtacgtacctaaatttctcttctttgacatttgagacactgccctcacaacagaatgcagtgtcatcaatttcagtattactggtttttaggtattgagtgaaaaaaactcatactatttcattgtttttactatcttttaggtatcagttttattcctataaatgtaaagtatagacttttttcagtataactttattgttcacatgcaagttacaaactaatgagcagtcattgatttcttgtgaagaaatgttcctgtcttccacaatgttgagatctacatgtgaaatactttataaatgtgtgtaattgctgataaatactaacttttgaatgaataaaaggcaacattctttagtatttctatgtaaagataataacacagtcatgagaaaatagctttgttttcccagtctttcctttctctcctttgttaatttctcaaaatgattgtgaagttataatttgttttggggagaagaagtctcagttaacttttcatctgtcccaatccgtctccttatcccctaagtcctatatttgattcagtgagaaacctagtaagtccagcctgtcactcataacaaaaataactattcctacctttaagagtattcagagaaaattttgatacttgtataaagcaagaggcttctaaatgaggttgcttgaaatgagagacagtacagaattacaggttattataacatatttaatgaaataaaattgatagttttagaatatatagtttccttggcagaaaagcacatttctgtatcatttggtctccttacaactaaaacagcatagtactcaaaacatgaatccgttatcaagtatttcctgtgttatgcttataaagatattagtttctttgagggataaagaatatgaaactatctttttatgggcagagacctcacattttaggtagggaatttatattgacattcttgagacaaaaggcagtccaagacagcagacactgaaatcttaaacactgagtcacatataagataagaacaatgcaaattcagagctgggatatgagggctttgaaggataggaagggtttagatgagataagctagggaatgaactaaagtagaagtagagaggaataaaagagcatagagttggttgtggctaatgagttggccaaactggatgaaatgaaacgtatttgcacgaccaggaggatttttatagacgctgtatgtggtgggtttctggagaacctttaaggccaagaagagcctgaacatgtttcagtagaaagtagaaagcaatacatggtagaattttgagtagtttaaacatttttgatatttggaagatattttttgatatttttgatatttagatatttgatattgatgcaaaggctattaggagggaaaacaacaacatgactggtagtattcaggatataaagtggtagagggtaagggactaggatgataacaggtgagccatttgagtccctaagaagtgagagatttaatctaaaacttctattgatcataaaaatacatgctcagaattggttgggtacttttatttatttatatcctgcttcctttcagaatttgagtgggtagagggattaatacagtgtgtatgggaggtttagtcagcgtacaatccagaaaacctgccttagactatatctacatacctgggctttcatgttgaaaatgtatgctgatgtgtagggaagtacagtatatatagatggagcatttactatttcactattaactgaaaaataatccagccaacctagttacaagtggtgacccttgttctttgttaaaggaaaaaataatcacatataggtgagaattaactttctctttgtgccatatagatgggtcttgatggacttcaacaagactacatcagaaaagctgaatacccttttagctctgagcaaaagtggatggctgttaagtgtgtacaccgaacacagcaggtatccatctgtttaaagaatacttatttcctgtttagcttagatgactattttttcatttactgtccacctttgggtttagtcattgtacataataaagacttgttgctttaaagtacatgtaattaatagtacactcatctcttaattgtttgtgttctctttgatagtctttccttatagaatccatgcatagatatattcatggagttgctgctgtgtgagcaaacagcttaaatgagttgtagcctagtctcagtctcctgaagcttgtgacatcagattttttcagaattttttctcttcttcatgacagttccttataaggtctttgcagactgtgtttcaatctgtgttctttcactgaaggaatgtcttatctttagaacaaatgaagccaccttactttttgaaaagtagtttgcaaatgtatgtcattcatgttgattactccagcttacaagctgacaaaatgacataccgatattttaagccgccaccttgttcctgggtgcttgagaaatttttccagttagtgtaataagagttctgaattatctacagtgtataattatatcactcatagttgctattaccagcttgatgatgaaacttaactttaaaaaatattgaagcttgggctggatgcggtagctcacgcctgtaatcccagcactttgggaggccaaggcgggtggatcacctgaggtcaggagtttgagaccagcctgaccaatatggtgaaaccctgtctgtactaaaaatacaaaaattagccaggtgtggtggtgtgtgcctgtagtcccagctactcaggaggctgagacaggggaattgtttgaacctgggaggcggaggttgcagtgaggctgagacaggggaattgtttgaacctgggaggcggaggttgcagtgagccgagatcaccccagtgcactccagcctgggcaacagcctgtctaaaaaaaaaattacacacacacacacacacacacacacacacacacacaccctcaaacacacctttttcttcttttgcctaggctgagtgcagtggcgtgacctcgggtcactgcaacctcaacctcccctggcacaagtgatcttcccacttcagcttcccaagtagctgggactgtaagcacgtgccaccatacctggctaattttgctaattttttgtagagatgggatctcattgtgtttcctaggctggtcttgaacccctggactcacatgatcctccaccttggcctcccagagtgctgggattgcaggcgtgagccaccatgcctggacttatttgttatttttatagttcctttgacaggaatgactagttggttatatgtttttacctatgagcaaacacatgatttttgcatgtgatacctatgattacgtctctatagaaaacaggaatgaagggatctcccttcattcatataagtggaaacatacagtttttaaaagaaaggccaggttggttaacactgaactttgaattgaagtcttccaggaactatgttcatgagggccaaaaaaaagatttccgtctattctttaaaggaacttttacaagcttaggtgaaagaagacaattggaaataaaactatgaaaatacaatacctttcactttaaacgttttaatgtaaagctttcagaaattgcattaaacttaggcgattttcagctgatgtcccttaaccacatagttatatggcaagcatatgcatatgactttttttgataggtctatttcattacattttgtaaaccatcacacggtacctcaagatagtgtggctcatgtaatgtttaataattttacttttcaggaacttttaatgtaatctaccaaagttttacattggaagattaaatcttcttagttgtgggagtgggggacagaaagtggcaggatatgtttggaaacatttgattattcttcacacttgctgacctgaagagttcctcttgcaagtgaaaaccaaccagtgaaatgaacaaacaaaacccaacccacagatgtgactcaggatctagaagaagtcatcctgacacagatagggaaacttaacattttaaaagtaacttcagtggctcagatagtttgcttttaaaggactttcacttgaacatgacaatatatatttatctctactatctccctggaacccaccaaaattactaacaaggaataaaagatataaactcagaaagtatagggaagattcaaaggtgccaggtacctttgaaggcagggagtaaggcataaggctaaaaatagtagagaaatttgaaattctgaataaggaaccaatagaactcccccaagtacctttgctgcttctttaggccagacggttagccttcctttacccctgtggaacaccagaaatctggggataagagtagagggtaggattaagccttaagactgaaaacagaatgattaagaagatgtcattgtcctgaaggataaagccctagttcttaacaccatttgtctcttggaatacatgaaggctggcatctccctactgtcattccctaagtaagaagattcaagagttttagaaaagctgcctggtctcgtaaggcagtggtccccagcctttttggcaccagggactggtttcctggaactcttccacaggcaggggatggttttgcgatgacactggtccacctcagatcctcaggcattagattctcttaaggagtgcacaacctagatcccttgcatgtgtagttcacgatagggttcctgcttctatgagaatctcaggccctggctgacctgacaggagattgagctcaggcagtagtgctctcttgcctgcagcccacttcttctttgtggctgggttcctaacataccatggactgtactggtccactgcctgggagttggggagccctgtcataaggggcacctttgagctaagctctttgttcattggaagcacttacctactcctggacttcatctcatcaccctacagcaaggcttaccagttgatccttagctctgccagtgctcatggagcttctagtcttttagtttcttcactcttttttttttttttatatactttaagttttagggtacatgtgcacaatgtgccggttagttacatatgtatacatgtgccatgctggtgtgctgcacccattaactcatcatttagcattaggtatatctcctaatgctatccctccccctccccccaccccacaacagtccccagagtgttcttcctgtgtccatgtgttctcattgttcacttctcatctatgagtgagaacatgcggtgtttggttttttgtccttgcgatagtttactgagaatgatgatttccagtttcatccatgtccctacaaaggacatgaactcatcattttttatggctgcatagtattccatggtgtattaaatacaagtgaacagggagggattactagatacttggagaaaatctttagtatgaaagccaaagaccaaaccaacagagaaagggatcttagagaaaggtagtggcagatgctgaagaaaatttccaaaaaccataaaaaagacaaaataactttcaataaaatgtttattaaataaagtcaagaaatgtatcaaagtagaacagaaagtcaaagacatgtacagtataaaaggtaaaaatcaaaacaaatacagaagatccagtaattaccccatagtggtaataggaagggtaataggaataggtaataggaagaaagaacagaaaatgagaagattttatcaactaatgctggaaaattttccagaatgaaaagactttagcatctagaataaagtggcccaccaacagctcagcacaatatgtatgttaaagcagagtggggtgagggataaacacaagacccataattaagaaatttgaggacacttggagagggagaattcgaagagcttctagagagctttaagcaaaggggagatcatataaaagggcttaggaactaaagtatggtagtctgccacttagcccagcgggatacattccaagactgctagtggatgcctgaaaccatgaataatattgaaccttatatataccgtgtttttttcgatccggtaacatagatggctactaagtgattaatgggcagggagcatatacggtgtggatatgctggacaaagggatgatgtccttggcaggacagagtgggatttcatcaccatactcagaatgttgtataattggaaacttatgaattatttatttttggaattttctatttaatatttttggactgctgctaagtaacagaaactgcaggaaattaaaccctggataaggggacactactttaatttctttatacttttcaatgaaaacattgacactggaggctggaagataatagagcaaagccttcaaaatgagaggaaatttatccctagctaaacttacaaatgtgaggatagaagaaaaatgtgtcccacaccacgcaccctttcttagatattggtggataaaagaaaaaaaagaaaagggagacttaaaagacttaaaattcagtgaggatagaggtagagggttgttcctagataccagtggtacagcaggcctagaaatcagccaattagaaatggaaagaagactgaaggagggtggtctccagtaataatatagaggtaatagcttatctgcttctttgttgttgtgaaaaaataccatgagaagggttttatattacattgaagagtttaggaagaatgaatgataggtatacagaaaacaaattaaagaggtggttattaactttataaaagacaaaacttgaacaggaaaagaagtatcctatttgagctatcaatcaggataggccatgaaaacaacatcatgctctcctgctgcctccctgtccccaaatatctgctcattgtagttacttgggaatgcaggcagatggaagctccattttaatgtgagcacacactgtcacagcaggggtagaagaataggaaattgtgcactggcacctacatttccatttggaagtgacacaagtactcatgtttattggccaaagcaagtcatacctgaccgttgtggagtgaggacggcaatagggaaatacattcctgcctcccaggagaactgggatatttgtgaactgctatagtcattaccacacttggcttagcagcaaagagtcttgttgtaaacaaaatactggcagattttgctttagctatatcataaagatggggagggggggaatagatagtggaaatggggaaattaacatctgtcacaatagacagtgtataaaattgataactgatggagtagcagtataaacatgttaaaaacatgagggtaaatatcagagaaaacagctaagagagttaaaattattttgcttccatggagtaggactagtggtgagaagcgttgaacaggaaactgcagtatttcattataagcttttgaagattatttaccatgacaaaaaataaaagaaaaagtgcgataatacccataaatacagtgtgattgggagaattaaatggtgttttaggtagatagatatagacgtatatagtagctaatagagaacttgaaccattgtgagctgttatttctcttccatttcctgttatgttgcagtgagcctctttccacatttcagagtgccaaatttggggcttagtatagcattgccttttatgtgtgggatggtgggatagatgttttctatagaagatacagaaagctcccctataggaatatttaatcttcagagttcaggtggcagtcaaaaccttaggcttgagtaacttctctgggaattatgagaaatgaatgccacttaattttggactccaatggcaggtaagtacaagttgaaattaaacttgtgtttggtacattttcttcttaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagaggtaaggctatttcagcatagtcccctggggtggaaaggtagagccttcttttaattgcagatgaattcatgcttcacatttgagctgtccaactcacttccaggatttgtagaacccttgccagtattgaggtgttaagttttagttggttaattggccctcaaaagatggaaatttgagaatgtagcaaaatatgaatcactggttcttttagatctccagaggtctctgagtagctgatagaaattttattttaaacaagtttatcttatgagaagggaaatggatcgaggtaaaatggtgttactctctttttatcactttgttttaaagacaaaaatacttttctaaaaattgagtctgaagcctctaatatatcctttaaggtgattgctaacttgatctgttactgttcaccagggaggtaaagaagtccccagattctgcttacttatatgctgctgactgagcagtgatggggagagggtctgctggacacacacacattaggccacctctcctagggatgtcatgtgtaagactcgggggttggtggttggtgtcctaacctgattcttaccttctggatagtcatctggcttctgcagaatatatgtagttatgtagtctctcacagcagttggaagagttggcttccttaattttattattttaatgaaataggagtctaagcactacaatttctgggaggaagaaaaacaagttatgtgaaaaatgtttttatttgttgttcacttaagcaaaggctttttttgagttttaaacattttgatggatttatagggcttctgttcttaaaataaactaagtttggaaaggtactcttaccagcagagaacattgctcccagcctgctgccattgcccttctctctgaaccttctgtgctgctgaaccaagatcactcctcatacccctgcccccagagcctggtgcatctcatctgggatatgggctgtattgtgaccatcttaacacttcatcccctgtctccaaggaaatgggaggcagagactcatggctgagaagttattttgcaaatggatattttggatggaaaaaaatttaaaggaaaacaacttttccttccccctttccccttttaatgtaagaggctttgatgacaggttctagagtttctggggtttcatcccaaaggcctgaatctggaacatgccctggatccccccacctcagtcctcaagctttctggacccctgaagccaaggcagattctttctcccagcgtcatttctggggcaggaggaatctcttttctggtttacctgggccagacctaagaatagcaggatctctgaaaccacagggttttgatgtgtttttatcaagccaaatgtacaattgccaactgacactctggataattgagcacagggggtgccctcgtacattgtaccgtcactcccttctgaacagttggcagaccaaactgtttggaagctcagatactctggctcagggtaacacttttgttccccttacactcctcaactttccacctcagctagggaaagagaatgacagttaaggcttgacccaggattataatcgttagagcaagtgggagtttcagagacttaaggggcactgcagggaggccttgctgccacaaaattagggtttggattgataaagcctgtgtcggaaggggcagtggcagctccactgagacaatcctgggaagactgtggtgcagagggcctgttactcccctgattcacctgattctggggctttgaccctttctttttaaatttacttttgctaagttgcacttatttattttttaaaaagaccgttggtgaacaaaatgtgaacccatttctttcctcttttgaacttctgggatgtcatcacttccagtttgttggctttgtttccagctattaataaagcattaaaagagtggagaaaaaaaggtagggaagtgggcagagtcttgctactcttagcagcacatagcaagaggttttaaagtggcatggatttagaggacttaaagaggtcttgaaggtctaatatatgctccctctttttgttagtttctggaacaaagttttcctacctcattatattgactaattcttttcatatgaaggattgtggaggtttgtgtatgtgtgttttgtactgtaacattatgaagtagaccagagttggtagaggggaaagtttttgttgcacagagttttgggaaacattctgctcatttgtctcttgcttcatgtcttttcttctttatctacccttgtgctccacttccatcctccccctgagattaccgtaatgaagaacagaaagattttaaacctcagttgatatgtacttacattacatcttatgaaacaagtttcttaaaatactgtggttcttaattttgatattagagtatattttgttttatgtcaggggctctccacatgaaaaaagtttacctatccttgactcagagagtagcagcagattttcactggtgctaaagaagcaaataaatacaggatactaacctctagactagtgccacccctccattaggagtgcgcagagctgatctttccgtcttaggatttgctgacatatatttttgtcactgtccccttctgttaccatcagcctctatcctaacaccaggaactgtgaagtggctcattctctcaagggtgaaagcctttggagcccacatctacataaataattaggtatatgactcttactttggaaaaatagaattacttgcttttaaccttgattttttttgagcatatgtaatctttcataccttctgcttgacgaagaatggatagtttctttggtctctctggggcttttcagtctcctcttgacttatttatgtttagtttgtatgtgcatgttacaagttgttcagtctaatatctcagatgcaggcacatccctttggttaataaaagtagtttccggagttccataattctgagagcaagctaaatgatatttgggaaatgaaaagtactttgtactatatcttacatgcccaaggatgatgacagggaaataagtagaaataataatatgatggcgttatttacatactcttagagaaccaacgttacaaataagaaatgtctgttcatgttatggaaggagtaaaagaatccaaactattgttggtattaatggttttacaaccactttccaaattagctttaccttccaggagttttcatgtacaaagttgttacaggctgtgtataattaactaatacagccttctcttcagagtgtttaatttttctggagatcttggaaatggaaagatgaagatccgttagaagccaccttcaaaggtgtttgcctgtttaaaattgactttaaagcctaacaaacccatagtttctctaaataattaattctattttttaaagaggtagagttcctgttgaaagtagctgcatgtgattactatgtgaaaatattgttcattttctgtctcttgcctactctgcccttcagttctttagtttgattctttttaattaaaacagcttaaagggaccccttatccagaaccattaaactataatgttttggtctgtaatcattttgattttacaaatgacattatagtcttaagtgatttatttaagaagtgttactgtctccaatttctatcaactaaattctgatgttttcatgactcacttttttttgttgttgtttggattttattatttcctaagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcggtataactagactgctttcttttgttttcgatagtttttcttaaaatactgtggtgcataattttgtgaactattagttatgaatatgtttatgtaatattgagattatgcaattgaaatcgactcatggttttgctcatggtctatataaagttggcaaaactgattatagtttaaaaagtaataactttgacatgcataactaaatcatgaaatcacatgcattttattcacagaagggtaattatttttaattcatgatcactgtgatgacagagtaaaagcactagatcatgattgtcaaaggaaacatgaaacttagtttttcctttcaacttaagtataattttcaaagcagacttgtgcataatttggcagaaaatagcttgttatatgtatttgtttttcatcatgtatacctatatttgaatgctatttaagattaccgtaagaagtagaataagagcgaagaagagaatgaaagttaatttcccagagcctctaaactgtaattcatactgataaatttaacagttggctaaactccattaattcttatttggagaggggctagtccaggagtttcaaactatatattgtctaagaacaggtcactaggaacattatattattggaagaataacttttcgatgtttattttcatttatgtataactacatgattaccacagatccaccaccattttgtctggcttcggacactgtacttaaaatgcactctgatcttcgttacatttcagctgctgagcagaacctgattggcctagtttcgattcttaggtatgctagcttaaatagtcaaaattctttttttttttttttcctgtagagacagggtcttgctatattgcccaggctggtcttgaactcctgggctcaagtgatcctgtagccccaaagtgcagagattacaagcctgagccaccgtggccagccttgaaaattctttattcttaaatttaaacaaaaatgaaagtcaaacataaaactccagacttaatactgattcagataggtttgtattactggtaggtaacaaaagagaacagataacaaatcatactaaatgagcattacgttgactagcctgtcaagcaaaaacaatttggtttattacattttctctctcatttgctttagccagtcgtctgggattgtattccaaaacttcccagtcagtctcaggagaagaaatagatgcaatggatgttcagcagctttcacaaatagtaccaaaggtaggcctaaactaaagccttttggactgaaaggccttattctaagtgttaccatttctactactatcttaatgaaactgtttaattgtgaacatcagggatttaaataaccaccagatttgttggttcaaatcctgaaatgaagtcttatcattgaattagtcttatcattgattatttatgatatgatgtttatgaatatcagtgcaaaattattaattttagcaagaaccagatttcctctgagaaaagtactgtggaaattaatagtgcttgtatttatgaattagaggatggagagagatcattgatttatacttcttactcttttgttcaattttaattttagcatgagtatgtgattttttttaggtacaatttacatatagtaaaattcgcccattttagtgtatagttctgaacattgagtgatgcatgcagtcttgtgaccaccaccacaatcaagatatagaacagttccatcatccccccagattatcttaggcctttttgtggtaccttctccccctacttccaggacttggcagccactaattctttttttgtctctgccactttaccttttctagaatgcactaaaaattgaatcataccatatgaatgaggcttttgaatctgcttctttcacttagcataatgcatttgacatttatctatgttggttgtgtgtattagtagtttgttgttgttttttaaagtaatattctattataggtgtaccttacctattcaccagttaaaggacatttagattgtttccactttttgatgattatgaataaagatgctgtcaacatttgtgtacaggcttttgcagtttgtacacaaatttattttgcatgaaaatacattttcatatctcttgggtaaatatctgtgagtaattgctgggtcatacacttaatgtatatttaatttcataagaaactgccaagttgttttacgagatggctttattattttgcaaccccaccagcagtgcctggaacttctaatagtcctgcatcctcactagcacaagggattgtcattgccctcctcccccattctgataagtgtacaatggtatcttactgtgattttaatgtgcgtttccctcacaactagtgatgttgaatatcttttcatatgcttatttgccatccatatatcttctttagtgaagtgtctgccctgcctattttttaaaaattatgttttctaattattgaattttgagcattctttatataatgtggatacaagtcctttattagatatttgtttgaaaatgtttctttccagttggtagtgtgtcttttccaagagagaagcttttaattttgattaggtctagtttttcaatttcttcttttatggactatgcttttgatatctcagaactccctgcctaacccaggttcacaaagattttcttcgtgttttcttatagaagttttatagttttgggttttatacttaggtctgtgatccattttgagtgtatttttttgtatatgttgtaatgggttacggtttattttctttgcatatagatgttcagttattccagcaacatttgttgaaaagactgtcctttttccattgaaatactttttaacttttgattataatgcttttctaacaaattatttgtaggaaggaggtatctcctgccccacagcacagtagcttctttaaagccaggttccctgatatgagattaacttactttattatcttgggctgccttgtaaggggcctatcaaagcctggtttgtggatacccaggtcccataggaagtgccccataagaggtgggcagcagtcttcccagttgctgacagttcagatttcttggttttattgttagttaacttatatatgcacatctatttgtatgtccttcaaaataagcacttatctggaatttattttattagctattttgtagccatccattgttactaataaaatgtgctacctcctccttcatttattttacacttacaacttcaagttatatattcagaatgtggaattttcttaaattgtttctgcatcttaaggtatgtctatacttttttgattagaaaatttattcattagtggtatatgttcaacatagaaaaatcaaataatatagaaaagtaagagctacaatagaagttgtctgtaatctaacccacactcaggttatgcatccacagagtatccataataagttaacctattatgacttaaaaaaatgtgtttaacaaaacctggttgctactttatactgttataattctgaacattcattttacataactttggcatttctgaaatcaattattattagaaaacatgtttttaattgctgtacaatattttgagtataccatgtgtatgtgtgtataaatgcatagcatgcatatatatatatagagagagagagttacataaccattttcctgttgaaatttgagcttctattctttttactactgtaaatgttcctttaaggataatgacaatagcaaccatttattatctgccaatgcatgtattacctacattatctaatttacttcttatagctaccttatgaaagataggcagcaccgctttaaaaattctaataattaataagccttatttcttagcagtgttagatttatagaataattgagcagataacacagagttctacattcctactccatctctaccctctactcttacacagttcctcttcatattaatagactgcattactgtagtatatttattgcaattaatgagctaatattgatacattcttatttcatggtttacattaaggtttactttttgtgttgtacctttctaggggttttgacaaatgcataatgacatatatccaccattacaatttcttttgagacggagtctcgctccaccattagaatttcatacagggtagtttcattgccctgaaaatccctgtgtttgacgttttcatccctccccactccgcttgaatccttgacaaccactgatctttttactgtctctgtagttttgccttttccagaatgtgtatggttggaataatatcatatgtagcctttgcagactggatttttttcactaagcaacatgcatttaaggtttcaccatgtcttttcctggcttagtagctcatttcttgtgagcactaaataatattccattgtatgaaagtgccacagtttatcacttcaccttttgaagggcatcttagttgcttccaggtttggcaattatatataaagctgctctaaacattcatatacaggtttttgcgtagacataagttttcaattcatttgggtaaatactaagcacagttgctgaatcagatcatatggtaagagtatatttagttttttaagaaacaggcaattccatttttatagatgaggaaattgaggcccacagtacttgggagacttggctgatgtctcagagctagtaagtggtggtgttggcattggaactggaatccaggtctgtatgctccagagttcatctgttgtttgctgtttctttgaatattattgaacctaagatgtacccaactctgattattattattattgttattattttttaccactgcccttatccatgtacatctgattatttttatacactaaattcctgcatgtgaaatgattggactaatgttcaacacatttgtaaggccgttaacatatattgctgaattgtcctctgaaaaagtttctgtttatatttccataaactacacttcatacagtagcattaagtccctagacctccagccccacttccctcatcctctagcaagtggttagattttggatgttgttactaatagaaatacactattttgcttatccatattttttatttctcaacttctaatcactcatgaatgctgttttcagagagagccaatcatagtcctgaaagatgtaatctctaatgttgaaatcctgaaagattgaaatccataaagtcttaaaatcctgaaaaaccacagtccccaaagatcaaaatcctaaaaatctaattctggaaaaaataattttaaaataaaataatttacatttttaagaaggaatttatttgagaaacataaaaacatgaaaatgcttcattggtcactttatacaaaataagcaataataaataacctacatagttttgcaagcatttgcaagcataaacactcaggcatattatatgacagaaagatataacataggactgttatgagcatatgaactgtatttataaagaaataggtcataagggaaatgcataaacacctatcactgtggttgctaattgtgtgcaccccactttataactgtgggtcatttttatctttcacaaatgcagatgtatgaaaaggacatctgttcatttattgaggaagtttcaacatttttacatacatgtacagtgcttacatacaaagtcaacattgtgatcatgcactttcgtgaagtcagatttgcaaaacatgcataaaacaaattagaatcctttaagtctctataacttacgcttccagtgttggaaatgatgcaaaggtgaaatacatagcatagcaaattgtaaaaaataatactcacaatttaaaatagcggaaaaggaaactaaaaaaagaaaaataatggccgggtgtggtggctcacagctgtaatcccagcactttgggaggctgaggtggatggattgcctgaggtcaggatttcgagacctgcctggccaacatggcgaaaccccatctctactaaaaatacaaaaattagctgggtgtggtggtgggcgcctgtaatcccagctactctaaggaggctgaggcaggagaatcgcttgaacccaggaggcagaggctgcagtgagctgagattgcaccagtgcactccagcctgggctacagagcaagactccttcccccaccccacctcccccgccccaccaaaaaaaaaaaccaaattaacaacaacagcaaaaaacctaaaaagaaaatatgacatggaaaagcatattacagagataaatgatggacagttgcatggagatagtccataaaagctggctgactttcacgatcattaactatattttgaagtcttgcagcatgatgagtagttgcttttttttctttaagaacatggctgtcagcgtatgttcatattcattttctatgtggcactgctgtttttgaaattctatgattcgatgtacactaacatgaacattctctattaaattttcctatcctgtgattgtgattttcaggagtttagactttagggattttgatctttagggatttcagcatttgggattatggcatttggtattgcatctttcaagattatgatcccagtatgttgggatcatagatgactgttgggatcactgccacccagagagctggggcagtgtggatgtttgctttgtttttggggtggggaaggtgtttatatatttgaatagggcttttttttttttttttggtgcacgtcctatcctggtaatctcttcctgatgtttatttctgaataaatcccatattggatttttttagtggtattgggacagagtattagtaaatgtatgtgaaatctgcagttacttaaacattttaccattagacttctgcataacttctcagagatgctaaaggtggtgaaactttcattttatttgctttcttcagtttgtcctctggctctcttataaaaattaaggtgaactctggaaaccaaccaaagatagttagggaagaaagaaactaattacaaattacatcatcagcctggacaaatcacattgttggggtttcccaagtagagtgtgtgtgcgttaattatagcagatatcctgatgctattccaaggagactaaaacaaaataagacctaagccctgtcagaagctcgttgaattgcttaaattcatcctactttaaagtggaattctataaatactagccctgcctcccaggtattttgtatcttttgaatacctaagtcttttctccaaatattattagagaattttttgtctcattaggttagcaggacggcccccaccctcatcttgtctttttccctacttcattttgtgttcatgtgacccttttatagccaatatgtttatttggccttcagctttttgattagtttagtttagtttagtttagtttagtttagtttagtttagtttagtttagtttagttagtttagtttagtttagttttagagatggtgttttgctttattgcccagactggagtgcagtggcatgatcatagctcactgctgccctgaattcctgggcccaagctatcctctgccttagcctcccaagtagctggaactgtaggtgctcaccactatgcttgggtaattaaaaaaaaaaaaaaagaaagaaaatccatttctgaatggatttttaaacttttttgaaagaaaggatttgcagaaatggagtctcaccacgtgttgcccagactggtcctgaacttctgggctcaagtgatcctcccacctcaacctcccaaagtgctggggttataggcatgagccactgcacgtagcctcgtcttctgctttcctttgtttgttttttgagacagagtctcctgctttgttgactaggctagagtgtagtggtgtgaccatagcccactgcaacctcaaactcctgggttcaggtgatctccccagttcaggtgatccctcatgactcagtctcctgagtagctgggactactggcatatgccaccatgcctaggtaattttgttattttttatagagatggggtcttgctgtgttgcccaggttggtctcaaactcctgggctcaagtgatcctcctaccttggcctctcaaagtgttgggattacaggcataagccactgcactcagacagtttgctgcttttgcttcacatcagtttgaataacttttattattgttacaaataaaacagaccttttgttctaaatcattagcttgttgacattttcccccatgtactagaatcatattaattgtgcccctcattaaaatatttttcagccatcctttttcataattcttttgaacacatttcattctccttttggaatatgaagtgttgctatgtactttgacctagagccagttaaaaagtagtactgaatctcagttttgcttgttattaagtcatctgggaattctcagtgttttccatttatgactttttctagtgtgtcctacattttccattgatccattgatagaagtggtcatcctctttcattcttctttttctgatttttacagcattacttgcatttatatttctactgaatctattcaccaagtccccatattattatcacaattcatatagtctaatttttaataggttgtaaacctttatttcaatcacttgttttttcttcagtgcattagttttctttaatctgtcctagaagatttgaggatcttcggtaggttattctaatgcaagacacatcttttccattaatctctcctttaatattttcctttctttttttttgtaacttcctttccctagtacatcttgtctattaatttccatcaaaagaactgtgagtgctgaccacaaatgtgacactgaaaaggaggactcataagaagagaaaaataccccttgtagattgcttctgaaaatatgtggccttgttctactctctttgatgatttttatctcttcctccaaatctaaaatcaggccaaaatacccaactgtcacaactggatcaagccagctgcaccttttaccaccaagtacaaggctcactgcaacccacggatacccatctaacttcgggacagccatgatccccaataggcagggatgacacccacgaccagcaagaagcagctacagaaaattgatcctcagtgcctctgcctcccataaagatttatggggatcatgtctctcggagaaatgaggcagaatagggaattagggtaatcaagggttaaggcataagtaaaagaacagtagatgcagccagttctaggcaagattaggcagcatttaggccacatccttaatcctgtgataacaagacagtagtctccacttcagcctctgattggctggggaccaagtctccacttcagtctctgattggtcacaggctaatccttcatagggtgtaaccaattggaggcctctaaatggcatctggtagtgttaccaaattcttttaacttaataaaaaccctaggccgggcacggtggctcacacctgtaattccagcactttgggaggccgaggctggtggatcataaggtcaggagttcaagaccagcctggccaagatggtaaaaccccgtctctactaaaaatacaaaaagtagctgggtatggtggcgggcacctgtaatcccagctacttgggaggctgaggcagagaattgcttgaaccaaggaggcagaggtagtgagccgagattgcgccactgcactccagcctgggctacaagagcgaaaatccatctcaaaaaaaaaaaaaaacaaaaaaacaaacacacaaaaaaacggctgggtgtggtggctcatgcctgtaatgcactttgggaggccaaggtgggcagatcatctgaggttgggagttcgggaccagcctgaccaacatggagaaaacctgtctctactaaaaaatacaaaattagctgggcgtggtggtgcatgcctgtaatcccagctacttgggaggctgaggcaggagaatcgcttgaacccgggaggaggaggttgtggtgagccgagattgcgccattgcactccagcctgggcaacaagagcgaaactccatctcaaaaaaaaaaaaaaaaaacacaaaccctaaagaacattgtagttgggactcatgagccgcttgctcgagcccgttctactctatggagtgtacttttgcttcaataagtttgtacttctgttgcttcgttcttttgttcctttgtgtgttttgttcaattctttgttcaacacatgaagtacatggacaactcacagtcacaacctttcattcgctaacttattttgcagcttttgccaaacacttgttatatttcagtgctgtgtgctacatgattaatttctgcagtaattagagttttcacttggaaggttaccagtatgttttggatatatgtgtaactcagtcttttttttaaaggcacactgaagagtttctgaatggatttttgaacttttttgaaagaaaggatatttcccaaatataagttatgtgattcatgatatttggattgcctagggataatcagtagtgtgatattacagtgcagctgagtcttttgtttaagaaaataatactttttttatttagacctttattaaaggagagaaccagggaacagtctttatggtagtactgagatttattcagttgttcattcattttatttgtctttatagagcgctgttggtataggacaaaaatctctggcttcatgagtcttagaagataaatgaatataatgttaaataagtgcttaagagcaaccccccccccccacaaaaaaaggcaaaatttgaatgattagagagggagattgaaatttttatatagtaagactagggagggcctcactgagaaggtactatttgacagaagagggacccatgttatatccgaggaaagagcattccagacaagggcagaggctggaagtgagtgtgcctggcatgtgtgaggaacaacgaggaggccaatgtagttcagtcaggaaaagattaatgataggagtgcagtgaggtgtgaacttcatgagggacccggtagataataaaggacttaggcatttgttttgagagagatgtgaaatcatttgagggttttgagaagagacacgtgatctcacttctgttttaacagtgccactctggctactgtgttgcaaattgactgcaggaaactagggcagaaataagaaaatcagtttggaggtattggcccagagtgtgggcaatggttttggagtaaggtggttgaattctggatatatttgtgagtggagtcaacaagattcgctgtcaaactgcttgttggcacataagaaaaatggaggaattaaggttggctcccaaaatttggagcctcagcaactgcacatatgtacttttcactaacagaggataggaaggagcaagattgagacatctaagaggaaatgtgaagtagggatgggaattagttttgctgatctggatttcagaagaaatgtctgggcttgagataaaaatgcattcaaaaaaatgcatgtaagtaaaatccaaagccatgtgcctgggtatgctcacctgaggcgtagggaattctgagacctcttatagagaaaggaactgagccctggggtgctccaacatctaggcatcaagagggatcaggagaagtctgtacaagaggaacagccaaaaaggtaggaggaagaccagtatcggtggtagtggaagccaagggaagatggtgtttcaggagggactaatcagctacgttagggtgcggctgagagattaagtcagatgagaaatgactgtaggcattagcaatgtggtggtggtggtggtggtgcaggtctttgaaagtcatgaatcgtgtttcactgcagttgtggtaacagtatgatcatgggatggattcagagagaatgggagacagcaagtataggctacttgctaaggagctctgctccaaaaatcctccccgttcctatatcaaaattttttccttgctgctgcactttaccatcagtatacaaacatgtttcctcttccatttaaaaaaaataaagaaaaaaaagggaaagggtggcagctgaaatgggaagggaagagaagtggtttttctttctttttttatatggaagggacaacatgtttttgtatactgacggtaaagatatagcagtgaggaaaacattttggcacaggagggaggagaatttctggagtaatggtcttaataggtaagaaggtagaatctttgacctgcagtagatgcatattgagttcatctgtagtaaaaccagaggttagttcctggatacagatactgagttgggggaattgtggaaattctcttctgattctgatttctccaaagtaggaagcaaggtggtcggctgagaaggaggctagagaaaggggatagattgcaggtacgaggagagaaaactaatatgaactaatcctctaggagaataggaaagagaatggtgtattatgtatattgaaatcaccataacttgtaaatattgttggagagagtgacatggtagtgaggcagaagttaaaatcattgtgaaatgaggggctgtgaactccggagcagtgaatgcttacagttagtgagttacagtctcatctgacattcagaactgaggttttatgaagggagaatagcggataccgtgttccacctgtaggctcccccagtggtactatttgaggaggttatagggatggtagtgttttgtggaaacactaggttagagcaaagtactatttgaggaggttatagggatggtagtgttttgtggaaacactaggttagagcaaagtgaaaaagagtaaaaaatagaggagatttgttggaacacagtgaaacgattttagatcaggagatggggtcagaaaaaaggattaaatatttattttggagagataaaaatcatataagcaatttagaagtacagtggaagagaggctaatgagttaacctgagtaaaagggaatgagcagacacttgacactgtaaaaaatggctctacagacactgagaagcagctgttctttattgctcctgaagacagaacaaagggaaaaggctattttagttgtatgcgagtgtcataggaaacagacgcaagagaatttttcctttttttgtctctggaacatttcaagaataaggctgttttctttccagagtttacacataatgatataaattggatgacttgtttagattgtgtatttcctgtggtacctttggtaaagattgaaatgaccatgtcagattaatgtcttaacaaacatatgtcatattgcttaagcttgatctcagtggcaaattaaatacagcttaaattgatgagtttttcatcattagttatgaatgcatgggttattctgtagaaatcttaatattgaagatttttagtgtatcttgtattttaacaggttgcagtattttacagagctagcccaaggcacaagatgaaaattattaaggtgagtgtgtaagaatcagattgttttatttctgtatacaaaatgctgctactttacttttgttatgtttgcattacagggagtagagcatcaaggtcagaaatactgtgaagcaaaacagttttttttttttgtaagagcttgacatagaaacactaatagagaatttagttggcataagatgtagaagaaaacttgaatgaagtatctgcaaatacagccttctttaaacagttagacagtataaaacaatgttctaactggggtccatagccgagtcatcccagcgtaaatagcagtaattagttagaaactaaataaatacagcaaggaaatagtgttgtgacagtgtgaacagtgcttaaaaggctatgattatttatattaattagtcaaatgtatttaaaccaactgatagagtatccagtagttaatggtcttaagttatgatagccagccattgtgtagttcagagtttctcaaccttggcaccattgacattttggactggataattccttgttgtgaagggctgccccatatgttattgaatgtttagcagcattcttggccccttcccactaggtgccagtaacatcccccaaatcctgatagtccaaaacatctccacacattgtcagatgtcccttgggagacacaattgcccctggttgagaatcattgtatagttgtttgaagaacagaatttagagatacagttctcacagatgggaatattagtagcaactttttctaagctttatcttactgagatctccatttgttgaagttcattgaacaatgggtggtctatattatttctaatcttaattatgtgaaaaaaatagggaggatttgtttatcgctttgtatggaagcaacatttttatcaaaattccttcctctcccctgtcctctgctccactctagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtaagctttgtttcagtgaatgcctatcagagaatcttcccctatcctttcctgtcccccacccctagagaattcaactggaaaagaattagtatttaaacattaggtaaactaaaccacttttctagggtaattatcctattttatggtatgaagaagatgatttgtgtggctggaacaggcatagtaaatggcaggaccctcatttaagaagtatttgccaagtgccagccacatttcacctttttctgggcactaatatgatggtatagtaatggcctttattttagttaaattcaggtagttagaaatatgcatatgtatggctctttttttggctttataataaatattgaaaattatgaagtttacatccatacctgttttttatatcagtaatttattcatcttgccctcatttaatgttataatttattaaatttaaatagctctatttgtgtcagccacagtttccagttgatttaagactccagtgtaatacatggtggtgtcagtttcacagtgttcaggtggggatcatgtgaatcccatttatttatttatttatttttttggtagctacctgttggatgacctgagtttagtgataaattccaattatatgttccaggctgctttattactctgttttggcctacagggaaacatttgggagcttaggactcacagtatttgccaagcttttgcaaggatatgagttttttctttccattattataattatatagaaatcttagaagaaatggggagttgattaaaaagcatagattttcctggattcagctaaatgaatgagataatttatatgaatccttgtaaaccatgttcttcatttaattcctctgcaacatgtgatctacttgatgtgcaggagcaacacgtagcttaaattctataattcctatatatctcattgccatttgattcctgacatgcattagtttaaacctttactctgcattttgtaccactaagaaaaatgagcttagaggaaggtgaagaagataatcatggctgggcagggtacctcatgcctgtaatgccagcactttgggaggctgaggtggatggatcacttgagcccaggagttcgaaaccagcctaggcaacatgtcaaaacccatctctccaaacaatacaaaaaaaatagctgggagtggtgatgtgagcctgtggtctcagctactctagaggctgagctggaggattgcttgagccaagaaggtcgaggctgcaggtaagtcaaggttgtgccactgcgctccagcctgggaagcagggcaagaccctgtctcaaaaaaaaaaaaaaaagataatcattttatgtattatgaatgtgaagtattttctcttgtgtgaagagacaatgcatgattttaatgttgaagtatcttcttcagaataagaattttaatattgtgacaaattagttcaggtagagcttaggcttgactttaattctttgctaaaataaatgtttccatattgatacatgtgttgtattagttggaattttattttatttatttgtttgtttgtttgagtcagtctcactttgttgccaaggctggagtgcagtggtgtgatcttggctcactgcaacctccgcctcccgggtttaagcgattctcctgcctcagcctcccgagtagctgggattacaggcatgcgccaccacacccggctaatttttgtatttttagtagagacggagtttcgctgcaccatggtggccaggctggtccgaactcgtgaccccaggtgatctgccagtttcggcctcccagtgtgctgggattacaggcatgagccacagtgcccggttggaaatttattttcaaaattagctctacagtgttttagtatagatacatttttgtatgataatattttctcacttcatctttattttttaaatttcaggtctgcaatcgaagagggtaaagggatttataataacattaaaaatttcgttagattccagctgagcacgtaagtttgcaagaaatttgtcaccatgggtcttctggataaattatatgaaaagtagaacttaagcagaatgcctagaaacttctctgccttatatttgtgagcattgttcatatgtcagttttccaaaaagaaaatttattgtattctgaaattttaaatggcatgataaataggttgtaaatgtaacagttagatgtctgtatcatcaaaatgtataaatctttgtgatttatttaatagctcacatctcattgtttcctcttggtatctttttccaaaagtagaaggggtattgtgtagtcaaagaacagttaccaaaatattgttgaaactatcatgcagatgtaaaaattctttatttgttcctgttgtctaaacatcttgaaaatcctttgttaaaatactcttagctttaaaatgtccacgtgactgaagaatagtttacttgaaacagtcttcctttaaaagcatagtagtaagagatttttaaatgctaaaaaagtggtatcatagaatcaacagatttactctactgatatttttaaatgactctctttttcaacaggagtatagcagcattaactttaatctcattggctacattaatgaactttcctaatcctctcaatgccatgcagattttgtggatcaatattattatggatggacccccagctcagaggtacgagttttttaattgcatgagctggaaagacaaggaatgtgtactaccctgataattaagttttaaaacttgatttatggacagtgttggaaaactttgcagcaaatgttttaacatttatgttataaattgtgtgatgtgtgtattttattaattctttttgagtgtgcatgcagtgtagatctgagcctttccactgttagatgcctagcctaaggttgagaatagatcaggaataggtgctatccctgtcctcaggaagtaagtaagccttttatttctaagaaatgggtataatggagaaatttctgggttcagttttattatctaggttctactgtcagttttagagactttgggaaagtattagaggacctgagtgtcataacttttttaaaaaatttaataataatggggtagttgagtgatagatgtcatttggccactccagcaaatcatcccagttaaaacctctttatatgaaagatatttcaaaattcagtcggtaggtcatgtatttcacaccgtatttgaaataggtaaacttacatgtaaatgaattggatggttttttgaaagttgattatctatcccctatcaaattgtgccaaacaaataaagaggagagaaaaagtgacaaaatcagtggttatttttgcgtaatcagccagcgttttatgatgcaacattttgtttctataagaaagcatttagtttgccgaataattgaggttagtgaggttgtgaaagtaacaaatccagaccttaaaacttgaaagtaatttatttttctgtttgtttttaagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgaggtatattcactggccaagctgctatattaacatgaattctgtatatctgataggattcttagttattttgatgggttacccagaaggctgggaagttaagggagctcttttagtgaaaaatataagaacattttaaaagagtttgatttccatctttatggataaataaaattattgattcatgtattagaataaatctgcagagaagtatcagttacaataaaaatacatgaaaatttagagagaagttggaaaatctgagtcttaaaatcatagagccactttattatttttaaataataacagtattttaatatctaatacatagttcatgagaagttttttttttactttttattatgtagattacagctattcactaggtgatttataggaaatttaggtagcttttatgtttcatgtgttaggctaaagttatttcttcctaatggaaagaaaatgtttatattttttaaaaagcagcgatttatccattaaattcagccactgaaaagtaattttgttattgcctcttgacagctacgagacaatgtgattacacctcgagacacaacaatgaccttcacatgctttgtgttttttgacatgttcaatgcactaagttccagatcccaggtatgtttaggtgaacttagttgattgacttgattgactcacttgagtagagtgctttctaataagtaggcaaagattatgggtttttagctttgcttaattttgtagccacagattgcagccccagacacagccttcttataaacatgtgccattggtcacaatgaggatggggcatttgtgggaggtaagctttatgtctgactagaacataaaagtattaataattcacaggtgttgtcatctgcgtttagctggctatagctataagatagatcgtggttaacattatttgagcatagaacaaacctcatagtttctgttgagattttattagtctcattttaaaagacagtattgctaggagtataagagcagttatgtgcctattttttttcccatcactcctgtcactgtgtcaaagcttaggacattctaattttgcttttcttcccttgttgtatcttaaggtgtgactgctgcttcttggtctaagtgttttgatagaaaataatgggctagagctttatggtacttttttagagcatattgtccttaaaaactagtttcatttgaggcatgactattcatttcagctttaaagcactttatgaatccttaactatattaccatttgccatgctggaacttctgagtacagcgaattctcactaattgaccaatttttgaagaagctgtaatatttatttttttatgaaaagtggttttactttttcagtacacacacaattaggtccattctccaagaaaggattttagattatctaccttagtgaatgtatagaaatgatttagcaaaatacaaataaagtttcttgatgtttgggatgttaaaaggtttcttttctttctatggtctaaattatatagtgtcactttttaagcaagccttttcttgataaataaaataaaagctactttaatatttacttttattccatctgaattattccaaaacagtagtaaaatttaagatatttcatagaattgacattgcacaattcagtgataaagtgacactgcttgttaaaaattagaagtgaatataataaagaagttatttctgtgaccaaggagtaataaatgaactctctgctctgccaacagaccaagtctgtgtttgagattggactctgcagtaatagaatgttttgctatgcagttcttggatccatcatgggacaattactagttatttactttcctccgcttcagaaggtttttcagactgagagcctaagcatactgggtaaagaaaacgttatctttatcatttatgtattttagataaatcatattttctaatgtgtttgttttaattttaaaattcttttaaaatagcaaaataagtaactcacttgatttgaaaaaggagtctattttttcacttggggaagctcaggggaattactctcctaactccagggttttggtttttgctcttttataggttatcaattgttataaaaatcataatacgtgattctcaaatatagcaaatcaaaacctgctctagagtatagtttataactttttatgtactatgccatcttgtatgaagagaaaactagacttaatctccctgaaaaccaagttgctctcttctttaaagttagaattttcagtaaactaataatttcattattctttcttgtttgtacattctaatttcacaaaatgtcagtctgaccaaatagcagaatgttttataaagactatttggaaattacacatttttcttacattaccatttattaaatgtataatacagtgcatttaaaaattagttttcctatgtaggtgtgaggaatgatatatttgacagtaatgctatcctttattgagttctcaatttgggtatttatgaaaaggagttatacagtttcactgtattttttcttgtaagttaaaatttaccttaaaattgaactagttgaatttcagtattttaattccatattcacatttcttcctctttttaaaaaaatggcattttaaggaaacatctgcaattttccaagcagtaaataagaattgagatagtgtggatagtattgtaaagacaagtcttctatgctttgaaatagaacatattaatgtcaaatttttaatcttcagataggcattgtcattcaaattgtctactactgttgatacagtacttttttaaagggctgtgtgatctatgaaataaactccttttgttggtgatactgttaaaggctagccacataaggtttcagggaaagtggtcagaggacttgggttctaattctggctgctgcctttcctagttatgtgactttggataagtcacttaatatctttttttcttttcttatttttaactgagggtgattgtgcctgccttatggaatagttgtgaaacaatgtgtttgaaagctgtggtggccaggcgccatgcctcacgccagtaatcccaatacttcgggaggctgaggcaggcagatcacttgaggtcaggagttcaagaccagcctgtccaaaatggtgaaaccccctctctactaaaaatacgaacattagccaggtatgatggcacatgcctgtaatcccagccacttgggaggctgaggcaggcaaatggcttgaacccaggaggcggaggttgcagtgagctgagatcatgccactgcattccagcctgggtgacagagcaagacttcatctcagaaaaaaaaaaaaaaaaaaaaaaaagttgtgttaaaatgctagaaaaatgtaagctattaagctttgcaactgtaagtttcaaagaaatgtaaaacccaacttattttctcttgcagatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaatgacatcccagtggggactattagcattaaaattatccatatggatgctgaagatacagaaattaaaattatccatatggatgctggagaatgcatagtacacagaatctatgatttaaaaagaagttgaatgtacagtacagatccagattgcaattttccataatatattaatccaagttgacatggatgagttaaatgggctagtatctaaattttaaatttttaccctatttcctaatcctaggacttgctagagtccctaacaatactaacttacttgatgtttttccctgttagactaccttatggagttatttggccccataatggctaaacatcagggaagaaaagaaaagaacttaaaataattcactgattaggtaaacagttctgaaatgatcaaaactggccacacagaacaaggctgaacatgttgtgtcacatttgtgctggacattgcatgacccagagatgaaacaaaagtgaaaccatgaaacccgaagaccctcccctctcaggatacaggctttatttatatagcagtaaccaccctcacaagaataagacacattatttacctgccatgcccatgtagggtatgtattttacattggtagtctttttgagatcacttaagttttggtctccttgatatactatataagtaaagtaagtattggtcacacttaaaaatagtttctcactgaaatgaattggaggcaaacaataaacataatatttaggaaacttaattaactctaccttgctttctgcctctgtcacttggcaattcacttccacatatgactcacccatgaagttagatgatgaactggttat

SEQ ID NO: 17015 - DNA, 13343 bp, Human
gaccctctccgcacctccccagccgccaggccgccagcccggtgcccgggcctagcagcctccgcggccttggagagcgcgaagtggaggggcgcgcggctctggggggcagcccgagcccagacctgggtcccaaggtgctggcggggagcctgtgacctgggacggggtgctggaggctgaggaatcgcgcctccatgccacgccgcagaggttcccgcgctcgaaaccgaacgccctccagccaccaccactcacggcctactaagcgcgcgctccgggcccagggcacaaagatggagggagcggcgcgatccacccgccccacccccacccaccagacaaaggggcaggccgcccctcccccagccttcttcgcgggccccgccgccctctgctcccctcccctcgggccgccctttggtgacttcctttcccctccaagggcggccccgggacttctcaggaactgcgtttcacctggacgtggggcggggagccggcgcgcagagggcggcctccgggcccacccctaggccgagccggccccaggcccgcgccctcccctttgaacccgcgctcccggcccctggcgccttcccgcccaggcgcccccgcccccacccggtcaagcacgtgctgcccgggccccgagcgcttcccgccgcacgggtgggggctgggcccaccccccgcccgctccccacccccaccggaaacattcctgccacattcctgcaactgcaaggcccagcccgccgctccccaccccgcctccgcgccgggcccagggctttcctgcgtcccctccaccgccggctcgccccctgaggagggggctgggccagggcctcggctgaccggggaggaagaaggggagcagagaaaaacatgagtcacagccgtgtgtcactggagcgcatttcaattccctgcatcacaggaggtgtggaaggccgcctcggggaccgggcgcgcgaggtgcgcccgagaaggccccgggccggcctgcagggcgcgccgctccgctggccctttcctcccccaccgccctccccgccatcttcccctttggcttccttctcgctcggtgcaacaagtctttgttaagccgggcgccgggcgggccaggcgtggcggagatggcctgcgtgctcggcccctgccctcaaagcgcttccaggcgacctctggcccaccttttatttttatttacagtcccaacggaagggcccaggtccccaagtgggcctgcgtatctccagaacaccatctaagtcacctcaaggtatgaagcctcccttgggtgtacctgccaacgagccaatcgttggtttcgctggaaggctccaccttgatcatggctcgctggtggccattaataaaacactttggatttcacaagtttcacgtttgaatttcacaagacttgtatctcaccaatcagccacacgcgggttgacactgaaaggcacatgctgacacctgtccgcccaggggaaatctaccatctctctattttagttagggggcggcgtgtaggccgcggaattctctaacgagcgcgtttctcttcaccccctgggcccgcgtggacccccgtccacccccacacgccctggagggggggccgggcccacacgccctggaagcccctagaggtgactctccctgggacccctgtaccagggaggaaggataccgccacccgtcaccaccccccgccagaagctccttcgtgactcctctgcgcgtgccttcccacacctcctccgtccgggactgcgaggagtgggcggtcgactcgagttcgcagcccaggcctcccacacgcccctccctgccgtcagcacccacccgcgcggcagcggcggcggctggcgggcggccgcccttttaaatccccgggctcatttgcatggccccgccccctgagtgacacggctggcgcgggcgggcccgtcccccctgcccctgggtcgctctttttaagctcccctgagccggtgctgcgctcctctaattgggactccgagccggggctatttctggcgctggcgcggctccaagaaggcgtgagttcgcggccgctccggtggcttcttttttttatatctataatttaattaaattatttatttattgaggccgcgcacgggccgtgcccagcttcctgcccctcgccatccttcgggggagggggaatatttttgtccccccgcctggctgtgacacataaataccccgcgggggcctgggcggcgagcacgcggcggcggcggtctctgagcgcctctgctctctcccggtttcagatccgcatttgctaccagcggcggccgcggcggagccaggccggtcctcagcgcccagcaccgccgctcccggcaacccggagcgcgcaccgcagccggcgcgaagctcgcggtgagtcgtccccggggcccgcggcggcggcggcggaggggggcgcccgcgccccgcccgacgtcgcccctcctcgagccgcccggggctgcagcgcgcgccgccggctttattcccaggccggggcggcgcgaccggcggcgggggagggccgcgcggcgcgggggcgggcggcggggcccggcggcgcggggaggacgcccgcaccccttccccgcgccgcgggcgccctgcggggggcggggacccgggaaaggcgcgcggtgggggagggggcgcgcagctgcggcgagcgcgagttgtgcacccggcggagcccggaggagcccggcgcacctcgcgcggcggccgctcccgctggagccggagcccgagcccgagcccgagcccgggcccgggtgaggggcggggagagacacgggctgcggcgcggcaggagagtggggggtcgggcgccccccgcagctcagggaagttctggaagtgagggagatggggaggaacccccaaattcggccctacgccctctcggcctttctctcgcgccccctccgcagatgaggccggagcgcgggcctgggtttggggcttcaccccgaccccacctctggcctggcccgcgcctcttcagccccaggggccgggcctgccctccgcccccacaaactggtttcgctgctttgctgggctctgttggaactagtccctttgactccccgtttctattttattttcttctggggctttattttgcggggaggggacggagggagggggctttcttcctctcccccgcgcccgcgcgcgccaggtttcctgccccaaggcgggcttgggtgccccctctggcaggaagtggggccgggtgcacccgcgtggcggtgcatgcggtcggggtgcgctgctttcccgcgcctgcaggagcggcctgcgcccctccccccgcgcgccctggccccgggtcccgccggccggcctgcaacggccgggcgcagacacttgcagagtcaccctcgggccgggtctggagcctgatgcctcgggggtttagccctagccgctaggcgggtaggcaaagtgtcgggttgaaagggtctccgggaacctacttcttcctgctcgccaacttgctgtgtgaccttaggcaactcaaggcttctctgggctacttttttacgggggacggggaagaaaacaagggaacccccaagataatttcctagggcctttcctgcagagtccttaagtatttgaggagcacagtttgcatgcacagtgtatggaggagacaggcttgaggcccaagcgggcttattacaaagtgagggattggggttaggccctaaatgtagttcctccaagacaggcctctgatgttcagaaacaggtggaaaagacgaacgtttcttggcctcactggaaagggcctcgggccttcatttagttcgtggggggttggctgaggggattaaagggtccccagcagcaagaggtggggggaggcaccagatggtatgagagcttccagggagacccgccaagatctccaggcaggccgggccaggctctctgggattccggactggcttcgcccaactggaaccccctcgatgagggggccccaggcagaccttatatgaggtcagcactcgtttagttgattaattttgatgtttagtttgaagggggacctgtggtgtaatataagattctaatcactgcctgtaattgcagagcaggccaagccactaatgacggagcaggataaatcaccaaccaccttgtttaaaagggtctccaagtctgaaacattataagatagaataattaccaaagtcctgctgtctggagggtctcttgatgcttgaaaatggaggtcctgggccctctagaaatcacaagtttgcaaaaatgtttttttcctctcattggggtaaaaactctttttcttcttttttttttttcttttaaattagacatgggagtcccaccgtattgtccaggctggtctcgaactcctgacctcaagcagtcctcctgctttggcatcccaaagtgctgggattacaggcatgagtcacctcacctggcccataaatcattttcaaatggtctagttcttattttggttagagtgaagatttctttctattattttaagtttttctaaactattacctagtttgatccttgaagcagtcaggaggtagttcaggcaggtaccttataattaccttgatcttacagattgagaggggttcagaagtggagccgcttgtcccaccccttaccatggcaggcagggattggttactggaaaaatgtgtagcctaggcctccggcgtctcatccatctgtagcctggggataaggactaggataagaagatgtggaggactgtcctttttaagcctgtaatacagggtattcccaaatacaggttgcaggccctccttccaatgagaagttttaggaaaactcaaaattgatggggttaattaaaccccaacaggcctctaagaagaaggaagatgctagaaaatgaccaagaaggttttaggatgagccctaaacctcatcctaaaggatgagggccagccagggtctgttaggcggtgcatttcagttggagaattccctacccatctgacaaagtcccatctgactccagttgggcagaggaggggtaaggggaaagaggagggtggcctttggctttgggctcactttcctcccccacctcacccactagcttcaaccatctcctccctccctcaattataccaatctgaattctccagggatttaccctgggtgagaacagagaagagagctggtggtgggcaccacccctggctgtgtgattggctctttttggtcctgagtcttgcaccttgccagataggcaatattgtcagtgaggtgggcaggggatcaatgtccatagctgccagatcgcaaggtctcattctttccattttcccactgaactgcgtaggctggattttctcttaaagagaaagggcagcagttgactacagaaggaggggatgctggcaatacgtcagatctcacctccccacacctttgtcccagggtggcctcacccatgtagctaggtctgggctggctgtacctcctgggaccccccccaccacgctgcactggggcggtgttaaggcaggacaacaaagagcccttctgaacaggagatagataagaagctgattagggccaacggcccttccccgcccttggcagcatctgggggtgggcagacccctccatcctgggcagagtaggaggcctgggggcccatgggagcacagttttctgcagtgtgccttgaaggtgtgggtgatgagggggtagaaagtggctgaagcgagatgtttgtctaaaagcacttttctgtctcccagcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcaggtgggtgtccaaacctttgcttcacttggtttaccctttggggctagggaggtgcctggagtttcattcagcaggcgagaccatgcatggagggtgcagaatgattctgcgcagtaagcgtgtgggtgtgtcctcccacctgtgtgtactcctgccccacttgcaaccctggtcagatctctatagagaccccaggagagaaccgggggccgaggaattcaagataaattctgaagccaatggcaaacagtccaaacctaaagcaccccagaggtcacatggccagtgcttaaaacactcgcctttttcttaatttccaatccactgtggaccagtaattttaaaatgcagtaaagacgaatgaacaaaaatgaacatagaagcccagggtttttaatcattagattcagtgcacgtaaaatgatttttgtcaatttgctgtaaagttgctgaatacttatggtcgattcttgtacttcctcatcccaggtgagaaacgggtgcctgcgtgggccagcacctgtttgtgcacaggccagttatgagtagttctggaatgggcattgcccctggctctttagatggaaattgaagcccaagaagtcaaaaatgttggggagttggtggcagtgaccctcagaaccctggtgctgctctccccacaaagtcctcatagaaggatgaggctgccagcctggcgctgtggggcaccctagggagcatggccatttgggcatgggggggaccccatattggcctcttacagaggcagctgtcacccaagtgaagggtggctgttggtgaagcccagttacttcccttccctgggagagaggtaagaggagttgagttcgacctctgccccttaaacatgatacaggttgttcacctgcaggttttccctgtccgtacggtggagagtggtctgtgctgacctgggcccagggagacacgagctgtgaggagtctgctgtgttggaattcagagcctggggtggggtcatttgtcctcttagcctagctccctcagcctcccctcctaccccacctgttagccatggtcagtgggaggtgtcaggaggggtgcagggttactggaccctggttatagacagaccatgggcggccccctaggaaacagtagctggcgcgccttcaccacacaccttatatgcattatgcagcagctttttattctatctacggcttattaaaatttcagtgggaatgatggcagggatctctggagtccggctataattccccttctctgggggcagcctggatgggctccaggtttgcaagtgcaggcagggagtgtgtgtccagcataggtcatctgagagggtgggcagtgatcatggcccagtgctagataaccatacattacccatttaatctccatgacaccctgcaagggaagtcttcaccatttatagatgaggaaactgaggctccagcattaagtgtcccacccaagataagtgtcagaactgagacttgggcagagccacctaactgtctttctgtccccagaatgcctttcctaggggtcttctgggctcttgtcattttgcatcttagaaacctgcagggaagcaaggggagaggtgggaggcactttgcaaagatgctcaaactggagctttggatcctgaagggattcctaggtcagggatggtttgtggttcttggttcttgctgacttaaccttgttgaggaggcagagggctgtgtcttctgagggggtggaaacaggtgatgactgtccctgactaccccctctgtctttacagaaggagcccagcgaagtgccaacacctaagagacctcggggccgaccaaagggaagcaaaaacaagggtgctgccaagacccgggtgagacttgagatgggactacccctgggtggatgactagcagaggatcctcttgttggcaccatggccacggctgtggggaggtctgggaaggggctcagtcatctcagttgtgtacccccttccctggtacagggatggcagtgagtctttgctaactggggagagtggggcgatgactaaggtcttacttctggggggttggtcctgcccaggacactgcggagatcaggtcagaagtcccacagctttcctgatctagagaagggcagagtggggagaatggagggtccctgccagtccctgggctgagaatgttaccttctcttggggttccctggagcctgaaggggtggggacaggcagcaaaggccagattcacagtgacattagcctttcagaaaagttgttttgttttttattttattttttctaagacacgactcatatcctctgagtcatgggcggaggtgggagtagggggcgtgtgtgtatgtcgagggggcaaatgtggctggccagtcattgccagctggacttgggtgggcctgttgggtgagagtgttgggtcaccctgaacaggcaggtaggtctgccccccatcactattgggcatcgggtgagcactgatgagcattttggacttaggagatattttctctaaccctctagaaaaccaccacaactccaggaaggaaaccaaggggcagacccaaaaaactggtaggtgaagaagcagactgctgcttgcctcctgggctcttttgagtgagggtgttgagtacacagtacctgatgctatgcaccccctatggaaaggctctccttgacctgctgggacatcagattttacagaagtccagagaggggaaggtacctggcctgggctgtgcccatgagaagtgaggggtcccaggtataaatcagaccacatccccctgccctgccctgccctagttgtgtgtgggggtccctccctctcctgctcctagaatactcagaacttctaggggagatcttggaagtcatctagcctgtgtccccctcaattagagatgaggaaaggaagccatagggggaaggtttgtccttcctatgagcctctgcagaagagaaacagcgaaggagctgggccctgggaggggtcggtgctggagttctgatgtgacccaccacactgcactggagggcaccatccaattctgggtccccaaacagctggtggaaaggctcggtgggctgagtcaagaagctgcctctagggggccactgcagttagggtcaccccagccttccagctcctggccctctcctacccccagcctgccccctcaaatccctgaagctgtcattccttgagctgagccactgctggggtgggggggttagggggtgctgctggccaggccccaagagtgagtaacaggaaacaagttgttttggagtttgtgcctggcacgggggctgtagccccgtgtggtgtcccgacattcccgcccagtgagtgagccccggcggcacacacttccccttcctccccaccccggcctagggtcagccctcggccaccccggagggccagggcaccacagcacagcatctgcccctgtgggccaaggacctggttcccctgcacccaccagcgggctcttgcaccttccagccaccccttcccatttcctcccccagccacctcttcccccacctcctcttctcccctagggagtcagtcacatcctgaagctcattgctgccctgagctctgccctcctgccctccctgggcctgggggccaagggggcttggctcctggctctgggtgagagcagcatgtgtgtggggttttttcctccttttaaattctttttatgaatgaagccgggccgtggaggttgctgagtcacccacacactcagccctgactcatccctcttcaggagagccagggagtgcagggagcgggtggggccagcctctgggggtggaagagggggaccgggccagagctcacaccaacaactgcccacctcacaggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctggactggagtctcctgtggtgtgtgcccctaaagcctggggcaggtaggatgggtgacacttgtgttctggcccccatccttcaggctgcaggaagggaggggaaatagcactggaatcacctccggggaaggtcattttaagcctcttgatgaaatcaaaacccctagccacaaaacattttatttacaaaatatatactgaatactatacatctggccccatcaccatggaaacaactccaaagcctgcctggggatttgtgcccaagcccagcccaggagggctagagaaagcaaaggtgtctaccagccgccgccatcccagaaggaaagcctcttcccatgagtgcctgtgggtgggcggtgagctcaacacccacaaagggcagaaggcctgggggcagtgaggtgatggtgagggcatgggaagcagatgctgctgagggtgggtggagggagaaatggagacccagcacccagcagggggagccaggtgacagcaggggaagcagatggcagggccccaggcagtccaggaccccaggctctgaagggtggggcaagggggtcaggtcacgtcttgacatccagcagtggcatccgcttgtgctggtagccactctgccagccatgtaccacctgtcggggaggagaccacaccacaaggctgggctgtgttccctgggagtctgcagcacccagttacagcccaagtaagcagaaccaggctctggtttcagtgtggacgagtatggctgggaacagggctgactcccaccttgcctcattctccccctggcccccaagtgctcaccttggggtctcccatgtcagagagcagctcctgctcagcctcatgcagttcctcagctgggtcatagctgtacatggggagcaggtgatggcgcagccggtccaccctggggagcaggggaggggactcagctaggaggtccccccaaccctcatcaaacacctggctgcctcgtctctcctccctttcccaggcaggggcaattccagtgggtgccttttgggacacactatacctccaagaatacaaccctgattctacaaaggggctttccccagtgagtaacctgaggctggggcagggaaaacaaatttcaggcttgtatcaggatggctgagggacatcttacagaaaagtcagagcctatgagcaggaatttcagaacgggtgtggggttagggcgggtgggggacagggacactcaccgctttttcttctgtacatacattacctgcaacagagacacagcactgtgggggctgctgagcccaggaaggcccacaggcagagagaggcccacctccacacccttcactcccttaacaggacagtggggactctgtgcagactggaccaggcccacccagcccctgccttagcaaagctgtgggtgtctgtgtgtatatgagggctccttaccacagccaccaccaccccgaccagggtgatgaggaagaagggccccaacacatagcccaccatggagtcgctgttggcctggggggcattgggcacagtggtgttactcatgacatcagcagccggagggctgggtggtcagcatgggcagtggcgcttcgggagggcgcctccactgggctccctgggaaggaggaagggaggttatcagttgcacccaggtgacatccagactctggatccctcccccagagctgaagatctatgaaaactggtcccaggtcaaatcctgggaggagggatcctccaggtagatgtactgggtgtgaccctccagtgagtcttggcaaatcctggcaggaaaggggatcaagggaaggcctggatccagggctgagtcttgcccaactcctatccctaaatcagggtggggcccagctcagatgctggccaaacatttataagtctcagcttctggggaaagattaagtgcaggtttcaggtgcctgccccagcccttttggggcattgggctgccagcacctgtcc

SEQ ID NO: 17016 - DNA, 40181 bp, Human
gtaaggaatgtgagaaaagacagatatatatatacagagagagctatggaaaaagggtggttggagagggacaaactcaggtacagcctgagttctattccctgcggtatttctaaccctcaattcatattataagaggagctacttaatcttctctctgtatctataaggtactttttctttttctttttttttttctttttttgagacggagtcacactgttgcccgcgctggactgcaatggtgcgatcttggctcactgcaacctccgcctcccgggttcaagcaattctcctgcctcaacctccggagtagctgggattacaggcgcccgccaccacgcccagctaatttttttgtatttttagtagagagggggggtttcactatgttgaccaggctggtctcgaactcctgacctcgtgatccgcccgcctcagcctcccaaagtgctgggattacaggcgtttaagccacggcgcccggcctataagttattttctatgggaaataacttgtcaaacttccaccaaaaaggaatggaaagagggcagcatagtggccaggcagtttatttccatactaggagatacagaagggattaattctaaccgtaggaattctaaccatcaaatgtcactcactggcctacctaaactgaactctggtcccagccagaacaagtcaggaagaggggatgtctaagaccgaaaggggggctttctagttaagctcttcaggcaggagaggaaaaggatgcccgcatccccaaagacacctttagctaccacaagccccaaaccccgtactttgtaactgtgtctagtttacgtcctttaaaaattattcttattaagttaaattgttttcggggcggggaagatacaaaagaaaccagttaaagtctgaaaggatagagaggggaaagtttctcacctcattcttccagccacccagttcctctcctaaaaggcaatctttaccagttccttctctaacgcccctcctttttaatttgattttttaccgaaagctcgctcccttttaattttccctcaggtttctgaaaatttcccaatcgcagcccctcccagcagggaaatagtaaaggggcttggtttttatgttcaacccaaagcaagcctacaaaagggagtagtcggtttcgagcctgacggtggagctgacgcgggaatgagagagaacctgagaagaccgccagggcgccctccctgcggaggcgagtccctcaccgcccctctacatcgtccttttcaataaggagctcttaatacctgcaactgcttccttcaaggggtggctggaagatcagtaggcaaggcctgcggactgcgcaccttaaagcgcttcgggaccgtaagacagtgagtgctgagcgcgcggccgggaagaagcctggaggctctgagctcggaggacagagaccgaagccccagggcctgcgtccctcacaacctgcgcctcctgtcctcccgcgctactcccgaagcgcaccttctcgcccgcaggccgcagaagtgatgacgcaaagccctcggggcctccgccacctcctcacgcttctgctggaccgaatccttggaatggacaggtagcggttcccgattgctatagcgacgacccggctccgagccgcgcccaggccctgacccgggcgtcgtgacgtcagcacgccttccctgggcgctcagcctcgctggccatgcgtcaccccggccttggtgggggcggggctccgaagagctcggttcagatcccggccgcctgggctccaggagccccggaaccaggataagttggatggctgccgcggcgaagcggggggcggggtggaccgtgcccggtattttctatacgggttccggggcccggtagaggcgcgccaagaggaaaggaaagtgcggcggccctggaacctggatatcgcgcgaggcaagctgcgcgcgggcgggcgggctatggcgcaggcgggttgtggggccggcgctggtggcggggcccggtgcatggcggtctgtcggcggagtcgccctcgggggctgtcaggttggtggctgcgggaggagtgggccaaccatgcccagggcgggaggccgggcgggcgcaggaccccgggaaggtcccgagcccggcgtgcccacctccctccggccctagcagggcggcctggccgctggaccgcggccgggccccctcccccacccagggtccctgcccctcttttccgccttgcggctcctcccccgtgactcccaaacctcaccccgtgacggcgcccgcctccacccttgtgaccccacaccccacccactgaccccaagacctcaccaggtaaccgttggttattattcattggctgctaacccaggaatttccccagcacttctcagagacccaccaaccagtgactccctcagttttaatccggtgactcacatgaccctgagatccccacactcctccttagtgacccccaaacctgggtaaccctcctggcccagtaacccccccgattctaccttgtgttccccacaaactcggtgactcccctcaaaactctgctggcgactcctaagccctactccaatagttttccacgcactcaccttgtacacaaccctcagtatctttatcctgtagccgtatgaccctcgttccacgtctgcctttatcctaaaatcacccccactggcatctctctctgcgatcccagcccttcagtgtcaatcagcacatgacttacaagcgtccagcacctttctggtgctaaggaggatatagagattaatatgaagtagtaataattggaggcatgagagaattctggatcaatccagaatccagtcaatccagtgtgtggtcccagctctgtcactgctgtgctttagggacctgtgagaagtcccctcctcagtctggacctcagtttctcatcatgactgtgatgaggttgggttagatgatctttgagtttccttccgtctgtgaaattgtgaaattatgcagttctcagtcaagataataattttttgcaatcatttttgtaccccaccctggaaatttcctcttgtaacctcatcccaggatctgcttgcatcatgaaccttactccctcattcccggatcaccctcttcactcttcatagtgcatacccatttcccttgatcaggccccatcagttaacatgtttgcaaagcagtatagcagagtgcttcatttgggggcattgagttcataacaaacctaggttccagtctgattctggcccttcagctatgggacttttggtatattatttagcctgtcttaacttcagtctccacctctgcgaagggagaaaatagtagtgcctgacataacatatgtaaagcaccgggcaccatgcctggctcatgggaacccttagcataagctgttgttagaaatgagaagctgctatggatcttactctgtcctgagtgctagggatttaacagactgaacatgtggcccataccttgcattatgttgctactactgacatcttggaatccctatcttctcatctctgctgtagcctcacttctctggttcttaccctgattttgcctcaataacgattggcttgctgaatacctactgtgtgccaagctctggatatataagttaaatttacgtctcaacagccccaagagttaattattattatatccaccattttcccttcccatatttttgtttggttggttggtttcagagaaatgaaccagaaactctcacagctaagtagcagagctaagatttgaacccacagtttaaaaaaacaaaacaaaaccctactccattgcctgtctttcccccagacttactcaacctcagctccttattccttattttctagtaattcctaaatacaacatcagctcgttccttgatccctaaggtttctgttcttgagctcctagcctcaagagatcctcccaccttagcctctcaagtagttgagattataggcgtgagccaccaagactggccctgacccccaaggtttctattaccgtttgccatgtaacttggtgactttctcatcctgctgttcatgacttttgatctcatatcccctgaagcccctgcaccttgtaggggagggaaaatatcttcttaggttcatggcttaggcccctataacaacagatttaataagagaagattatatacatttatttaatgtaagttttatgtgacaggagccttcataaggaaatgaagacctaaagaaatgattaaacttgtatatttttatactagatctgatgaagagtggatagttgtggaaaaatacaaaaagggtaatatcaaatagtaataaactgggagaaacttagcaaggcctgtttgttcagactcttctctgtgtccctgtgtcttcacagataagggtgcttctttcctctgagtatagggagggcacctctttatgagggtattatgacctgcttcaggggaaagtcagaaaaatccttcctaggttttgtgatctgcttcaggggagaagagcctcagagaaagtgagagtgaccttcctactgccattttctcaagttgccatattttggagtagtgtcttgaacccagtcaacttctctcttcatcctttgcccaaatatctcttgttctatgaatctttgacgcttccagccctttccctgtgaactcactcaccatacagtgtctcccacctcactggcactttaccccaaatcctttcatcttgttaagtcccttagccccaggaatccacaagtctgtatgctctaaaaccatctagcccagttgcctttcatcctattttttagtctcagtgttctactcccaccaccccaccttctgccatcctcagccacattctgtgacctgaaaccttcatataatttgtccttcatttagtgacctcttgatgtgactagcttcaatggaatctgctccttccatcccagcatgaagcaatcctgtataacttgcacaccctcccattctaaggcctctcctctcatacccttgcccagtatcctgtgagatcctgcctctcagattcctccctcaccttttcaaacccggattgtctttcacccttccacagggcctcctcttcctgccttcctcttatttgtcccctcagccatcctcacctcaccaatcttgataattgattacaatataaatctcccttccatctcaggtctgctcctttcttcctccactctcttgtgcatctatctccagggccatgcgtatgcccctgctgctttcagctctgcttccttcatatgctgcactgttccaccaaacttcatcagtctcttcggtttatccagagaactacactcttctctgggaacttctgatgacttctgataatagatcaccaaaggatcttggttttttagagggcagggagagagccctttgaagtccttcagaatcaatctagctgtgtctcctggacaccctcccactatcctatcctgttatgaagctgcttgctgtatatgccctcagagtagaatgctttgggtgtcagcttctgcaggcactgaattagccccatggttttccaagccctgggaaaacttgataatccccaaccactgaagtctgaagagtcagtagcaaaatgtgacatcaaagatccacatccaaaagtctattctgtgggtcaccaaattcccaggtctcttataatgtacttattggctgtgcagcaataaatacagcagaaactaaaactagagttgaggaaagggtataccctgggttctacaactgctgtgggtggattttaaaaaggagttcttgccttagatttgtttacttagggcacagaacttattctgccttgtatttgagttatttgtgtacttttctcaaccccactctgtgagctctgtgagaacagagactaggttttcttttttcttttcttttcgagatggagtcttactctgtcacccaggctggagtgcagtggtgcagtcttggctcactgcaacctcctcctcctgagttcaagtgattctcacacctcagcctcccaagtagctggtgttacaggcgcctgcaaccatgcccagctaatttttgtatttttagtagagacagggtttcaccatgttggccagactgatctctaactcctgacctcaggtgatccactcgcctcagcctcccaaagtgctaggattacaggcatgagccactgcacctggctggttttctttatcttctgtcttcatctcttccctcacatttagcaggtagtcagtacttacctgttggattaaattaactcactcagaaattctgcatcaggtgtacaaaagtaaaagcagttcatgtctacattcattttgtggacacaacacccctccccaaagttctccaaacatgataatgggcatgtcccttgatttaaacgtcggtaatttagacacttccttttttagtcattgctcgggtgggggaatgggtgtaagtgcttttctttttctactgtatttctggtaagataggttgtttgacgcagttgctcaaatacagtggtaacagcatcaggggctgtcttatataaatctgttctcaagaaaacagctagtttgaaatatttagtgtgggttgcagagacgattaaggaacagaggaaaccaaggaggcaaaatgttggtaatttttgaagttggataatgggttcaagaggttcattataccattctttccatttttgtgtatgttggaaatccattataaaaagattaaaggcaggggcagctaggtgaacaagtgcaaatttagcactgttccttggaaaacacctcagagcaaatgagctactgtttctgaatcagtactgttatctaggttaagtagtatatttagtcctaacctttctctgacctcttctgtttgtgagatatcaggatgctaaatttaaaaattagcaccctgcagaattctgtacctagtggcctgggaattgtaacatcctggcatcaagcacctgttgcactgcttctcagcttaggtatggtttctggtggaatagggctggactggacctgagaagagggtgaggcagtaaggaggaaagagggactgagggctggagagagaccagagctctactagggtcttccccttcttgcctaaaggtttcaagttactgggagatcctaaaggtatatatattcattcattcactgattcattcatcccacaaatatttggtgaatatctgctgtgtgccaggtacttttctaggtactgggaatagagcagtgagctcactgtttgaggaatggacagggtagagacagacaataaacaaataagtaaaatatatattgagaaaattaagcagagaagggagatagaaagtgccaggagtaggccaggtgcagtggcacacacctgtaatcccagcactttgggaggctgggttgggtagataacatgaggccaggagtttgagaccagcctggccaacatggcgaaaccccagctctactaaaaatacaaaaattagccaggcgtggtggcaggcacctgtaatcccagctactcgggaggctgaggcacgagaatcacttcaacccaggaggcagaggttgcagtgagctgagatcacgctgctgcactccagcctgggcgacagagcgagactctgtctcaaaaaaaaaaaaaaaagaagaagaagaagaagaaaatgccaggattctgggtgttaaaattttaaatagggtagttgaagaggttcccactaaaaaggtaacatttgagcaaagacctgaaggaagttagggggtaagtcaagcatacatctaggggaagtttattccagtcaggaagaacagcaaacacaaaggccctgaggcaggaatgtgccctatatattcaagaaacatgaggaagccagccaatacggctgcagtatattagtgagagaagaaatggcagatgttgcggtgggggtgaattgggggcagatcacacaggccactggcttgtagtgtgagttgtgagtgagatggtagccattagagaattctaggcagataaataacatggcctgacatattgaaaaggtcattgtggctgctgtgttgagaataagctataacggggcaaaaatggaaggagagaaactggttaggaggctactacaatagtctaaacaagagaagttggtggcttgaacccaaggtgaagcaatggaaaggtgagaagtggttggcttctggatgtatttggaaaggagccaacaggatttgctgatggactggatgtgatatataaaagaaatagcagttgagggtggctacaattttttttttttttcaagacatctcgctctgtcgcccacggtggagtgcagtggcgtgatctcagctcactgcaacctccgcctcctgggttcaagtgattcttctgcctcagcctcctgagtagctgggactacaggtgcatgccagcgcacccggctaatttttgtatttttagtagagatggggtttcaccatatttgccaggctggtctcaaactcctgaactcgtgatctgcctggctcccacatttttggcctaagtaacaaaatggtaaaattcccatctactgaaattggggagcctggaaggagggcaggttgttagaaggaggagataaggaattcactcttgaacatgtcaagttcgaagtgttttttggatatcaaagtcgagatgttgagtaagcagctggatattcaagtcttttggagcctaggaaatgtctactctcaggaaataaaagaacaccatcacctggcaagagacagcggagtatgggaagaacactggtggtcaggtgttaggccctgctctgccaccaggtagctatgtgatcctttgggactcctctggcaacgcaggcctctgtctcttcatctgcaaaatgactgctttattttattttattgtctatttcttttttttttttttttttttttgagacggagtctcgctcgtcacccaggctgaagtgcagtggcgccatctcggctcactgcaagctctgcctcccgggttcacgccattctcctgcctcagcctcctgagtagctgggactacaggtgcccaccaccgcgcccggctaatttttgtatttttagtagagacggggtttcaccgtgttaaccaggatggtctctatctcctgactttgtgatccgcccgccttggcctcccaaagtgctgggattacaggcttgagccactgcatccggccccttatctgtttctttgacaaggtcttgttctgtcacccaggctggagtgcagtggcgcaatcatggaggctcactgcagcagtgacctctccagctcaatcagtcctcccatgtcagcctcctgagtagctgggactacagagatgggcaccaccacgcctagctaatttttgtatttttggtagagagggtttcaccatgctgcccaggctggtcctgaactcctgggctcaagcctccacctgcctcggtctcccaaggtgctgggattacaggcatgagtcaccacacccagccaaaatgaccactttagactaggaatgagttgtgttctcagcccctcctattgtgggagttgatgaattaagtgcttagaataaacatgataatatatgtgtatctgagagcattttggaaactgctgagttctacaccaggtagtggtattggcaataagatttcttccttcattcgctgaagtaatacccagtgagtgcctgccatgtggtgggcactatgtcacatgaggatacgatgatggagaagacgaatctgtgccctcagggagcaccgcagacaaccccctgttgtggcttcactgccaagtgcagacgaaacatggggctggagtgtgacattagccagggaaagcttgttcctgatctgggtctccgtggaaacagtgaacgtgcatgtcaaagatgaggcaagatggtaatcccgatgagggaaaagtcatccacttagctggactagggaagagttgggagtggttgggaagggttggagtggtgggggcttcagttccttccctcctccattctttcgttcaacatttacttccttgccaggagcttctcttagaagctcacagttctgtggtagatgaagagtttcatatctggtctcaggagttcaacttagatattacaataagcagaactgaatcaggattcaaatctgagctaaagagctcagttagctatgtaacctagtagtattaatcatttggtatctgtgggcacattctttgttaggtgctaattaggctgaaaggcatgctctccaggaacttaaattataatcactgtaacagaaagtaagaatgttattttcccctaaaagagtcaggtgttaaggaaaacacactccgtggcagtgtaaccctttaactgcatctggaaactgtccctgtggctgtgtttattcttgtgtcatttagatgtctacgtttatatcgtgaggagagtctctttgaccagataagagtataagatatagctcatcctaattgacaaaattagtcacccacaaaattagtttagaggagacatagtcaacatctaccacgtaatggaatggggaaattttgtcctggagagtgaaaaaagaaaaaacaaacaaacaaaaaaaacgaaacctggccgggcgtagtggctcacacctgtaatccgcactttgggaggctgagatgggcagatcacgaagtcaggaattcaagaccagcctggccaacatggtgaaaccccatctctactaaaaatacaaaaattagctgggcatggtggcgtgcaggagaattgcttgaaccaggacccaggaggcggaggttgcagtgagccaagatcgcaccattgctctccagcctgggctatagaacaagacttcatctcaaaaagagagaaaaaaaaaaaaaaaaccacctgcaatacaaatccaagtgcagctgaagccattgtctttaacagatggccctaacctgttttgagtgctgtttcctaaagctgccaacaaacttcaaatgccttttaccctggcagctatcagtcaagatatagaaatgtgatggtctcacaaatcctatgcaattgtctcttttgctggcaaaagtatgaggccagccgggtgtggtggctcatgtctgtaatcccagcactttgggaggctgaggcgggtggttcacctgaggtcaggagttcgagaccagcttggcaaacatggtaaaaccccatctctactaaaaatacaaaaatttgccaggcatggtggcaggcgcctgtagtcccagccactggggaggctgaggcaggaaaatagcttgaacctgggaggcggaggttgtggtgagctaagatcatgccattgcactccagcctgggcgacagagcgagactctgtctcaaaaaaaaaaaaaaaaaaaaaaatgtatgaggcgtactcaggctcctctcttccagttcagaatcagaaggatttgtgatgttggacaggtcattcggggtctcaggctcattatactgtcattacctggaagccagagtgcctcttttctagtgcctctatttgacattcccttagagctggccctctggtgaatagttcatccctaagaaggccagatacaacttgttaccctggtactatctcacttcatcacttcatttgttgggagttcctgctacttttggatggttgataaagcatgagacccatacagttaagataagaaccaaggaactgggagctctttgaggttgtagaactgacttgaggctttgatgttggggatttggcaggggtgcctaagaccagagttctttctctgagatcatcttctcaacccaggaaatactgtcctgtggccacatggagcaatgaaggggaaaggtagaccctgcttaggccaccacttcgtccagacccacccttgtgaccaggctggggacacacatgttgaagccaccatgtcctcaggtcctgtatagacttgctgttgcctcatgctcagctgatcagctttccatatgatgttatagaatggcctccatgaatcacgaagctcagttttcggatgtgcttttgctgtagatcagtaacatggaatccatcatatcaacactggactctccattcctcatgtatggagaatcatagatattcctgtaaccaacaaagggagtacaaagcatgcatttagactttctatttttaattttttatttatgttgcgtaggtaacacattctcaaggctttttttatttttatttttttattgagaccaagtcttgctctgtcgcccaagctggaatgcagtggtgcaatcttggctcacagcaacctctgcctcctgggttcaagtgattctccagcctcagcctcccaagtagctgggcctacaggcacgtgccaccatgcccagctaatttttgtatttttagtagagatggggtttcactatgttggccaggctggtctcaaactcctgaccttgtgatctgcctgccttggcctcccaaagtactgattataggcatgagccactgcacccagccatttgtttttcgtggagtataaaagatattccctgaaaagtcgcccttccatcgtcatcaccactcagtcatccttccacaggcaaccctggttagtaattttaataatttcttgactatccttccacagattttgtttgtttgtttgagatggagtctcgccctgtcaccaggctggagtgcagtggcgcaatctcggctcactgcagccacctcctggattcaagcgattctcttgcctctgcctcccgagtagctgggactacaggtgtgtgccaccatgcccagctaattttttgtatttttagtagagatggggtttcaccatgttggccaggatggtctagatctcttgacctggtgatccgactgcttcagcctcccaaagtgctgggattacaggtgtgagccaccgcacccagcccacagattttttaatgccaatgacattacataaaaagcactgttgaacccgggaggcagaggttgcagtgagccaagatcacaccactgcactcctgcctaggcgacagagcaagacttcgtctcataaataaataaatggcactgtttttacctagccatttttttcattatgttttggagatcttgccatgtcaatatgtaaggagcttcctcatttatgtctacgtagtatggaagtttgatattgatggacatttatgctgtttctaagtttttgcttttattacatgcagagatgccatagataaccttggacatgtgccattttcacgcatgtccatctacctgtagactagatgtgaaattgctgggtcagataatatgtacatttgtaattttggttgctattgtcaaactctcctccatagagattttgccaatatgttctcccaccaccagcaatgtatgactgtgcctgtttctccacagcctcatggacattgctttgagttaagaatatagcagattctgctgcacagtggctcacgcctgtaatcccaatactttgggaggccaaggcgggcagatcacctgaggtcaggagttagagatcagcctggccagtatggccaaaccccgtctctactaaaaatacaaaaaatttcccgggggtgatggctcgtgtctgtagtctcagctacttgggaggctgaggcaggagaatcacttgaaccctggaggtggaggttgcagtgagctgagattgcaccactgcactccagcctgggcgacagagcgagactccgtctcaaaaaaaaaaaaaaagaaaaaaatatatatatagcagattccctgaagatcaacataggatactgaatcatggggtcccactgtgacactattccacaagacaaacaaaacacggcacatcccagtttgaagaatacagccaggcacagtggctgatgcctataattctagcactttgttgaggctaaggtgggaggatcacttgatcctgggagatcaagaccagcctgggcaacataataagacctcatctctacaaaaatttaaaaatttaaaaaaagaaaaattagctgggcatggtggcacgcacctgtagttccacctactcgggaggctgaggtgggaggatcgtttgagcccaggagatcaaggctgcagtgggctatgatcatgccactgcactccagcctggacagcagagcgagaccctttctcaaagcaacaacaacaacaaaaacagtttgaagactactgcattaaaaatatatccaccaggcaaggtggctcatacttgttaatctcagcactttgggaggctgaggtgagacgatcacttgaggccaggagttcaagaccagcctgggcaacatagcaagaccccatctctacaaaaataagtaaatagagatagatgtaagtaaataaataaattagccaggcttggtagtgcacacctgtagtcccagatatttgagagtctcaggcaagaagattactttagtctaggagttcaaggttgcagtgagctatgatcatgccgttgcacttgtagtgtgggtgacagagcaagaccctgtttctgtgtgtgtgtgtgtgtgtgtatgtatatgcacatatatatatccaagaggtagttggacttctggtagttaaaggaagaaaacttcttaaggcagttctccaccttggtgtttatgccagcatgaattagaaaagaagtagattgatgtttttcattttcttttgagacagggtcttgctttgtcacacaggttgaagtgcagtggcacaatcatggctctccaaagcctcaacttcctgggcttgaatgttcctcccacttcagcccccgagtagctgggaccacagccatgtgccaccatgcctggcaattatttttgtagagacggtgtctgcacctgacctcagcctcacattgatttttttaagacggtgtctcggctgggcatggtggctcatgcctgtaatcccagcactttgggaggctaaggtaggtggatcacttgaggtcaggcgttcgagaccagccaggccaacatggcgaaaccctgtctgtactaaaaatacaaaaacattagccgggcctggtggcgcgcacctgtaatcccagctactctggaggctggggcaggagaatcgcttgaacccaggaagtggaggttgcaatgagctgagctcgcaccactgcactctagcctgggcaacagagtgagactctgtctcagaaaaaaaacaaaaaacaaaaaacaaaaaaaaaacgagtctcactctgttgcccagtgaactctggagtgcagtggtgtgatctcagctcactgccacctccacctcccaggttcaagcgattatcttgcctcagcctcctgagtagctgggattgcaggcgtgcaccaccacacctggctaattttcgtatttttagtagagatggggtttcgccatgttggccagggtgatctcgaactcctgacctctaatgatctgcctgcctcagcctcccagtgtgctggggttataggcgtgagccactgcacctggccagacattgatttttaaagcccaagtcagggccaggcacaatggctcacacctataatcccagtacattgggaggccaacgcaggcagatcatgaggtcaggagttcaagaccagcctgactaacatggtgaaaccccatctctactaaaaatacaaaaatcagatgggcatggtggtgcatgcctgtaatcccagctactcaggaggctgaggcaggagaattgcttgaacccgggagactccatctcacaaaaaaaaaaaaaaaaagaaatgggggtctcactatgttgcccaggctggtctcaaactcctgggctcaagggatcctcccacctcagcctcccaaagtgctgggatttcttttaaatggcgcttcttcttttaaaaagaagaaaaaaaaaattgaagaaaaaaagcaatatgctttatgcaaagatgtgttttagctgtttaaaacttatgttagtgcaagtttgtgttactaatttcctgttttctcttcagtgtttagaaacccacagaaccaggcctgttcactaggtttttctgcgtgtagtgaagtatttttctataataaacattgaatcattttactgcaacttttccaaatctggttctgatttgtttgccactcatcttcatcagccttcatccctcccaaactaatgtgtcttttttctcatgagaagttttctatgtttacaaatgaagaagtttctaagtgaagattaagtcataattatttttgctaatcaaaattgaacattcttttcaggcaaatgtttttgttgttgttttctttttttggcttctaaatacagttgccctctgggctggctgaggcagagtacagaaagccttgttccaactgtccagagttctggttggcagaagacaatagaatagcgaacaggtgcctgtagtcagcacagcccagcttgtgtgtggagcgcagtaggtctcaaccatgataaagtggaaaaacacaaaaaccatggctactctttagtttcctatctttcacatcccttatttttctcctttgaggaggcagtttaagcacatcttgattcatggagagacctaaagatccaaagtatctaaaaagttgggagtagtggcacacacctatagtcccagccactcaggaggctaaggcaagaggatcgcttgagcccaggaggttgagtttacaggagctatgatcactgcatgccaacctgggcaacaaaatgagatcctgtctctaaataaataaaaggtttttctaaatgttctctctcctcaataattacaatttatgttttaacattaagaaacacatcgatatattgcaaaggtgaagggttgttttcctgcatcaggaccagtaatgggttaagtttatttaaaagtgcagcaggccgggtgcagtggctcacgcctgtaatcccagcattttgggaggccaaggtgggcggatcaagaggtcaggagttcgagatcagcctaaccaacatggtgaaaccccgtctctactaaaaatacaaaaaaattagccgggcgtggtggtgcatgcctgtaatcccagctgctcacgaggctgaggcaggagaattacttgaacccaggaggcggaggttgcagtgagccgagattgtgtcattgcactccagcgtgggcgtgagagcaagactccatctcaaaaaaaaaaagaaaaaaaattgcagcaaacagaactggatttgctcctagttctgggagagtcaagagtgctcccttctgtcttcactcttttctcaccttccgctctcccagtctgtctctcccctatacacagctcaggtcattgcagagctagtaaaccttatatcctacaaggagaaaacagagcagccaccctcactgcccctctgccctgtctcggagggctgcaggagtaatgagtctgaaccggcaagtgcaggcagaactcacacatagccatcctgaagcagtaacaagcctttctttggctctgcccatgtcattgttgttagttcagtgccagcatgggaggattcagagtaaaccatcattgaaagaaagtacagggagaaaaatggcaatcagggcactggtagatgcctagcagccacaaagcttcctcctcaccctctgcagtcaggctcttttggaaggcagcttcagagattgggaaaggtcagggaacaacagtagcctcttttaaaggtttgtattacgagacttaggaaggaaacgtgaatgagttgaggttatttagcctgtacgcgagaacatgaaaaggagtggaaatttgttttctttgagtctaagaagggttattttgggaagtgtggctaccagctattccctttttccattgcgggtaggccaagaaggtctgggtttaagttacagtgggtgagatggaagttaacccgtattcaagtgttttgagtgctgacggtgtgccagtcacagtgaattagcagaaggaagaagtgcgccagatattgagaagtatgggctctggggccagccagcctggctttgaattctggcttcaacacatagtagtgttggaaccttggacaaggtactatacctctaagcctcagttgcctcatctgtaaaatgggtataatatacctacttcctcatcagttatttttaagattaagagttaatataggtaaggtgctttaaaaagtggctggtatatattaatcacatttatatgtgataaaaataaatattagcatgagcagtagaaaggatcttagggtaatttgggccagcatttcattttacagataaagaggcagacatagagatagaatcgagattagaagccaattctgtagacttctagtccagggtggttgccactagtcctagctgttttaggacttcgtattgcttcaaaagcatttccctttaggttcctcttccttcccctcctcctgatagctggtatttctagagtacaggcatatgtgccctcatttaatcccttacagcaggctatgaagcaagtgccactattatccccattttctcagaagtgacatctgaggctcagagagcctgcccaaggctacacagaagttcagcctggattaaaacccagacctgacttcagagcctgtgctcttaaccacaccactgattttccttagaaagtcccagtggagtgcagttgtgctcagttaaaccatgtgagtatttgacagaggtgagctgcaggagccacagggcccagggagtctgaggatattttgcaatcccttttcaacctatatctgctttgtttttatttttatttatttatttatgggtttttttttttttttttgagacaagagttttgctgttgttgcccaggctagagtgcagtgatgcaattttggctcactgcaacctccgcctcctgggtccaagcaattctcctgcctcagcctcccaagtagctaggcatgtgctaccacacctggctaatttttgtattttttttttttttttagcagaggcggggtttcaccatgttggtcaggctggtctcgaactcctgatctcaagtgatccgcccacttcggcctcccaaagtgctgggattacaggcatgagccaccgtgcccagcctgctttgtttttagacctggtttctcttatgtgtcttctgacacagtgcagttacactaaagcgggttacccaaagaatctacctgatgaagagagtgaagcttgaaggtcagagcagaccaagagaggccaggagcagagctcttgtgagacagggaccacgtggaggttatcagggctctgggcaaggatgctaatagaccagagatgtcagatgtcagaatccccaccttgaccagtggttattcaccattaatccctatcagaccctgatgacagccttggatttccctctctcctggaaaatgcaaaggctcacacaccaaaaaagtattttggagtagcttcaagtttcataaacccccagcttcacctctgtgcttcgcagcatagtaattaaggtcacactctggattaaatggcctagggtgaaatcctcctttactagttagctgtgtaaccttgagcaagttacttaacttggtcttgggcctccagttccctcacttttaaatgaggataatcatagcatttgattgtaggattgttagaactaaatgagttaatgtatgtgacattcctagcacgtggttaactctatagtagtgttcactatataatagtattgctgcccttgcaccttagcccatttagtaaatgtttatggacagaatgaatgaataattctagttgagatgccatgcctggggtagagcattccaatcagcgtgtcgcagttggtctataggtttttttgggtttttcgtttgtttgtttttgagacggagtctcactctgtcgcccaggctggagtgcagtggtgcagtcttggctcactgcaagctccgcctcccaggtttacgccattcttctgccttagcctcccgagtagctggaactacaggcgccctccacgcccggctaattttttgtatttttagtagagacagggtttcaccctgttagtcaggatggtctggatctcctgaccttgtgatctgcccgcctcaacttctcaaagtgctgggattacaggtgtgagccaccacgcccagccagtttttgttttgtttttttctttttttttgagacggagtttcgctgttgttgcccaggctggagtgcaatgacacgatctcggctcaccgcaacctctgcctcccaggttcaagcaattctcctgcctcagcctcccaagtagctgggattacaggcatgtgccaccatgcccagctaattttgtatttttagtagagacggggcttctccatgttagtcaggctggtctcgaactcctggatggtctataattttgccaagatattgatccgctcgcccctcagggctgtcaaagccccagttggtcgcttctggcttgaagcagtgacatctgcaatgtgaacttctgactttaagcagcagcatctgcaatgcaatgtacaaatatctgtctctctaggtcccctgacatgaaaacagtttgggtagcaccagtcaaagatatcggttggtaagtcgtgagaatccagtaggcagtccagattccaagtccaggagaattttgagaatggatgtcaaagagagtcttcacgactgcactgagtttagaggccgtgggcttcctgcaggcttcacaagtgttggggtccactgctagagcaggctgcacaccacagtgggtacagaagatatcctgccagcaggaagcttcagtgcttcccaccttgcacatgagggacccagggagtcactcacaggatgtgtggagagcccacagtgtgagttgctggagaaaccactgtgacgcagaaaccaggctagagcccaaagccttgtgtaggcaacggacattaaacagatagtgatgagtactgaagtaggttgagcccagaggtgtgagtgctaggaaaaggtggtacctaggctgtgggagtttataacaacccagccttgtatgcaaggtggactctaagagctgtaggaaactatggaagggttttagtcaaggaagtggtatgtttagatttatactctttttttcttataaatctacttttatttatttacttttcattagcttaagtccttgaggggcacagcgtcacacagattctgtgttcaatagctttagcaagattgcttgggaatttagcacaaaccatgccactgtttccatgggcctgagtttacctttccccagattatgctggttttcttcagtttgctgccagcagtcagtgtgttgttctttgctttatacatgtaagtacatctcttgcctaaatagaattcagtttcatttcgagcataaataccttcaatttttttttttttttttttttttttttgggacggagtctcgctctgtcgcccaggctggagtgcagtggcgcgatcttggctcattgcaagctccacctcccaggttcatgccattctcctgcctcagcctcccaagtagctgggactacaggtgcccaccaccacgcccggctaattttttgtatttttagtagagatgggttttcaccatgttagccaggatggtctcaatctcctgacctcgtgatccactgtcctcggcctcccaaagtgctgggattatagtcgtgagccaccgcacttggccaatacctcaattttaataagagctgtgtcctcgctttggttctggaggccccacttacagctagcaaaaaatggccttggactacagccttccaaatgtattgtatttatcttattattatttttgagacagagtctctttatcacccaggctggaattcagtggtatgatcaaagcttactgcagtttcaaattcctggggtcaggcagtgctcccacctcagcctcttgtgtagctaggattgcaggcatgtgccactacacctggctaattttttttttttttgtagagacaatgtcttgctgtgttgcccacattggtcttgaactcctagcctcaaataatcctcctgcctcagcctcccaaagcactgggattacaggcatgagccactacaccctgcccatatttgccttttggaagtcctgttctcagcaggcctctacaggctccaagatagtgggaagagagctttttttttaaattcaccctgacagcataaacatgaatgttagaacatgagttggaagaggctgaggcaggaagatcacttgagcccaggagttcgaggttacagtgaactgtgatggagccactgcactccagctgggcgacagagtgatactttgtctctaaaaaaggaaagaaaagaaaatgaattggaaacagacaaaagtttatctgaggacataagttataaggctccttatagttgtccagaggtgaaaggtgagacatgcctgaaataagtacctggacttttaagggaaaaggaggactcaagcatgatcccccccccccccgccctgaagttctgggtggaaggcgataccacccctgggataggggatactggaagtacaatagttctggaaggttgggacacattgtgagttctgttgaggacttattccacgtgtggtacatgtgggatgttccctgaggatggttaacaagctcagtagataaatgggtccgagcacaggagagatgttggagtaggcagagagaaccatcagcagtggggttaactgcctgccttcagcagggctccttcctaaggggagaaagtttagaaatgggttttgatcagtgatttcttactttatgaccagtttgattggcatgcttctcttctatgcttaacttttagaattcttagataatgtgtattttgagcccttttcataaaaaccaatatagttcactactttgaagaattcatcttttttcttcttggctggctggcctcattaactccttccctgagtgtctttgcgataggagaaagctggttaactcataatgtgatactgtttattttcttagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggtaagtatttctggggacctcaggatcctgccctgtccctcagcctctggaaaggagtgtccatttctaagagtcccaccatcaccttgccctcccgcctgcttacccttgcccaccaccacaatttgctctgcattagaatctcctgtggtgcttgatgaaaagggaactctaaaataaaatgctacaagtcagacaatcccagtcataggaaccaatacctctcaaagacagaattcctaatatgtaataagcagttgataaatatttctggaatgaacacagtgttagttatgactccctgcttttcagatatcccctgtcacagttttttagtgctttctagaagcagtttatcatcttaattcaagtatattcaaacattcaaactactaagcatctgccatgtacaagatgctcttttaagccaggcatagtggctcatgtctataatcccagcactcagaaggctgagatggaaagatcacttgaggccgggagttggagaccagcctgggcaacatagcaagactcttgtctctaaaaaaaataataaaaataataatctgggtgcagcagcatgcacctttagtcccagctattcaggaggctgaggcagaaggatcactgaaacccaggagtttgagggttcagtgaactatcactgcaccactgcacaccagcctgggtgacagagcaagatcccatctcttaaaaaaaaaaaaaaaaaaagatactcttcctgattcagagaggaacacccaagcagagatctcatgccctaatccccactaggggatgccagaattgaaaatataggacatgtagttaaatttgaattggacgtaacaatgaatactcttgtaggatacatacatcccaaatgttgtagggacgtatgtatactacatactagggacatacatataccccttataagggatagacatatataaatgtgggattaagctgggcttggtggcatgcacctgtagtctcagctacttgggaggttcagatgggaggatctcttgaggccataagtttgaggtcagcctagacaacagcaagaccccatctaaaaaaaaagtagggggtgttaaatactataaaatactaaaataataataccaagttctaaaaaaaaaaaaaaaagtattgtttatctgaaattcagatttacctgggcatcctgtattttatctggcaattctatccttacactgaaggtacttaaaatcaaggtaggtgtggagtcagaataaagtgtttagggcaaggcctgcaggccagggacacttttcctttcttgccagtgttctcaggcagccagatagcattcgtgtcttccttggacagcaccttgaacaaggcaaatactgccttgttcctactgttcatttggcgttttctggactccatgattgtcactgtcctcatgaagcactgtcattgcaacattgccctcctttatttcaacacactctcagaatatatttctgctcctaagtttacagataagttgtttattgatttcattttaagttgtctgtttcctgatgatgactaaggagtccccttaatctcatcagtaagcactttccatatgacagtgtgtgggggtcccttctggaaaggtttcttgtcaagagctgtctgtgacatgtgggttcttgttgggttcatcttcttgagaacgcaacttctctagaatgcttttgaagcctgaaactctctgtttgcagacttcccactccaggtcttgcccctccagtgcagtctccatgggatggaagaacttagaactctagctagggttgtgtttactccttggacccagttagttcccgtgcctcagtcttccactgagaattaatggtcaaacaaatgaataaaaagcaagtgaccacacctgacctgagagagccactctttccttatatctatccttcttacgtatttctttattctgtcagtcttcctggctgttctttgcccactctgtagtgttgcagtgtgcacttacacacacacatatgcaaacacacactcactcacaacagattttccctctgctcagggtagagctctccttcagagaccagaaccacactttcctgaaaggcttctctgacttctcctctgaagcttttgactgaggcatttttgtctctgtctgctggaagccctaaaattgtaagagacttatctttaattaggatgagtataaaatgtattattcaaacccagcattttaaaagtggaagaatgtgctattaataaatgcactaggactgttccaggcaaactggggcgtatggtcacctctctgtaatgggatatgaggcccttgtcagtcagctgttctccccactgcctctctccattgtagtctctggttgtttgaggaaatagtaggctaagttttttcttcagacaactcttctcaacattttgttttctaccttgaagcagtacccactctgctggccgtagcttgctgatgctttcagaaccccaagtactgatgcccttgccaggacagataaattgttaaaatgagggtagcctactgctctgtgggtgggagggaagaaaatgggttcatcttccccccatctcagctgcctttcctatttcttacctttatctccaccttacctgcctttggttagttgtaggactgttagttactgaccccaagaagactcagtttgggagcaagtttggggattcctctaaaggggagacgtcagcagagacttgggctggaagtaactgtctttcccacctgagcgctcagtttcctaaacctcaatcttctaaggaaaggacaaatcacttgtcattaactttttttttattttttcttcctttttttttttgagacggagtctcaccctgtagcccaggctggagtgcagtggcgtgatctcggctcactgcaaccttcgcctcccgggttcaagcgattctcctgcctcagcctcccgagtagctgggactataggcatgtgccatcacgcctggttaatttttttgtatttttagtagagacacggtttcatgatgttggctagactggtctcgaactcccgacctcaggttatccgcctgcctcagcctcccaaagtgctgggattataagtgtgagccaccacacccagccttacttttttgttttttctttttgagacaggacctcactctgtcacccaggctagagtgcagtggtacaatctcagctcactgcaacctccgcctcccgggttcaagtgattctcctgcctcagccttccgagtagctgggacgacaggtacctgcctccacacccagctaatttttttgtatttttagtagagacagggtttcaccatgttggttaggctggtctcaaactcctgacctcaggtgatctgctcgccttggcctcccaaagtgctgggattacagatgtaagccaccgtgcccagcctttttatttatttattttttatttttttcagacagggtcttactctgtcacccaggctggactgcagtggcataatcacggcttactgcaacttctgcctcctgggctcaagcaatcctcccacctcagcctcccgagtaactgggaccacaggcatgcactactacatccagttaatttttgtgttttttgtagagacagggttttgtcacatagctcaggctggtctcaaactcctgagctcaagcgatccacccgccttggcctcccaaagtgttgggattataggcatgagccaccgaatctgaccatcattaactcttcaatctccctttctttcctttctcatttctcttcttccttccccctctgtcagactcactggacacaaggaagggtcgtctagttctaatttcaagagccttattagaagtgctttccagtaaggtaaaggaagagtaatatcttaggaaatctggaggcttgttaatttttatgctgcttgttgtgttgccttaggtgatctaattttttactagaaaattgaaatgaaaaatgagaggtcaatgaaggaacattactcaacagtggcagtggaataagaccttcatggacacataatagcataatagttgtgctcacatagttctctattgctttactttccatttcttctaaaatgcatattgggcttataataaaagctaggatttattgagggctgaccatatatacctggcactcttcccagttttttatattcgttaactcatttaaccctaacagcaaccctataagagacacagttttcaatccccattttaagaaaaggaaactgaggcacagagaggttagttaaataagctgtccaaggtcacacagctgttaagaggtagagctggaattcaaactctggaggcctggcctggttccagagtctattgtttttaaccattaagctatatatcctgccttcacaggggctcctggtcttagcacactgtcatagtgagggatgaggggatatgttttgattttgttagtttgagctatatctgaattttgacccactggggctcatccaggtttaagggccattagttcaagtctcagcaacttactattaggttggaagtttccacttggctgggcatgggtagaataataagtgaagttattcctcctgttagtaactggaagggaatctgttgggaggtgatgggttccggcaaggcaagtgtcttcacccttagtgtctcaaggcccaggcccagggagacagagcaagggaacaaggaagatgttacccatgcttagacctgcaggctcgtgcctagagactcaaataagcctcagctaaaaacaggcaggcgtttcttagccctcttctggtcctggcccatttctctctatttccactcttaacaggagagaagcttcttgaagggcaggtgatccagctcgaggatgggaccaccgcatacattcaccaggtgacggtacagaaaggtgagggcaccccaacacaccatgccttgtcgagggaagcctgacagcccccaccaagggacccctccatggcactgagctccagggaaaggcaggcattgctctcgttacagaagctctctcctttgaggatggtcagcctgtgcagctggaagatggcagcatggcttacatacaccgcacacccagaggtagggtcaccatcatcacaactcggggaaggatgggaggcaggactggaggatggggtggcaggactggaggatgggatggcacacaactggggtgtagacatgggagctgtcatctccatggtacacacatgctcacctggattagcagccttgcccaccttccctggtgcagaccacaggagcagctatgtctgcaactgggaggtgagccttggagatcagtgacgtggactttgatggtggccttggctccagcacagccacaaagtcttagggctttaaataggacccgaggatatcatccaagaccaggaaaaaaaactaatattttagaatgaagctcctaaggtgctgaagaataacaatttattccttccgcaggtggtttcttgagtgactgttgcatgcctggcgttgtgttaggtgtgcagtatacaagacagaacaaagtcagacacagtccccgctctcctagagtctagagggggaaacagaagtgaaacaagccatcagtgatgaactgatcattacaaacagagatcaggctcagggagggcttctctgaggtagtgatgcttgagctgagaggtaaagaatgaggtagacttagctgggggaagagggatggcagggagggttcagtacttcaggcagaaggaatagcatgtgcaggcctagagctggggggaagaaagaacagcacattccaggaactgctaggagctagagccctgggagtgaaggcagaatgagcaggaggaaactggagagagaaagacagggctggtgcactctgggtttgagtgtcagggtgaggattttggtctttatcctgagaccagtgggaagcatttaaactgttgaggcagttaagtgacatggtcacatttgtgtcccgcaaagatccctctggatgttgtgctgcctggagggaactagagggggtgaggagcgactggtcaggaggctattgtggtcatctaagccaaaatgatgatgggcccctgtcaggtcctcaaggagcttgtgagttcccatttagtgtaccataggagacctcatccttaggtgagacagctgcagaaggagggccagcaagagtgaatcacaaagtgaagggccatgagaaattggatgttgaaaccctccttggtatatgtatctctcattaacttaaagctagggtcccagctgtatctcttccccttgtgtggcatcagggctaaccgcgtgttccctgcagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggtgagcacgcacagcgtgacacggtctgtcactctagacaaccgggcctggcctgcgcactgcctcttggccctgccagaacttcacctctcaagaggacaagggcagccctgtgcttgggcaccatgtgggatattccctttgcccctccaccccagctcccccaactcacctgtcacacatcattgtctagggcatgcaacacagcctggcctggccgctgacagctgtttacgctcacttttgtttacgctgtctttgcagagggaaagctgccataagaaacagtggcatccttatgctgaggagttaggcccagcttcactttggctgctgtagtaatcctctgcactagctgggaaagccctgccagtgacttgtattagctttctagtccactgaggtaattgtatttatttcttctctgtgactcagtcatttggaaaattaacctcagtgggctatgacaagggcatgtgcaacagaacagctgggattcctggattatgaggcccacacagtagctcagctggaaaggaaaagggtcctggctctgcaaataccagtcagtccaagttctttctgccgaaaccatggtcctgcatgtggggaaaagggtacagacatctctgagctttccaaaccagggtgttcccttcctggaatgactacagagcctcaggctggatgtgccagggcttcctgcacgttccttccttccagcagttttacccgaagatgggggaggttttttatttataatgaaaccagtgtgactgaatgatggaggaaaaaaggaagtcctcatgtcttttcaaaatgaagcacaggccgggagcagaggctcacgcctgtaatcccagcactttgggaggctgaggcaggtggatcgcttgagtccaggagtttgagaccagtctgggcaacatggcgaaacctcatctctacacaaaaatacaaaaacaaattagctgggcatggtggtgcgcacctgtggtcccagctactgggaagcggaggtgggaggatcaggaggcggtgactgcaatgagctgagattgtcccactgcactccagcctgggcaacagagggagaccctatctaaaaaaaaaaaaaaaaaaaaagtcacaaaactttacagtaggctacattcactcccacccaggttccctgaggtatatcttagagaccaaatttgagactcgatgttgatgtaaagagaagtgggttttatttaaatcatgagccctgagatctatgcttgctctacctctacctagtccaaacttgggtgagtccctcctctcctcgacctcagcttattcctaatatgatgagatgggaccagatgatctcagaggtcacttccatccctgatgtcccttgattcccgtgattaccccaggagctagtgagacatggaatgaaatccaagtgcctgtgtgggttagcccgccaagcaggtcaggccacctctgaccctaccctctacccagaagctgtttaagtgtccgtgaagctctcagctgcttgagcctctgagctggagcctaactagacagaccttgccatgaatttggcctcacccctctgtcccctgctcactgtaacttgtagagttcagtttcaggagctcctggaaagaccagagtgtgattctgaagcattctagaaagaaagactaagggatagtcccaccaggaccctgcccaggaaagcagaagagcaataagggctccctgcatccagaggctggtgtgagatgggtggctttagcaatatcccagaagaggagacaaaaggggaggacttgtcagctgggtgctgtcattagagctgacatttctggtggaaactgcagcactcccctgggtgcttctggtcgtggccacctcactctgggccccaagtcctatcagatgaacctaggtgagctcatctccacagcaagcccccttgtttatgtacttttaagcactagtttcgtgccaggaggaaggggacccctcccatcagaagatggaggtcttgagagttgcaggctcctaggtgtgtgtgcttagaaggagggtttctggcacttggtccagttcaagcatggccattcagacaacctcccttttcaccttacctagctgtctatgtgatagcctttcttcaatagccgtcacagccactatgacctgtaggtctccctttatcccatcagagatgggtggtgactccccatgcccaccctgtttcttctgtagcatgccccagcatctgttccttgtccgtctagttatgttcttctgccccagaggcccctgacaggtttaaccctgcctgttgggtcttaagctgccagcagggccctgtgtcccaccttcttcactggggagaatacatatagggatctcaagacttttcccccaggttcttcatgacagccagattccccgtaatggaaaagggcagcaagttggagacagagcattccgctgtggctacaagggctgtgggcgtctctacaccaccgctcatcacttaaaggtaaggttgctggcagacagccgtcagctctgcagtcttccctcccaggctgtaattctacctttctgctttgattggaattggtccctgccctcacgttgctggagggaagaaatgagggtacacaggaatgccagcacagagcgcttgacacacatgaatggtacaggagggaagagaatcagggtcctaaagaaaaccaaagagccctggtcatacccttgctcctctgaattatgtgattgcttgtcctcacaggtgcatgaacgagctcatacaggtgaccgtccatacagatgtgacttccccagctgtggaaaggcctttgccacaggtaacctgcctggtgggctgcttccagttgagggtggagggttctagttctgtttgggacctctctgaagggaacccaacaccaggctgctttcctggagaaactaccgtcagagtactctgacttgcagggtgctctctctggaggaaaccttgttacgggagtgcaaggcagcatggttcaggccagcagaaggagcctggagggttggtggagagacccagcctcttgtgtcagctctgatgccaaccagctgtggattattgggtgggccattgcatctctctgggcttattttcccctctgtgaaactagtacctttagccatgagttctctaagtttcttttcatgctcatgttctggtatggctccaactgctcctggagagggaagcagggcagagtgggcttttccagcccctgcccagggcaggggtgggatagaggcagacatgggcttcttgagccaaaggaggtggagagcctgtgcatgaggtggacggtggaggatgagaccccactgggtgctcatctcaccccctgcctgccacatatggacaggctatggactgaagagccacgttcgtacccacactggtgagaaaccatacaagtgcccagaggagctgtgcagcaaggccttcaagacctcaggagacctgcagaagcatgtccgtacccacactggtatgctgggccctgcccactccaaccccattccctgggcaaaaggaattcagcttgcctttcagacttagacctggagcccagtgccatccccagcttgctccagcatggccctctttcccacacccctcctcacatcccaccatttgcataggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggtgggctagctggcatgcgaggactaccctcactcaggccccaacccctctactgtaggcttcccatctaagacacattcccaactcccagcccagaacccttctgtgccagccattccaggctggtctggcggtagggtatccccagaacaactctgcttgcagtgagtaattcctcaatttccagttaggtccaatctgaaaggtattgccagtcctctctggggtccctcagctccctaccacccctctacacccaccctgagttctccaactctgactgaactcttgaaaagaggccagggtcaggaatgatggggaagaagcagagtgaactgtcaccttcaactcctcaccttatccgccgtccatgactcctgtgtatcctcaccctccccagtgttatgcccctcatccagctttctgtgttgtgtctcagcatgtgtgtcccctctttcccatcacaactgatacttcagtcatccttgcctcttgcctctgctgttcaccattctcaacctcccaccctcaaccttataagccccagtgccccctaccagccccttcactagccccagccttgccctgtcccccgtttcctttccgccttgtctctggattcagtggttcaacacctgtgtcctctctgtgttccactggccatcttccccaaccctgtccattcagagtctcaggtctcagtccctctccctccctctggctctcccttcaccaaccctgtccctcacccctgtccccttagtttcccccttgccagccccagttcccacccccctcacagcccagtgtccccaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccatggcgagctggaggccacggaggagagtgagcaggccctctatgagcagcagcaacttgagggtaaggggagtgggcagagggtgagagtggggacaagccaggcctccccatggcatctggtagcagatgtcagccttggctctcctctcccagccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtacaggccctggagggcagaggtgccatactagctggcactctccactctctctggggactctgggagccctgaagttctgacagccccactgccacccagcttcttgtttaagttttatagacttcagaggctgaggctgaggagaccacatcttgcagcacagcctctcctcctcctgtgcttccagctcagtctctggggcttctagagcacagttagtagtttctctctttacttggaggctgacaggtcctgttcatctgaacaggatatgggatgtccttctcaagagaggcatgttcatatagcagccagaacatggtatggggtctgaaagcctggggtctggtcctactagtgtactagctagctatataacctgacccttgtccgtacccttgctagaaagtacatctgtgctttctagagttgttaggacacaatcaggtggcgaccctgagctggatacaacagggcccagaggcaaagtggtgataaatagaagtagtcagtggaattcttctagtgtggcctctctttgcaaccttggacccattttgtttgcctgtcacccatcccttccaccactatgacatgaaactaataagctgaccttgtctgggagagcaggtatatcttccttagggactttcagacaaccctccactgacactgccagctcatcttcccctcctgttggcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtatgaccaggcggtttgcttggggtttcttattttgtcattcctttccatggggcgggcattaaagtgcagcctaaactagtcaagtcttcttaccaggacaaagattccccacaaaagaaggggtcttccccacagttcctgggccatgagcagctcttacctttaaaagcagttgaatggaggtcaagagacactttctaaatctcaattcaaccctgatttgttgtgcaaccttaggcaaatcacttttccatggacttctgtccattttcaagtgaggggattaaaatatctttggaattttttacagctctgtccttctgtgattcaaaatccctaaattaaattgggctctaagttgggaggaaacccagccttacttagctctgagcctcaggctaattaatctgacccatacggttttatccattctcttctgggttgttcccagcaccttaattggagggatgtttatttggattgtggggagggagagtatactgcaggtggaatggaagacctccttttgtctttcaggtcacaatcattacctctggggctgtggtggctgaggactcaagtgtagcatctcttcgtcatcaacaggtggcactgttggccacagccaacggaacgcacattgcagtgcaggtgagtagagatctgggaggaaaggggatcccacggccagagaagtcaacaaggaataaaggggaattagatgaggatcttgaagagaagggcatctgactcaaaaagagcccatttcagaggacagatccctttcctcctgcatccatgcatctgtctcaggctcgctcttggctgaggcagaatgttgaagcctcttctggccttcaggataactccgatggcagtccacctgtggtccaagcccttcatcattttgtgtctctgtttcttcatctggaaatgaaggaggctgacgtagatgatcaccacggttctcttcagccagtccttcctccgtgagcaagtgggtctctctgaccctggctattccagggccccctggccatgcctagcctaataggactcttcatccgtgaacttcatgtttattggagccctactaagtgctcagcgtgtggcactgggtagatgggggagagtcaaaaaaaaaagtaggccacatattactaacactggaatctagcagggagggtctcactgtctccttccttctgcacccccttccccacagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctggagaaaaggtgcccagcccccaccactcctcagctgccccccaacctctctatggcagagaggcagggagtggccctgtacatagactgctggggattgggtttgatttgttttgtttttttaaattccattttgataatttttttcctgctctgggtggtggtggcacatggatgaatgagtatttaataaaagttccaaatttccacctgggtccctccatcctttcagctctaggcccgggtggcagggttggtcaaatcaggctatcagccctgtctccctggcacaaaccccactcagccttggtgccagagtggtggggctggcctgccagggacacaggtgggaaggaagcccagtataagataaagccctgaggagctgctggtggcttcttgcccacagctgagcaggtgggctccagggtagccaaacaggaccagggtgaccgctgcttccaggctctggctgagtctcaggcctcatgtgattgagctgggggaactcttttcctgccttttcttgtgaaatgtagtcagagcccctccaacccagccacccccaaatcacacagtcagcttctccaagagggcaaagccccaggttagagtgaggctgggggacacctttgccaaggttactgagattcaaggagcagagtctgatgcctctggagctgaagtcttggctctattacccagctctgggggtgcccacctaggtgcctaggactgtgctgtgggatttcaaagccacaatcagaccccactgaaaagtgagttggtgagaccagatcagctccagggggaagaagggatacaggggaaggcacttgatgggaagaagctctgggtttgactctgcctacacaggaacattgcagggattggtggtgcctcttttcctctctctgctgtgatggatatgccccaaccccttcctgcctcctaggattggaaccccctcctctgatccaggcatcctctcccaggatgcctagaaagctcccatttactcttgccaccagctccttgggaagagaggggcgggggcgtgcttccaggcaggaggtattcccagcaccttacttggagggatttttatttggcttagggggtagggggaggtgtcttagaattggcctgagcagatgtcttcaacatctgtgaccaccattcctggtgtgggcgtgtcccagtccttttggacactggatctgaagaaaggaagcactgacatggagggccctgaatcccaagcctgctgctgctgggacccttaaagttgaggtgcaccacaaggctcacccccatgtgtttcaggaagtttccagtgtcttcagggctactggggctagagtgggcagtgctctgagtaccgtttagagccagtgctgaggggatagggagccagcaagtcaagtgccacatcctgacctggagaggtgccctggcccatttccttctccagctttgtgatgttgcctttgtttccttccacttggatggagtcccaccaccatggtaatgttaagtagcaccaaaagctctacccagagcctactatgtgctttacgtccattctcagacattcttacaacacggaggcatttttcctgctttacaaatgaggaaactgctcaaggaggttaagtaacttacccaaggcctcctatgttgaactaggactggacctttactctgtctgaccccaatatcaggatgagcttgctttttccctcagcaagctgcgtctgggagccctggaaggctccagaagcctccgggtctgaggaggcttctaaaagggcctcacatgccccgggagccacgtggatacagaacgagggttcccgctctcagagagttggtccccagttcccatgcagggagtggagcctctgagcactgccagaacaacaggcagggttctcgacagcacagagcctcacgcaatgtgcaggcaggtggtgctctcgctccaccacggcacctctgcggtctctgcagccgtttgcatttcctgaaaccggatcttagtgtcagagccgcccccagccgggcgggcgcctcagccatggccctgcgcaaggaactgctcaagtccatctggtacgcctttaccgcgctggacgtggagaagagtggcaaagtctccaagtcccagctcaaggtgaggggcacccgggacccgggggaggacg

SEQ ID NO: 17017 - DNA, 68667 bp, Human
  misc_feature (1)...(68667): n = A,T,C or G
tcctgtttaaagatgaaaatgaaatatgtgtatatatgtgacatattttacctagcagtgagtagatgcaggaagcatgtaaaatgctttgctgaattcactaacgtcacaaaatattccttaataattgccgcgtttgataggctgaccgtatgctagcacaggaaacaatgcagtggacttgggttggagagaagaattttgacatttggatttttaaaaatcatgtatattgaacccatgaactctcatgtggaacatcagatttactatattttaaacagaaatgccatcactataaaaaccattgcaaatttgtcaatatacttccatttaaaaagccttttcctgcttttattgatttattgattaatttttttttgagacaggatctcactctgtcacccacgatgaagtgcagtggcacaatcgtggcttgcagcctcgacctcctaggctcaggtgatactcttacctcagctacctcccaagtaactgggaatgtaggcttgcaccaccatgtctgacccattttcttgcagaaattgagttttgctatgttgtccagacttgtcttgaactcccagactgaagcaatccgcccacttaggcctcctaaaatgttgggattacagtcatgaaccactgtgctccacctcctttttctccttttcagatagattatgtattctgtaccttttgtgtaactaacttgttattacataaactatattctaaatacattataaattattgtgatcatgatatttatcattgaattaacactgcctaagtagcaattttcacagaaaagataattttaaaagaccaaaatggttattctcttggaagcagttgacataaaataacagaataatacagattaaaattctgttttccaacagctactagtggtaagaaatatagtaagcttctgatttgtagaaaccttagctttctcatctgatgaggtggttaataatattaactctcatatttgctgaaataatataaaatatttaatataaattgtcaattataatgactggcataaggtagaattacaacaaatgctaattatatttgcttgtttgaaaatttaacactctattaaaaggcaaaaaagtgctcacctgcaaatattaatacatgccttctgtttagtccatagaaagcccacaagtaagagattcaaaagtgaaagctatcacttacagaagattaagaatatattgcattgagaagatagggattaaggagttcatcaaaggttttttaaaaaattattttcctgaacatcatttcaagaaagataagcgccaaagacataaatatattctccagagcatgtgcactgcaagttgacaaatgtgtctcttttatagagtttggtgaaggttattcattttatttttcctgtcttgaccagaaaattgtggtttctcatcatgtatgactgcctgcagggtcttctgaataggaaattaccaatgctgaaatttgtatgacttaaataagtgttgaagtgtgggggttgaaaggagatacatatcagagacatccattcagttaatagaactaagtttttgatttgcatagcttatatctagagcattgtgtttcttattttctatattactatcttctctaactatataattagcacagattgaagctataatggatttcaataatagcactactttagaatgatgtatacgtctttaaatcttaagacaagcataggaaatatgtatattcttaaaaaaaggaaaatttttttaaagtttagagttaaaagaaacatgcattttctgttacatttcagattattttagttaaagaatcttctatgctttttttcttcattcttagaagactacctgcaattgtaaagcatgaatcctgtaatacttctgtaaatgaatcactattgcatttataccattagcctctgaacagatttcaagttgctgctgccaactctcgcgagctttgtcagtaacagttgattgttacattcagtaacactgaatgtcagtgcagtccaatttacaggctggagcagcagctgcatcctgcatttccccgaagtattacatgattttcactccttgcaaactttgccatctttgttgcagagaatcgggtaagttgctctgaatttacaccttcgtgtagagatccaagttactgtaaagctcattctgtgggatgagagtgatctcttcatgtgtttgttgtgtccctttggtgctctgtggggaacagttactgaagcttgcaaatgggacagaggaagtgagccagcaggcacatgcatcaaatcttcctattattcagggaacgcagactttgtttatttaactgctgagaaaataatgaatttattcaactctgtataaaggaccatagcacgtgtggaatcactgtgatatatattcttagtgagtttcctaagaaaaaacatttcatactggcttacccttaaatgcattgtttattgaatctctctgtaaaagtaatctttgattagtcttcctttttttttctttttaaatgggataaagttagtagttaacttactttttcctgaacaaaatacttttctcaatcaacattttgtcacctaaaactttaacagtaacaactggcaaatgagaggtctgtttattttatgtaaataaaaacaaaacctgttttctaatttgatttacagtgatttatgagcgtgtcccctttgccctttgtgttcactttttatatgtttgtttaaattgtagcaaaatattttacatttgctattattttactattatagaaatagtaagcaaatgtactttctgctcatcctataatcttgtaaaactattattttgataacatcagttccactttaaccagggaattaaatattaaggattataaaatctatgaatgactaaaagtaaactgaaatgtgatttcattgtttatgatttctatttattatatatttttattttatgagtatgtcttctacatttttatgaatatatttcatgataataaactcaattaggagctcctgtcactagtctgtgtaatgccttccttaatataaactatctcatagttacaataaatacaatgacagtttacttatataagtagttactttgtttaaggataagcgtgagcttttaaagtgtgactttaacatttgaataaaaatcttcagaattttctctggatataaaataaagtagtcttttggatgccaaataaatttctaattgggttatcaaagttctgttttgttctcctaattttttgttgttgttgtttgtttgtattgtcctagttttttaattgtataaatatgtttgggatgtattccatatttcatttctataaaacataagctactaatagctaaacaagtcacatcttatctataaatttggttccttcttcgagtcatttcttgataagtataatatatatttacattgaatattatcttcatttcgatggtttcttgccagcatctgctcattcttaccaaaattagacggtcccagatgttaagagaattgtaattgaaaagatagcaacctaagagaagatttaattttcagagaagactcaagaaatctctctaataaatgttcaaattattcaaacaatgaagtttgcaaatgttcttcctaattgaggacagataaaacatcttaagtttcttatatctaatgtagtgtcttctatatgtatacatgcctaaagcatagctgaagaatccctgaaagacagtgatgtagtctatttataatcagacttcctcaattccccacttcacttagtctgcaacaaaacaagctttttaagtttgatataaagacgtcgttgttccaatttcttcaaatacatttaagagcgcttgttctagatcacattaatattatctagatggctctttctctaccattttaagaggatttatttccaagtagaaataaatatttatttaattgtaactttttaaaagatagggaaattatacacagggaaaatattttgaatatttgcttgaacatcttttaaaaattcttggcttgtcccttattttgaaaatctggttgatattcaagtatcccaaaaaatagctctttatacaaattattttatcacactcacatcttatagtataacatttagtattttttgttaaaatcagctagggaatattaatagtactttcaaaattgaattaaaaatacaaaaaaaaagatttgtcaccttttttatttgaaagttattgttataacagtttagcattttcaaaaattgccagtaaattttcttaattccaaacaaaaactcagttcctcaaaaactcaaattcctcaaaaactcaattcctcaaaaactagaatggtctgaattccaaacaaaaactcctgtctttatttccaatattaaatactattttgataagcaaattgatctaaattcagatacacagctgtatttgtgaaaatgtgccccatttttatgataatgtttatgctactatgttctctcagaatcatgtgagacagtatccaattgcaccagaatttattaaaagaaaaacgatcaaacctgcacgttgtgcacatgtaccctaaaacttaaagtataataataataaaattaaaaaaaagaaaaacgataatgttttgttgaatatcctaatcattaataaaaattttgagatatagactcaatatttttattctattttcatttatttctctttcgattgctcaattacatgataaacatatcaaaatttttaaagtcttttaatggcaaaactacagagtagcatgttagaatagataataccagattataaaaagggcaaagtgatgcttatttaaaaaataaagtactgcaattaaatataaaaacattagcctacaatacactaacagtatatgaacatctgcatatttttatattaaagtacacattaaataatatgtcatatgacactctgcaacaatacatatgagttagcattatattgtcatttttgcaatgaatgcatgcttacaagaattgctttgattgttaccaattacattatttgcaagttgataactcagatatcattatcgaaaaattaaagattttaattcataccatattattatataacaagacctactcagcataaaatataaatatcaacatataataaattttgtattaaatcaagtgacatgggaagatattacaaccatttagatgttatagcaactgtttaacataaacaatgaaacatcacatttcataattacacaaaacacaaatacagttttgtagcaactatagtacttgctttgcaataatataaactgtttgtagaacaagtttgaaaactatcagagaccaaaatttatttcaatttggtgtttggtttctaaagacaaactaatattcaaataaaatcaaggaaaaaatagatggcttttgcattagacttagaagaacattgactgagctaggcaagagggagaatgggtacaaccagggatgatgcaattaatttattaaattgcagcttagaacgaaccgcccaatcagctttgcaccttattcactttttcttcccagaggatgttttcaaaacagaaaataaaaaaatcatactagcactttgtttttctccagatgctctcctgcatttattaaagagaaaaggattagcggttatcagaaagaaaaaagaactgaagcagtagagtgcctctaaaactttgattatgtctgaaatgttattagtgtcaggtaacaggaaactttaagtcattgttatattttacttatttatttactgtgatttatgatacagtcatacaatacataatgatgcttcaatcaataatggtggtcttatacaattataatatagtattttcactgtaccttttctctgtttacatacacatacagttaccattttctaacaattgcctacagtattcaggaacatgttatacagatttgtagcctagatgcaacagcctataccatatagcctaaaggtgtggtaggctatggcatctaagtttgcgtgagtacacttataatgtgtgcacaatgattagatcgcctaacaatgcatttcttagagtgtatccctgtcaataaatggcatatgacaaggatacattatataatagtacctaaattatatataatagtacctaaatatcatgaatgtagaaatgctgctaaaaatatattttaattatgttttattgatcttagcacacatctaattgtaccaaacagaactgaaaaaataataatcttgtggcttgatttttttaaaaccttattattatagcagtcattttatatgtaaatatatatgcatatacatatgaatattgttagaattagatatagaaatagatatatccattaagtatcaagccctgaaccaaatgctccagaccatggattaataaattgagatatttattgggataaaaaatacttgtaggtcactagatatcctatgaccattggtgaattaggctgatttgaaatatgataccctacgtctgggacataggcattagaatagttatttattctctttctttgagaaaatctaaattaaataaacaaagacaaaactaatacaaatgcttagtatttgtaggattcgtttattggttgtgtaggttggatttcagcaacctaattacagcatgagaaaaaataaagggaaggctttgtacattaatggatctttgttattattatgtgaatgagaatcagtatttgtaattgactattttagttatataaacacattagttcttctatggccgggcgcggtggctcatgcctgtaatcccagctctttgggaggccgaggtaagtggatcacttgaggtcaggagttcgagaccagcctggccaacatggtaaaaccccatctctactaaaatacaaaaattacctgggtgtggtgccatacacctgtaatcccagctacttgggaggctgaggcagaagaatcacttgagcccaggaggcagaggttgcagtgagccgagatcacaccactgcactctagcttggcgacagagtgagactccatctcaaaagagacattagttcatttaaatgatatttgcatcacattttgctgtccctctttgtcacagagtttccaaatctgatttttaatttcttttttattgaaaagaaactcacatctgcattatgaatttctgataaaacttagatctcttctaatagtctatgtcatccattaaatattatttcataaatgtcaaatacttatgattttgtaggtcacaaagattatttttgcttctgccatgtggcccaatagtttctaagctttgatcctctaatttcagtcatttttttcattataaaaaatgcaaataattctgactgtgctaacacatttagcttcactagttgcatatactttaatctgttaacaaattgctataacaaatatgaatacatattgagtaatactgagtataaaattcctcttaagccacaatcttctcccagacattataatgctagcccctggttctctctattgacattataaatctggtaaagagtccctcatgtttattaaattttggagaaattacctggaatatatcctcagccttcgctctttattttttccatagcccttactagtggtagcatgtttgttagtttttacaatttgtagaataaatggtgactaccatatatttgttacttaatattctgtgaataaattgtctaaattctcttcagtttgtataataggattgtatagaggaagatgtcacttggcaaaagggaccacagaaaagacaaggaaaacagaaaaggacaataatgacaatctattgatccttaaaagttcttaacctacttaacaattctgccaagaaccagccagtcatgatatttcagagaatatatgaacttgtattttctcctcttaccaaggcagaaattatatctgatgtaggtagactactgtttactgcttttttggtggagctgtacatatagtcagaagtaacattaaatttggctaggacaaacattctatttaaaatactagctcttccttacaaagatttgacaataaatatccctaaaatgaatattttttattttccattccactatttttttttctaaattgaaaactaaaatatctctgttttctattttttcctatgtaggcctttacagaagcaggtttatttgttttcataatttgtagaattactaacgactatattttaggtaattatcatcaataaagtataatatgctatatgcagaaggcttataaaacattatacttacctctctttcagaaatcaatatgcatagcaaagtcacaatcatatgcatcagatttctcttttggtttcttttgctctgcatgcttattgggaagtcacatactgaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagtgcaggagcagcttcagttagcctgcatttgctttctcctggaagccattcattgttcaccagagccattctgcaaagtggatcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacagcttttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggtaagtgctgatttttgtcattgttctctggcttggtttgatccgttttgcttagctttgcttggtctctggggtagactttagtataaagacacagaaatgttttaattatttgttctatttgtaccaaagctggttttattttttcttatgaactgcatttcaactccctgtgtcagagtgtttaaatcatcatcttagaaattttataaaaaatatcttctgatttcatctccaaaatatttcaaagtatttcaacaatgttagccaaagtttttatagaaaaagatgcttagttggagaactaaaattaatgtgagaatactttttaacctgcaagtttacaatgttcacagatttacgtcagagtaggactatttcttcccaagctcttcagcttggtaccatgatacctgatacatgaagtaatgtatctctgcttaggaaattgaagggacatgatggtgatgcagttggccctcagtttacccaaaatatacatttgccattgtattgtttggtttttctttttttcctaataggcctgatcagatttgaggcagcctgtgtttgactggggccatgaggttttagctaagccgttctccacctgagcagtcttatggctgacattagataatcagagacattacaaaaaacatatttcccccatatattataagtattgtgatagtatgtccaaaagagtcagaaaaaataaccatttagaatatattttctaaatatgtatgtgtatctatagaaaataaagtagtttttttttctcccactacatttgtaaaccaaaaccacattttatacatgggagtaaattgcaccaatgtgaataatttaaaaaaaatagaaatttagaaatttacttatacaagaaatgtttacataaatcataagttgattgattcagtaattcagtctatcacactatcttttataactaaacaaaatgccgatagttacattattgctttctggtgttcttttccaccctccatttggaattctttgtatttcatgttactgtatgtatgtttctacaatatcagttgtacaattcttttcaaaatggtttaatacttattcactgtggataaagttataattcttccacctagcattaaaaggcctctgtaatcttgctgcaactcacattactcagtaacaccaggttctgggtaagccagttatctcactaataccaaagattctgagtttaactgcaccttagaactttcttctctcaatgtgccctgtttagaacacctacctctttcctctttaatgacaaagtcctacttttttaaggtcttaatctactacacatctcatgcaacatttctttaattcctagagttgcaattgcttcagacttcttgttcactctcacagaagttgactgtaacttgtctatttcctctttcattgtaagctgttcttcctcaaccatactaaactacgttcttgaaacagaacctgtggttttgatttgatattcattgaagtactatgatgggtatgtatcatatttaacaaatatttggctaatgattgaatgagagctggtaaaagatagtatgagtaaaaaatattatattgccttttcaagatatgtgggttattatattacccgtagctgtaaaatattttattccttctcaacatcagcataaatttctgctcaaggaaagaacgatcagcttatttttagaggtgtattagaattacttatatctcattctgctctctccctcaagactttatccatattacatcatttatatatgtttttaattctttctttaaattctaggaactgtaaatcatttaaggatttaaggatgatttttgaaattattgaaacctaaacttttcaaaggacttcatttttttgcatgttgcaatcattgaggaatttatattttctcatttcacaatggagaacacaaagaatcagatgtgttaaatgccttgtttatggcacccatataacagaccaaagaagaaaatctttgacacttaataggattatttaatacttaattatttaattattaattaattaataaggttatttaatattaaccttataatgggaaataaataaaaattgacattttaataataataatacatatatgtcatggagatcataagctataaagagttaaactgtaaagtagtgtggcaataacaagatgttattttagtaattttatttgcagacgatatttgcacagttgaacagagataataacattatatatttgtgttaagggttgatttgatgtcaagcataatgttaatatcctgatgttcgttatctactttcaaagtatacatgcgaattaatatagaagctttgaataattaagtgaacggcagtggaaacaaagttgataactgttaggtctggaaatctatccacatctttctgaccacagacttgatgtcccaaatctgtaatttccaagggcaaagactttcctcctaggcccctttctttctacccaccaatgacatttaacaatgtctggagccctttttgagtgtcagtactagggaaacagatgataccagcaaggtaaaggcccagcatgctgctaaacaccctgtaatgcacacggcggcattccacaatgatataattattcattccaaaatgtaaataatgccaaggttgagaaactcttctagtctctacttcctcagaacttcaaaatgtcttattaaggaagtaaaagtagaattggagctgtaattatcatttaggaaaatgagttttcaagttcatgattcacgaaatgttttaataaattcttcttaattagtaaatctatgtctactatttataatcttcattgaaatataatgtacatactgtaaaaatatacacaataaacataaagatcagtaaatttttaccaatatgtacaactccataaagataaagcataattccattgcctcagaataaagtcccccccgacctctttgcaaacagccatcttactccccatgtccagtcaatcactgattctatttttattatagattagttttaccttttctagagctttatattcatggtatcatagcctatataatcttgtgtctcgcttcttttgctcagcataatagaattgcaattcatctgtgttgtatgtgtaaagtagtttatttgttattcactgctaagtgctatttcctatggatgattgtaccactacttgtttatccattcactcatacgttgtttccttttggggatattatgactagcattctacgaatatttttctggaagacttttgtcttgttgtagaagatgttttttttctcttattttgagtaaaaagtgagaggaattgcaggaacacatataagcacatgcttattttttttaaagaaactgttcaactattttccttagttgagaattttatactcccaaaagcagtgatgtaccagagccccacttgtttcacatcttcagcatcacttgcaactaatcaatcttcaattttagctgttcttctggctttgtaatgacatctcattgtgcttttgctttgtttctatctgatggatatagatgtgaaacatcttttcttatgcttactggtcattggtattttttctattttgaaatgtttaagtcttttgccaatttttattgggtttatctctcattgacttgtaagaattcttatattcataggtggaaattgaacaatgagaacacatggacacaggaaggggaacatcacacaccggggcctgttgtggggtggggtgagcggggagggatagcattaggagatatacctgatgttaaatgacgagttaatgggtgcagcacaccaacacggcacatgtatacatgtgtaactaagctgtacgttgtgcacatgtaccctaaaacttaaagtacaataaatataaaaagatacatatcctatgtattttcaatattttctcccagtttatatcttactttgatttttaaaatgttgaatttcaatgaatctcagcttattaatttatttccatcttatcaaataaatatttccctacaccaacatttgtgaagactggtttttttttctgttttcttcttgctttatggttttagctttttacttttgattcataatatatttacattcatatctgtgaacttttaatgtaggcattgaggttcattatttcccatataaatattcagatactacatcactattctttagaaaagacacttctttacttactaaattacttaggctactttcttgaaaatcaactgaccatatacgtgtggatatgaatgagtacattttattctgtcccactaaatggtctcatgtctattcttatgccagtactggagtgtcttatatagtatgtctacacagtatttttttaattggagagtttaaaggagtacactatgttttcacaaacaaaacttttgatttgaaaaaaaaacagttatgtctattttagttttgcatttccaaataaagattagaatcagcttctcagttttcacaaaagctgattaggtgttgaaatgattgattaatgtaaagagaatgttcatattaacattactgcttttaaatccatgaatatggtatacctttccttttattttgttattttttaatttatataaatatttaaaagttttacatgtacagtccttggatatatttaactaaatttatccctaacagttttatgtattttaaaatttagattttgctagtatctaaatatacacttgattttctacgtcatgcaagcttgctaatttcacttataaagtttggtagatttatcaattttttaatttgggggttaaataagctattttctgtgaatgatgggggacagttggcttcttccttttcaatatttatatctatcgttttcttgatgattttgttattgcattctctaggattgttagcacaatattaaataatagatgtggagcatatagtttcaaatcttagagggatgagttcaccattttggtattgtctatattaactatagttttgcccttcgtcaaatttaggaaattctcttctattcctatttcttgagagtctttattataaatagatattaaattgtgacaaatgctctttctgcttctattgaaaggaccatcatatttttgttgctttgtcttctcattaattttgttagtgtggtgaattatattaaaacaatcttgcattcctagaataaaaacaactttatcataatatagtgtcattttaatatatttttatattgttttctaataataatataatttattgatgttttcctcttattcatgaaaaatataagtatacaattttgtttattttaatttctttgtaaagctttcatgtaagaataatcttaggctgaacatggtggttcatgcctgtaatcccaccactttgggaagccaaggcaggaggactgcttgaagcccaaagttatagactagcctgagcaacaaagtgagagagtccatctctacattaaaaaaaaaaaaaaaaagttggttgggtatggtgggtatggtgccacacacctgtagcctcagctacatgggaggccgaggcaggaggatcacttgagcccaggaattcatggctgtagtggactatgatcatggcactgcactctagtctgggtgacagaacagatctcctctctgagaaaaaaaatatgtagtaatcttccttctgcttcaagattttttagtttgcaaaccattgggattatttaagtctttaaatatttaacatatttcgtcaatgaaaccacttagatctggagttttccttatgggaaaatatcttattataaatataatacttcataggacatagagctatctagacatctattccttcttgattcagtagtgataggttatagttttcaaggattatttttccagttattccattatcaattggcattccccttttcttaactgtcataggtttgcattgcccattatccagtttctgaaattcattgccttgtttgttctgtccagtattataattgtttatgatgagaaggctaatctcaccttatcatggatgaaggtgaaagtccaacactttcctctccgttggtattttaagggcatcttaacatttatagatctcattcagttatataaaactcatttttcagttactttataaattatcaaagagatacaagatttttaaatttgatttcttaataaaattaaaggttattttgagctagcactaaaggacatgcaaatttgatgtctttggtttcagtgttttaagatttcttacagaatagaagtcataatataatttaggcctttgctaactggaattgctacctatacatattttacttcgttttgttcttcctctaatgctacctgtagaaatgaacttaaaattttacctaaataacacacaggtctatatgtgcattatgtcttttatattataatatatgtgaaaatatcagtacaacataatacgtctaccaatcacccatccaagaaataacttgatagcgaaaaaaattaagtcaaccagaacttaatgaaatgttgtcaatactatcccagtggtacagaaaattggtgaaattaaacttgggttatgagaaagaccagagcactaaagaaggaaaatatgccaaatgtaattagtaagatagtataaaatggaagttatcattatttcaaaacccctccagcttctttctactcttgcagatgatcttttctttacaatatcctcccttggtgctgtattcattcagagcttcttcagtgtaaaatctcagagagaaccattcacagtgcagttacacagccttccagatcatgtgtgacagccaatgtaatgttcccagtgtcaatctttttacagatcctttgtatatgtaaacttaggtaagctacttaaaattccctgatatttttttcttatctgtaaaatgggaatataaatataactctctcattgccattaaaacttgtcattgacagaaaattgtattccacttctctatttaaaaaagtcagttcttcctcatgctctattctcatctaagattaaacttagcttccacaccaaaaaaagtacaattgtttaatttcctgactcaaaactacttaattaatcaactaagctttcaaataaaggtaaactttaatattgaggcaatttacttgcttctatactttttcattcattcattcattcatagcctcttatttatttatcatttatttattcagaacctctctgaaatggttaatattttctaatgcttttttgccaggaataaatgttctgacatgtcacttttattttgtcctgttttgatatcataaaatcacaagctacttaacaaagtaatttggaagtaacatcacagcacacatgctgctattctcatatcataatattttatttattatttattcccttacactttaaggaaatttatcacagaatgagcaatttattaaacttgaacaaaaatgtattaatacatttttcaccactgaagttaactgatctggaaaaaagtaaatgagaacagttcttgatttttgtaatggggagtgggtaagacaattacatgctaagccaaatgttgttaatacacaagatattttaaaatgattgggacaatttgaaaatagatattcatctttttactaaattttaattgtaataatcagaaattgcagatttgacagattcctaaaggaatcaattttgtttctgatttgagatacacacacccacactgaaggaagggtggccatacagatggccataacgtcattaaagtacctgaaatacactcaataatttgttctctaatgtttttaatgtaattttaatttaatatttagcatttaatttgtatatttttatatgacacagtaaaaaatggattgaaataacagtattttaacatcacttatttcccaaatgggtatattttcttggtgcgctctctctctctttttttttaattggaatcattccatgtttttaaatgacaacagaaaaactggggaaaggtcaaagaaattatggatggagaaatcgtgctacttcattctaaatgtctgtgtaggaatttagcatatatttatacttattatatagtatttgtgcaaatcccttcaccaagaaattaatttccaaattataattgaatttactttttgttatatttttcaactaataaatattatagaactttaccacaatacaattcttagaggtctcttcaatatatcaaaataatatcagttaaagatactcttaacatgaacagtgtactatcacaatgacaaggtgtgaggtatatgcattctattattagaattttaaagtgctgaaatgatgagactatctaactttttttaagtgagaaaattgtgttccatagaagaaaagtgaattgcaactaacaggtgacagaacaatgattaactgtgactcaaggctattaactttcatttccttgtattatacattcgccaggctgccttcaccatgaattcttaaaagcagtcattaagtatgcttacaaaatgcatttggttgtaaacttgtaattttaaatgttagcatgcttatacctgcttggttaatgttatagaggtaagggcagagaacagactaaaattagacatcatgagacttagaggcaagtttaagtttgtgagactgtcatctggccatctagtccaattattatcagacttataattagattttctgacagataatagttcacgtggcttccagagtgaagagaaaaattcttaccctctgattctacaattatttgtggtatattatcataattaacccaatggaacattttcatgactttaaaaaagaatcagggcttaaatccccttggatttattttattgttatcataacagcatcaatgttctatcactttaaatctttttttctccttagaaattaatttaggagttactcagaaaagaataaggcaaaaatgccaactgtagtattcctgtaacttaccttaattttaacagatagaatataaatgtaggtttaaaaaaaatggatacccattagtgtaatgtatttgaaaagaaataattgtgttatgagacaatttaaagtgtatataagatcactttcagaaccatttcagagtgcagcaatatttttcaatgaatgacagtggaatgagatagagaaatccgatgtcccccaaaggggcaaatctacaaagagagctataaaactgagatatgtttgatcaagtatttcagaatactctctcgcagtgcagcagaaaaaaactaatgcactcagtataaaatggctcattaaaacatggaaaatctcatttataggatcgatttacttggaaataacctgatttgttttctatgtttctgcacatgttttttagttggaaaaagtataacattcagtccacttgtacatattaaattcagtctaatattaataaatcatttttttagaaatcaaagtaataatttcaggaatgtacacacagatgtaatgcttcaaaagacctgtcagaaataatagcttaaatattgcaaagtaacaaaacatagtaaataaaatgtgaatttatatatttttctgtatggagtttttctgttccacaatcagatatgactcaggctaatgattctctatttattgaatttagcaaaaacataagaacagaaacacacctaaaatatttttaaaactacaaacacagaagacaaggttaacagcataaaagaaaatagtggtagcagcaaaacagatagagccttaaaataaataagtatgttgattaaaaactattttgtggttaacactcttctcattgtataaaccatataaaaagtagtgtcacttactggtaaatgcatttatgaaggaatgtacttcctagaaaagaattggaatgataattttttaaattataaacacttttaagagatgtaatactatttattttaattacttttaattctaaaaatgttgaaataatcccagttagaagttaaaaacctaggccaggcatggtggctcatgcctgtaatcccagcactttgggaggccgaaacgggaggatcatccgaggtcaggagttcgagatctgcctggctaatatggtgaaaccccatctctactaagaatacaaaaattagctgggtgtggtggtgcacgcttttaatcccagcaactctggaagctaaggcaggagaatcgtttgaacccaggaggcagagaatgcagtgagccaagattgtgccagtgcactccagcctgggcaacaagagcaaaactctgtctcaggagaaaaaaaaaaaaaaaaagaagttaaaaacctaaacacacagtacttaagaattaatttttttgtttattttttcacctccaaagaaaggccttgacttttaattgaatttccaacatagcatgatgcatcaaaagagcatggcattagaggaaaatagcttgattttgaagccatgtttgccacatagttgccaagttaattgttccctctatgtctctatttctcttataaaaccttcctcacatggttattgtgaaaacttgcccagtgaataatacgtatatatgtattttattgtagatgcaaatagatctgggtatacctatagataagtctgtaagcaacaactagattggtaataggatggtattgttgttcttttcactaacgtctcttcctctgcttcatgatcttcgtgttggtagtttccatttactagatgtttcagtaagatccaagcaagagtctaaatattccagatagactttgcatgtagtctttacaaccactctgtgtaaaatgcattaatatccctattttacaaagaaagctactgatgattggaaagtttaggtcacacaactaacatttgtctttaattttttaatttttaatttttgtgggttaatttttccacctgcatgtcttgatttaaaaatgatattttaaattatggtacctaaaataatgctttagtagtcctaaaatcagaaaaacagtagttaaatataagaatatattgttggcagaaatatgtctcatcctccttatgaagttaccattctcagtgtactaggtaaactttatccaaaatgacattttataatttctaatttcaaaatctatttatttattttatagtttatattatatgctttgtttcatattttgtaattatgtatttatataaaatgtgaaaaataaatttgatcataacaatttacctgtagctgtaattataaagcagtataaaatttaataaaacaagatgcttctgattcttcagcattccctcagatagacatttttgaatgaaagtcatgagattgtttccaaggtacactgcttttaaaatcacaagttattaaataatacttttcagtataaaataattatggtcagattgatgagttttaagaaattatacctgctgcaattttccttctttagattgtaaggcctttgagggtaaagattttctctctgttctccatgcctcactgttttttatttgctttgttatctttgcctatttatgttgtgtttactgctgcatccctattacctcaataatgcttgatgcatgtgagctttcaaatatatttgtgtgttatcatggtgagagttctggaaaaactataaaacacagaagcatagagcaagatgcagatagaatgtgttatcatttgtaaggcggtcacgtaaagcttctgacaaagttctattaaaatagagggacagagtaaatcatgtgaatatctggggaaaaattttcccagaagagagaacaacctctaagactaaagtatttgggatgttgcaggaacagcaagaaagatagtgcggctggaataggtatgtgaaggggaagtgataagaggtaaggtcagagaagtacaaagagccaagatatatgatttgaagcttggatgagtttctgaaatctttcctgagtgagacatttagttatgaaatattcaggaatttgagtagcatattttggctcaaacattataaagaaatctctgactggtaggtacacaagaatgaagtgtacagaagaactaggaggttattacagcaatccagttgagaaatgatcatagattaggtaaaagtgggaaaaaatgatcagaatcaggttatactttgaaggaaggtctgacaatatttgctgagatattggatgtggaatataagagaataaattgggacaaggatactacactgcaaaattttttatttgagccaccagaagagtagaggtaacatttcctgagatattaacaactattggaggatatggttgggagagtgaaatcaaaagttctatttcagacatttcaagtttaagggacctgtttttccagaaatatttaaattaaattgtttaattcatatttaaatttttattgtgccaagacatctgaaattcaagggagaaaaaggggctataaatttggtatctaaaagtatgaagatggtgtttaaagctatgagacaggtttatttcacttacggaggttttagataaaacacatgtctaagcacctcaaggttagagggagggaggaggaagaaaaaactgtagagagagaatggagtagccaaatgaattggagggcaactaggagaacatggtatccactcaagactaaataaagagaatatttcaggaaaggagtatccgtatagaatatagaatgagtacaaagaaaattatgtgaaattgtgtatgattgtgggtttggaaatgtggacatattggtagcaaagatgtggtgttttgatgggatggtgggaactaaaaccttaatagagatgcaaaagagaatgagaggagaggaatcagtaattgcaatttgaggcaactctttcaaagagcattactctaaagtggatcagggaagtcaactcaggggatggctggacaagagagggtagaggtgttttcgattggccttgctttttcatggggaatattgcaacatgattgtgaactgatgggaatggtacagtgattataatgattaatctggttttgtgtaatcatcaactctatctacttaattttatttactttccttatagaaaactatcctcataaatacaatgcaaaccacttggttagaacttaggtcatcagtaattaagactatgtggatctaaaataaaaggaatcaagagacaggtagcaaagagaaaaacagacaacatcctagatattctgaacatcaaaaaagtatgacaaatgtttctttgatatgtattccatagaaaaggtcatattgaaacctattgacttgtactgtgccctaaattttaagagaattactcattgatttttttttgatgaaagacaaatcagaaacaacaattttctaagaaggcataggcagaaggcaagtaaccttacaatagaactgagaggtcacagtctaattgcatgacaagaaagcgggggaaaataacttctcataagcaacctggtataagtagtgacaaaatattgaccctagaccacaaaacatgtacgtgctgctctctgtgtgtccttgaacattcatagaagtattatgtaatgtctaatagaaaattaatctgttaaaatataatgaatatgtagtaataaaaatacttgtccttaaagaatatacttcttatgtaatatgtaaagaataataataatttagcctattgtatagtcaggatattctaaagaaagtactgaccaggtagcctttggagtcataattttaaatctataatattaaaaattacatcaattaaatttattattgctaacatttgctagctattgctaacatttgctagctccctgctcaggacttcactttcatggttgtagcaattctctaaagaagtatcatcatcctcaacaggtgttgataaggatattgaggcttacagagctgaagctactcaaaattccacagctatcagtgaaaaccggaactccaaattgaactttgtggtgtgatggaggaacccagatccatcttccctaaactttgctccctctctattagaatttttgcgtaccactagggaaggaaaagagcaagaattcaatctcctttgcccttatttttttttttttctaaaatcaaagtgttaatacctatctccttggctgttatggaaatttgagaaactatatgtaatatgcctgacattattccagatacatactgtaagtaatattgccagataaaatacaggacattcagttaaatgtgaaaaataagctaaaccaggaatatatatatgtaatatacattgttttaaatatataagtatgatactaatactaacatatattggtatgaatataatactaatactaatatttaattataaatatttactaacactaatattatagatataaaatttataattaaatattagtataagttaaaaattagtataaatataatactaattctaacatatattagtataaatatgacccatacgtctgatgggacataattatactaaacattatttgtattttagttggaattcacatttaactgggtgttttgctttgttttcactaaatctggtaaacctaactgcaagttagggactaaagagactaggaagtagccccaaggaacaaaattttgacaaaagctgaaaagtatgtcagacataagtttagagaagttcagcaaagggcccaggagttggtaggcagaaaagaaatcaggccagcaagtgttggaaaatggggactctagggacaagctgcatttctaagatttggctgaattcctgaagattggcccttggctaggcagggctcagcatgcacgtttcaggtttccagtaagtattagtgagctgaggaaagtaaggattaacatcataagagcaaaaactaaactattaacattatgattaaaataaacttgccttctcctttaacctgaatctctaaagctataactatgtatttgcatttattttattgctttggatttttctttcattttatcttcttaaaaaaatggtaacatctggagaataaatatttcaaagaaggtagtcataaaaattttgaatcatattaatgaaccctgaaatagagaatgagaggagaataacataaaccagaaaatgtgttatttgtaaaaccttaaactaattctatttacagcactagactgcaatctcagatttcatgtgcaaattatttattactaaatttactaacaataatcttatatacttagtatacaattaattcagatatcgtaatatgagggatactacctatatttattataatgaaatcattgtggaagtcaaagaaacctaacacttacgaaaaattactgtatttctgggatgtacaaatcctaatcttgctttctccatcaactttggcgtcagatattctgttagttactcagacttacattagagtatatgtaaattaagactttttttaaatctctaccttaaattataggtgatagctgaactggttgttttttatctttcttaatttaattacattatttatcttcctttagtacaatgcagaccatttatatataaagaataaataatattagagtcagataaatgattatctactaaatataaaattaaacctttataattgtcctttgttatccttgaaatttctgcagaaaatatgcttttaactcatacgtttatttttattgtgtttcaacattttttccttcttttctggactagaaaagattttgaagtaaaggaatcgaaatgataagttcaatcacagttgtaacacagtatgcttgtaataaacttttcaatgagatttcaaaaagaataaatattattttgtaaatagcattgactttacaaaatattggtaaaccagaggtttgaacctactttagatatagacacataatcaaatatctacaaatggaaaagaataagatgatgaaaatgcaatatttagtaattttagaacgagatattattcatttaataaggaagaaaatatgagtataaaatatatgattattataaaatagtaaacctaatgatttgattacttaatacctaagcataatataaaaattcattcagcaatagagagatttcaactacatattaaattatcttgtaaattttattggtaagtagtcttatttaatagtatgattcagagcactgtttattataattttgcaacttctcttgctaaatccacagtagtctctaattttatgatattttttctggtaaaaaagttttaaacaattatcctgatagaaaaaaaaggactctcatggaatgcttcaaaccaaaagtaatgatgatagagtaattagaaaaatgtaaaaatcctattgcattatgaaggatattgaacatttatagtagctttcaatgaggacacagagaaagaggtatagaaaaaaattctggaagaactaatgctggtgtaaactgctatggaccccagtcctttaatgaccagactatactttcatatctgagggggcatttaaggaagcacctctccaatactcacacacgattagagtatatgcatattcactgtattatgctttctttgagagaatattgaagcctttttcattatgagaaactaccacattaaaatacagcccaagtaaataacaattatgccactggcaatgaaaaacaacatggaaatttttatgtaaaatatttaattcttttttttatttttctattgttctacagtagttgagttctaaatacaaacaagagataaattttcaaatgaaataaagatgtgattatacagaaaattgtaaatgcccatgctaaatccagtttaagcatggaacactccatttgtttgaaagtatactaaaatcattttattgtttccctatgtgtaacatgcaaaataaatggttagattatcatgccaataagaatagataatgtctaaaattatatatagagtaaaaatgttgataaatacttgataaactgtgtgataaagatttgataaaatacatgataaacgtagtgggacctcaaaaaaaaaaaatcaaagactcatgagatccatttttttttccattgatagattgatgtctaagaaatagttggataaggatattaatagtatttttagtacttccaaactgttcagctactgataaaattgtatatcttagagttggtactaaaatattgagaatgcaaaaacatttatgtatataaacttgtttattcctgatgtaattcaggtggtcctccgtctgttcttgaaggtcagtattcacagtctttagtatacagccttcagatactttgagcttgaactaatctacactaaaaggaatctctggagattgaaagatgagacggacagaaaggaacaaaaggagtaaaaatagtcaaaaggctagatatgctttgaaatgggcttctgtatccaagtctttctgacaccaaagcccatttctttttactagaccacctagctaccttgtcactctaaatttactgttttgattattatttcttaatcctcactgggctcagtacttattattaataatatttctgtgtttaggctctaactctatgcattaggaaggtaaaactatggttatctgtgtacactatcatcttgctcaggaaatattattctaaattattatattgttttatttgaaatttataaattaaaaatgtaatactgagaacagaattccaaaaatagaattttctaagagcaaatcaatttttgtcagttcagtgttttttggtagacacagagaattcagttattcctagagcattaccattgtctgttcatgcaaaacctcccttatgtttaaaataattttattattttttcatttatcacacattctttcattccacacacacacacttacactgctctcttaggcacatctacatacaacttgttatccatccatgaatatgtaggtaaggatgttttcacttttttatcagcctggtttccttaggtatcaaatggaaattcagatagaagaagccttaaacatgcacctgcatatgtagagatcatttctaaatttaacctttctgtcaagagtctaactgcctacaaaatggagcggtctaatcctcaattttaaattcacctataattttactttttcacttctgagcaagatagtttcgattcttgggtgtttatattctactaattaaaatataacattgctgctattttcatgaccgattttttaaaataaagatttcttgcgtcttaaatatcaattaggtaatgcagctctacttgtatcgtcactgtgcaataaatttcagtcaatttaacgtataactccaataagatgtagaagaaaaaggatacttcactccactacgtattttagttagagttgttatatattaatcttgagccaaacctctgttcttagaaaagttccccatcagttttatcagctggatatgtcatggtgtgtcctttgagatgaaagcaccacaccagttcttcatttaacagtatactaaagaccaaaatattttgaaagaaaatgaaagagtaacagcaagcttacctcaaacactgctaaggaagccaatgttgaaaaacttaccattcatttcaaatggaggaacttaattctccagatagccccaaaacagagctaacgaacacaatgcatccccactcccagcagcacgtcgactagtggtgtttgttttcatatttcctatcatgtttgtcatgcctttagtagatgatttggctggcacaatatcctagcctagcctcagtgtagaaatctggcaataaaataacacatccaaagataaaataagaaccaatgttaagtgatgaatccatgcaaagtactcagtgaatctcttaaaatacgcctatctgcacacacaggaaggaaatggatgtgctgggaatctgcattcttctggaacaccatatgtaatgtctattgagatattttgagtgggcataatcttcctaggagggataatatggaaaactttcacagacactttctgtgaactagaatctgctgctagaatatcacaacttgaacagaagaatatccttacctcacactgggtgtaactgaagataactaacacttgttatcagatatttatgtttaaaaactcagtaagcaaaagatagcctatctgaaacatactactttgtctacaaaataaatctcaactctgtaactgatgttaaagaattatttcaatctgtctgtcacttagtaagcatgactaagaatagtaattttaatagtaacttatgctatcaataataataaacatataaaagtttcctaggaatgtgtaaaattctactgacccctgtaaaatactaacgaaagagtggaaataggagcattttcccataagctgtgataaaataattcttagtatgataatactttttaaaaagttgacagttgaagaaatttaactaagacaatgatgtactagacatccttaaagtgagctgctgctattactgtaagtttaatcattataaaggccatgacacttctcttagaggatttgtgtacattatcattggggagtactatattatgatagtaagctacccttgtgttatgaaaatgcatggaaatttgggtgaattattagagtaaaatatacctcacaaacatttgccttaatacaatttgccttaatacatttgccttaatacaaatgataaatttgtgcaatggatctaaaaagttatacatgtaggattatatagacatatacatagtgagaaataacattttaatgcacattgcatatacaaaatttaaaatctgctcattcatcctaaatgtttagtgcataataaaaacattaaaagtatacaataagtaagttttactcagaatgccatacaaaaaaaacacatgaacattcaaatttggcaatagtgtaatgctttcacaaaagctgaaaactctcatacatgtttaaaatttaaaccacatggaagttgggtttagctatggttttatacttggatttaaatacgtttgcttatattggcttaatgttgtccatccaatccctcaagaggaccacataaaatacaaattaacatttttgcgatatagaaacatgaaagtccataacggtttttttcttccataagctaaataccaaataacattatgatatccattaaaaaatttaataatattttgagaaatacatatggatcatttactttttaaataaagtaagcatagtcattggctttcttactttttaaacttaatataatatataaagtcaaaagggataaaaactgtaagtacattactccataattgatagtttccttttttcttatgttttactttcttaacttatccagagagaaaattatatttagcatttttctgcagtatatgcccgtgttttgtagatatgaatggctctttagaagtacatttatagcaacctagatgtgattcaaaattagtctttttggttgtcagaaataaagtaaccacagtatagtcatagccttttttttgaaaagacaggatcttgctctgtctcccaggctggggtgcagtggtgcaatcatggctctcacttcagcctcaaccacccagagctcaaacaatcctctcaaagtgctgagattacaggaatgagccacctcacccgatctatagtcatagcgtttcaaattaaatatttatttatcatgtttataaaaaaccaaattggtattcaagtaaaatacatttttaatcttacaacatcatagattatgtagcatttgttcataaaagtgactaaagtattacaaattaaacatatcaacagctactaaaaggaatatatgactttctcattattttcatatggtacaggtatctggtatgcaaaaattaggtatgtatttgacatattaaaataaatcttgaaatctattttccatcagcatatataaattaatgactagaatctgtcactgtttttcaatagctggagttggaacacttaacattatttacaacaagcaatatcgcgcctgtaatcccagcactttgagaggcagaagcgggctgatcacgaggtcaggaaatcgagaccatcctgactaacacggtgaaacctcgtctctactaaaaaaataccaaaaattagccaggcgtggtggcaggcacctgtagtcccagctactcgggaggctgagacaggagaatggcgtgaactcttgaggcggagtttgcagtgagctgagatcgcgccactgcactgcagcctgggcgacagagcgagactctgtctcaaacaacaacaacaactacaaaaaaaaacaagcaacaatataccaggttgtcagtttccattaaaggaaattcaaatcaacaaatgttaagcatacaattttcactatgagtaaataatttttgcattaaaatacatcagccaggtgtagtggctcatgcctgtaatctcaacattatgggaggatcagttcggtgggccacttgaggtcaggagttcaacaccagcttggccaacatagtgagaccctgtctctactaaaaatattgtacaaaaaaaaaattgccaagtgtggtggcatgtgcctgtagtcccaggtactctggaggctgaggcaaggtaattacttgaacctgggaggcggaggttgcagtgatgagccaagatcatgccactgcactccagcctgggtgacagaataagactctgtctgaaaaataaataaataaataaaaataaataaataaataaataaataaataaatctcataataacatttctttatctttatctcaatcattattaaataaatatctgagtgtactatgccgctgatggtaactggttgttgaaaacaactatgttttaggtatattaaagtattattgtattctaaatagggagaactttatatttcctaaggaaatttattagacaaataaggttctagaaaatatgacttgattttaaaaatggcctttatcatgagagatcgcagaaaaaataaaaatcatattatgtcagaaaggtagacaaacattataattcaattataatttacctcaatcttcaaggtttttgcaatgaacttataaaaaataccagtgtgaaaaatttaaatgaattaacatgaagaactcagtgaaacattttcttcagttttgtaatattttagctctaaaattaaaaaggaaatgaaaattagataccatttacatttcctactccgctccaccaaccccccaaaaaagtaataatttcttaaggaaaatatgatcgatcatagttgttttaaagttagagattttgattgtatttatttaacataacctcctaaagacacggtgtcatgatttataattgtttctataagattatagtgttctggtcatgctgttttctttctctaatttaataactgagttttgcataatcattcaatactgtcataaagagaaccaaatatggccattaaacaattagaataatacttcatttatgatttggctattatttaggcagatttaaaaaactatataattattattataaagatgtgtttacaccattatttgtgtatctgattctaatcccttttggttttatccaacattatgaatgtaaatgatgatcataaaatatctgatattttatattaaatgttacctcacatctgtatgatttactataatcacttcacaaatatttattgagcaccaactgtgagccaggcactgggctaggtgctatggagtcagtatgaatatatcgtagagtaaaatgcaggcctaccatcactgaggttaccacttaccgctggcagataacagaaaataagcaatttaccaaaccacataatgagaactatactatgattaactacaggcttgggaaatacaacataggagaaactcagtccagtcttagaagcttatagaaacctttcttaaagaaataaaaagttttggggtaagatgaaacagtacaggcaaagaccgagaggtgatagagaaagagaaagtaaaaaggcaggtgtgaggagacatgaatctggggagttatgaagaaaccagactgtacatttgtaaaccaagcttgttttagattacgtgccaagagcaccatgtgaaaacttttttttttaatgtgaggggagaatgctatcaaatttgaattttagaaaaatcattttgtgtgcagaagagagaatggcatagaagagagtaagaaagctgacagggagaatgagaggagacacatggtcgtgttccagggcagcaatacaaatggtctacactggggagtaactttgggaatgaaaagacaagccagaggatggatttcagatgtccagagaatattatctatgagctctggtaatcaggtagatatggagagtgtgtgagaagaaaggaaaatcaatgaatgttattcagttttcttacttagcaatatccagggccatttcatgagttaagaacgtatgtcggactgaaaattaaagtaagaagaagtgttttaaaaattagaaaaagaaatgtgtcatttctaaaggcaaagaaagtaagtttaacaaaaataaaagtaaaagattggtaaagattaaaaatatgatctttatgtttaatgatttaggttattgctatcatccatctgtgctgtatctcagatcttacagaatcatatgaagagacatgtctttccatctgcctacgtgcatatgagtgtgcaaatatgctaaagaattaaaatatgtaacaaaacattgtatgccactaagaaacatgttttaaagtccttcagaaacaggtttgtgtaacctagcagtaacctttagtaacctatactgaaatctacactagtcaaactaacacattttctaagcttctaaagccctcaactcttcttttgtgatttgcaatctggcagcaaaactaactgcagtttcaacttatgaacacttcttttacactgatgcctgactgatcgtgaagattctacttcatcttcacccttctcaagtgatggcttttttattctgctattcgtgtaccatagagccatatatatgtatatatgtctactaagagctcgttatttttttcaaaacattattcctccttcttccacagaataaactctcttaaagtagattctactagattacatcagagtatactatttacattttattcttgctgcattcaactgcttaaagcctgctgaatcttactcatccattgaatatgttttagcatctagcttactttccttctatctactaaaaatcttgtaaacatttttaattatctcagtgttcatacaaataaactgtgaaatgctttggcctttttctcttaatctttctcacctgcaagaatcacaaccttgtttatgtttaaatatgtgattgctatcaaacagcttaattaatgtgtctggatataaacatgtatacacactatatgaataaattcaagaccttaaactcaagagattctttaatgttgcctggcattaatgtctctagccaatttattccttcaacacttctaaaggatatttatacctgttctgtcttcccaaaactcaaacatttcttctctacttgcacagctacaaacttgctttttacacactcacacacaagaaaacaaaacccaaaattaatcagatcgcaaaatcaattaacttatcaaaaaccctggccaagtcctctctacctccctccagttgcaatgtcgattatgcccttgtctcccatctagacttgccagtgggattctctagagcccatccacatatgactatgcaagactttagttctaaaagtatttttcttctttttttaaaaaatcatctttgccctccatttattcatgtagttttactactgtaaaaaaaaatatgtaatctgaaaaaaagacttcacattgtttaatagctactttcccattttcatactcttcttgacagcaaaactcactaataatttacctctaccaattgcccacttttatcctctcattctatatttaaactatttcactatcccaattatctcattccaactattctcatattggtctgtatttccatgttgcgaagtcacttaattatttctgaatcatcagtatttgatgtgtgtgtagtctctctcctccttgaagcatctctttcagtggagtcatggaaacccagaaatcatcagagttttttttttttctaacctttctaggcttaccattttagtctcctttgtgatttcttctcatgtcaaaatattgtaatatactgcagctcaatccttggaccactctttcctgtgcatgtttattccatgggtgatatcagtcagttttactgccttaactaacatctacatactgatgacttccagttatatctgcagcccaggtctcttcctaaacccctgtgccttatgtacgtatctacttaagtatttaatatgcatttcaaactttatatattcttaatttacttttaacattctcctcacatacttccccacttcagttaaaaaaaaacttcattatatctcttgcttatgccaaaaaattcaaggtcaatattgatcatcattctccactgccagttaatcagtaaattctgtcaacttgacctttagaaaaataaccaaaccagaattctctttaagagtgtacattgtttataattattaggtccattacatatttagtaatttagaatagtaagaaatatagtctgggaattggatgatattaacagattattgttaaataaatgtattaagtgtgacagtgttgttttggctcagtaagaatatgactttttattttttttagaagtgcatactaaatttcttagtgtctgtactgcagaattaagcaagtgaatagaatgagttagaaactcattacaacttcctacacacttagaattttccttagcatgtatttacttaacggattgatcctgctcatctttctctctttcaccaacatgtaagctctaaaaagatgggacttttcgtttattttgtttgcaactatattcccagtacctacgacattattaggcacatattaggtagtcaatgaatactttttgaatatatgattaattatttattatgtagattcttcccaccttcccaacctcctaaatcttcccagagctcagttcttatttctcttttcttctcttttcctgtactcttcctttaaaaaatatcatctattggccggagcggtggctcacgcctgtaatcccagcactttgggaggcaggcgggtggatcacgaggtcaggagatcaagaccatccaggctaaaacggtgaaaccccggctctactaaaaatacgaaaaattagccgggcttggtggtgggcgcctgtagtcccagctactcaggagggtgagacaggagaatggcgtgaacccgggaggcggagcttgcagtgagccgagatcgcgccacggtactccagcctgagcgacagagcaagactccgtctcaaaaaacacaacaaaacaaaaacaaaacaaaacaaaaaatcatttatttctatgacattaaacatcatgtaaatgctcatgaatgtatatctctgtaaatgtctccatttacaattacaaaaaaaaaaaaacaaattttcctatttttaaaatttttccccattccacatcagcaaattctatcagcttgatctttaaaatggatctgcaagtaacttaggtctcattttcagaactacaagcctaatctgagccaccaaggtatgttttctggtttactacaatagccagtctccctggtcctactcttttctctccagtttattctcctccctatgttggagcaatcctttcaaaatataagccagatcttagcactgcctggataataactcttcagtgattttttaattttatcttgaataaaatctaaatttcttatcattatctaaatgggcccatatgacaaattgtttgacaatctctgataagataatctctctgctcactatactcaaccaacttggtctccttgatatcacttattgcaaattaatggataaatacgctctgataatttgaataacttcatgcaaattcaaccagcttttagtagcagactctggttgcaaagctggtgattccaaaccatgcagcatacagttctcacctcagagtgtaatgtgccactggaagcaagttggggacattaatgaaattacagaacataaaatatttgggctggggacagtgagggttaatatagtgtggtcctgcaaaatagaagtgggcaatagctaaatataggtgtgtatgcagtgtgtgtaatattatgactagaccccagcaagatattgtggatgaaagaatgtggagagacagatatgaatcaccatgtataagaataatgagaggcaaaaacggatacatttgtcaaaatagtgtatagagaacagaaatttgggtgagcttatgtcttgggaactcagaatctgaatggtcatttgactttttactttttacaacctttaagtagtaaggtcttacttgtttctggaataccaggtcaacataaacaagataaatatactattggcaggaatacttctcatgtttcttataaagttaccatgctcagtgtagtaagtaaacatccaaaaatactttttttaaatttctaatttcaaaatctttctatttatttatctttataatgtatattatatgctttgttccatatttcataatgatgtatttatataaaatgcaaaaaacaaatttgatcataacaatatttctgtagctgtaattgtaaagcagtataacatttaataaaacaagatgcttctgattcttcagcattccctcagatagacatttctgaatgacagtcatgagattgtttccaaggtacatgcaaatcataagttattaaataatagttttcagtataaaataattatccttgcggttttcattatggcacatccgccttggacagaagaaacaaaatcctgtgactgacttagctgcaattagcaagtcattcagaaatcacattcatcactgtcatttcagaagagtctagaaggaattgcttgtgctatatttagcatgcatgagagctgtaaagtccagcctgttcatctttctcacgtttctgtttgtttgcaaaagctagaaagctgtagccaagaagggcaggaaggaaggttggctttcaatacccttcttcagttcagctgagaactcctttctatgactcaatagccagttccaaattaccacattattaaaaaaatttggttatcctgcttatattttcttcatagatgatattactacataaattaatatctattaatcaatttatttattattaatctccaatcattaaactgatggatctcagagatcagtgacttacaggttctgtttactgttatatccattgcccacattcctggcacatgtcaggcaataaaattcaattattgactaacaaacagcttcctgaaaaaaagtcagttcagtttctttattgtggatttttaaaaaatcaacagaaaactagccctcatatgccatttctccagataagagtaatctcattttttcacaatgaagaggttatctttagtcttgaggtctatatatacagagagagagtagcagtagtgaatacatctggtgtcaagtacaattaaaattatgtcatagggagaatttaaatttattctataggaaaagcagagaaaccctgggtaaaatttatggggatatttttgagcttaatattatatttggtattaataaagacatatttctctttgagaaaaaaaataaaaatagccctggggcctggaattctagtagggcctgaatgcaggtctatttttccaactagatttagtaacgaataaagttgtcagggattggaatgaccttgtccagattgtgacacatattccattattaaaagtgaaaaaacagaagttagaatagctttgtgcagatatactaaagagaataaaacactgaatggaagattagacaacattacttcaagataacttgaaattcttttaaagggcctaatattatttttgattcaaaaaaagtattcaagtaacagaaaaaaaattttggaggaaaaaatacccagaaaattgttacctgaaataatttaagaatagaaatctttgattataaaatacttctaattgcacgctaataaaataaagtagttccatgagaaataattgaaggctaaatgggacattgtaacactttcaaatagtagaaaatatggatgggatatttttaacttactaatgatcagtaaaataattgggaaaaaagaattgtggaaaaatatggcattttatatggtaggtagcacacatatctttattgttacctctctaatattaatatagatttgaaattattttggttaaaggttttcaccaattacttaagtatctgaaatcgattattaaaatgaaataagattattttgtgtgtatcaccattttaatcattacaaattcaatgttcaatgctcactttgaaaaattcattaagcatgatttaggctcgagtctgtatatatgtttatggtaacaaaactgacttacaatgtttatttgttgtgctgacagcttcctccataaacagtgtcattgctgtctatgcaccttaatgtggcacatttggttgtttcatcttactttccctatatacaacatcttttatgtagatatacaaataaaattaaatacacatagatatatttaaaattttagcttcactaaattcattacattacctaaaatcccctcattgcatattagacactgtgtatattaatacataaaatgatactaggttcaacaccttaaaatttttaacctaaattcactgctaggcaggagtgtaggttcataaaaggaagttaaactaaaataacatacagcttttctaaagcaggaagaatatgtaaggcaattatattctcatgattccaagttgaaatctgtgccatttggaaggaaacacaacgctaaatagagacaaaatattttgaaaattggataggatttttgtaaagatttcaaataaaatagaaaaaatattttaacttaaaagttgaaaaatgatttatttatcaaagttttctaagttatctgtcagatgatatagatatgttttgaataagtactaaagaaataaggagatgagctagtcacccacagccacagatattatcctaaaaactgtattatttgtaattctatcattgagaatgaaatttgtttatattccatttgtatctctgtatgcaactatatactctagtttttttttattatttgtttgtttgtttcgttttgttttagaaaaactgcatgagaagactgcttacttcttttttgttcagatggggagctcactatgttgcccaggcatatctagaaacctagggctcaagaaatccttctaactcagtccagcttcccaagtagctaggattataagcacacaccacaacactcagcaaaattgctttttattaggaaacagtaatatcaatttttttaatgttaatgttgaggtacttagttgaaatcattaaaacaccagatttatgtttttgacattgtaggctttgagatttgaaaattcacctacctcagccattcaagttgtgtgatattggacaatctcagcttccttatctatataatctgaataataaaattgcctctttcaaagaattatagtgaatgttaactgagtttttgcataagaagtgctcagttcagtgtctaatagatacaaaatttctaataaatgttttttaaagtatattcttcttaaatttactcatatacctctgaaacaggtctcaaacaacctcaaaatatcttagccaacatccacaccagttgtttagaagagaaaatacacctacacacacacacacacagacacacactttgatttttcatttgaaaggatacgctgtagtttcaagtgtatgcagtataattctaatcactttaaaggttctttctaatacaattagtctaatggtttacttactcaggtaaaacctttaccaaacagccttttatcagacactgactctatgcaagtctacaagagtcaaaaaaacagacatgttgtctgctattacggagccttaaagtctaatggaggtgattagtcaaatgttgggacctccagtgaatagtgatataaagtcaataactttgaattcaagaataattatttgatatgctgaaactacccattaaagaaaaacatcacaattaaatttttgtataattttcttggagtattatttcccaagtcttttctaatatttaagtatgcatttaaaatcaagctattttaagatttgtatatgctactacaaaactaagtttccaggacattttctggcagttcctagactcatccctgaaactgtgggcttgctgccatcaattttatggcacagactaaagcaaacagacgtgaataagagcaaaaccgatagaatttggaagactcaaaaaagaagccaatttgtttcaagtttgagattattttcttatctataattaatgcaaagtctgcccccttattaaaataagtgttctagtgccattatttgaaagtacatttgagctttctacagatcattaggctgtcactcctctgggattcgtatgatcgcattcaaatgataacagttgctttgttgtctctggaagatgaaaatgggtacaaacataatgcatcttcacatttggaaattagggaagacatctggatgcacttgcccagctaatgaataaagggaaaaagggaagaataaaggaaggaaggaaggaagaaaggagagactggagggagggagggaggaaggaaggaaggaaggaagggggggagggcgggaggaaggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggaaggagggaaggagggaaggaaggaagggagggaaagaaggaaggaagggaaagaaaaagtttctgattttctttaatatgatttagtattcagcccaattcattttctgaagttggaggaggctaaacattgcctcgtatctcctctttaacttgccagctaattatgcaaacctttatatccaaacaatgcagaggaaagaagacagaataatcttccagaccatgaaagctttgttcatccatcataccaacagtgtactaaagatcttagagatcttttgtgtggtaactctttgccctttcagctgatgaataactgaagatgtgcaatacaaagaaattactaaaagagaactgtgcactggaaaccaatttgttttcatgactctatccaacgactttagtgaagtatttaggagagtgggttaagtacacaagcctcttttaaatacttattaagattaaaatgttcacataatatataaaagtatgctttaagtgggcacttgattcccagttagaaatttaggattaaaaaaacacactacatctcagcaacggtgaaaatacgtgaagattttgatttggattaaaaagaaaaaatatttctttgtgcttaaggcattttatactccattttatttcttgaacagaacagagcttaacaatactgactgacaatatgaacaaggctcttcattaggatctagtaataaaacaaatgattagagtaaaggaagacttctgataccagaaatcattcaagaagtctcaccttatatgcaggattcagttttacatttttgtgtgtgtttttatttccccttcaaaccaaatgtttctttcttacttatgaggcatccactttgataacagatgtcaagctatattatatcataattggtctttgcttattgctagtgatgaaacctcatccaatatttttgcatgcctccatttactacagctgttaatttttcttaaagtttgaaaattatgtgcagctagtatgtcttcttcctagtatttttttaaatgaagtgtaatttgttcccctttattagtgctggatgaaaataagtcttcttttttatttcctagaaagtttagcacattgaaatgttttgcctttgatcaaatttgtgtaaaggatcatacagattatatatttcctgtggggttcttctcttctcctcttctcctctcctctccctttctcttcccttcttttttctcataaaaacctatatccaaattctctgtgaagctgaggatgtattccaatccacaagtcaggaatgatgaaacagtaaaagtttaataagctacttggccatggactcttatagcacagtatatttagatacaagaaatcatccttagttaatttatgaatttttgcaaatttctaaggtatgctattataatcctgtccctctaggtaccttgattcctgcccaaaaatagcaaaccttattatttaactaagaaaaaaactgaacaaactataatgaatctagggaattgttcttcggtaattatttttctcatttctaccgttagcaatagaaatgtctggagatgggaggaagcaactaataaaagtgaactagattgagatatttgcattaaatataatctaaattgcaaataatcctcttacattctctatgcacagctgcattattatacagttcacattgctttggtaactaattttttctgcctttattacatcttccagaaaacaaaaagaatacagttataaagaccttcctaacaaactatagtaagtcaagatggagaatataagtgggccttggaaaatctgagttagattttagtttgtgaacaggcttaagagaaagtcgtctatataatgactcctcatcagcagatgaaggacattgaagtcaaacgttttgctatgtcacgacacttgaagaatcagtgtgagttttcaatgtgagttttagaagattaatatttacaagacatttttctttaacttaacacatgagaaaatgtgagtttcttttttaataaagtgaaaagttttattttagaactgatactgaattgatccaagatacatccaaagttccgaaagctattcacttaattcttactgcaaaaaccatttttttcagtgtatattttcctaggtttatgataggcactggacatgaaaaaatagataagactgattttctctgaagctcaaaatataattttcaatttatataatttggcattgttacagtatttcatttgtatgttataatataaaataaaattttatataaatgatatttgttcagttattttgggtatttctaatattcaatttgcagaatacagagatgcaaacacacagacacacacacacatgcacacacacatgtttgtctgctctataggctgaaagcttgtgtgcttccaaattcatatgttgaaatactaactcccaatgtgatggtattaggtattaggaggttgggccttgggaaagtgattaggtgatgagcgtagagccctcatgagtgagattagtgctcttatatcagagacctcaaatagctcccttctcccttctactatgtgaggacacagcaaaaagactgctgtctatgaaccaagaagtaagccctctcatcagacaccaaagttgccaatgccttgattttgaatttcccagcttccagaatatgaaacatcaatttctgttgtctgtaagctatccaatgtatgatattctgttatataatcccaagcagactatgacagcttgtgtatatgtgtgagtatgcaaagaaaaaatacttacatttttcttttatctttaaagattcatcttagaagcttgtagaaaaccatgaaagaaaaggttttataaaactaacaaattacctaggacattgccttgtggattaaaatggagccagtgtgattaaattactagtaatgcattcacggattaatattaaattgctgtaataaaattcagtggatattaaactcattttatttgggtatatagttaagaataaatactataattaatttatttaatttaagaaatctgtgtatttttttttttttatttgagatggagtgtcgctccatcgcccaggctggagtgcagtggcgcaatcttggctcactgcaacctctgcctcccgggttcaagcaattctcctgcctcagccttccgaggagctgggactacaggtgcacaccaccacgccccgctatttttttgtatttttagtagagacggggtttcaccatataggtaaggctggtctcaaactccttatcccaggtgatccaccgccttggcctcccaaagtgctgggattacaggcatgaacatggtaaaaaatggtttgcacgtgagacactgaaaagttgtcccagggtgtctgattgccacaacaaatagttactggaagcagaatttcacattacttggtttggaatactgtttttcttaaaaatacggaaattgtcatttgtgaactattttccatgtggtagtagtttttaaatgtgaacatttactgtgaaggacgaagaggtaaccacacatcagttgtgatgtttcttacttattttactcatatttcttgcctgcacactatgagtcaggcacaatttcaggctgtgaacaaagcaatcaaatgatagtttgaatgagacttaccctctcatgagaaaaaaggaaaaaggacagctaaagtacatagaaaaatatgaggtgataaacactgactacttcagtttggttcccaaggaagatctgtctgaagagatggtaggaggagaataggacaaggagctatgctttggggaaatataggcattgtatatcctatgaattggtatagtgcattatgtgtattttataatattatagctgtattgaaatttgtaaattgagtaacattgttagtgtagctgggagaacattacattaaaaagcttaagacctaaagccataaaattactagaagaaaacatatggaaaacactttagaacattgatgtaggcaaagatgttatggctaagactgtaaaagcacaggtaacaaaaccaaatttagacaaatggaactgtattaaactaaaaaaatcttcttcacagcaaaagaaacaattaacagagaaaagggacaacctccagaatgagaaaaagtatttgcaaatcaataaaagacattgtttataggaaaagtaagatgaaacaaccaaatgtacaactttaagttgcccagacagcaatgatagcagtttttggaggaagatatcagcacaacaaacattttaaatcagtttttattgcaatacacatacatacagaattgaacccatatcatgtttaatgaatttttcaaagtgagcatctaagaacactgaatttgtaaccattaaaatggtgatacatacaaattaatctattttatcttagtaatcgatttgagattcttagttaattggtgaaaacctttgaccaaaataatttcaaatctatattaatattagagaggtaacaataaagatatgtttgctaccttccacttataatggcatcttgtttttcaataattcttttctcccaattattttactaatcattactaagtaaaaatatcccattcatgttttctagtatttgagttttatgatgtcgcaattcagccctcaagtatttctcatggaagcactttattttattagcatataatcagaagtattttataatcaaagattttttattcttaaattgtttcggttaactcttttccgggtaatttttcctaaaagaaaattttccgttacttagattttttttatcaaaagtaatattatgccctttaaatgaatttgaagtttccttgaagtaatattgtctaatctcctattcagtacaaagctattctaacttttgttattttttcacttttaatcatggaatgtgtgtcacattctaggcaaggtcattccaataaaaaaatgcatgttaagtaagaactggtggatctaattgaaatgcagagattctatcagtaaaatcaagagtaactacaaatttccagctgcgtacttaccatctccatttggatgtaaaatttaacacgtgaacttaacatgtgaactctttattttattttattttattttattttattttattttattttttgagatggagcctcgctccgtcacccagggtggagtcagtggcaagatctcagttcactgcaacctctgtctcccaggttcaagccattctcctgcctcagcctcccgagtagctgggatcacaggcatgatcatatcgggtaatttttgtattttcagtagagacggggtttcaccacgttggccactctggtcttgcactcctgacctcaagtgatccgcctgccttggcctcccaaagtgatgggattacaagcgtgagccatcatgcccagctgtgaactcttgatattgcattccaaacgtgctcttcttgcagtctttcctatctcagcaatgtcaactacattcattcttccagtttctcaggccagaatctttggaatcaaccttgcctgctcctttcctctttatatctaatctatctgccaagtaatggctctacctacaaaatacatgtaagatctgactaattatttcaatttctgccactacgtctctagttcaagcaaccaacacttctcacctaaattattttagtagcctcctaattggtcaccttgaaccatctgtagttattcccagcactacagacagatgatcttttaaacaatgtaaatgagatcttattctttccttcccgcccgccccccaagatggagtcttgctctgtcacccagtctgcagtgccatggtgtgatctcggctcattgcaacctccacctcccgggttcaagccattctcctgcctcagcctcccgagtagctgggattacaggtgcccgccatcactcccagctaatttttgtatttttattaaagacggggtttcaccatgttggccaggctggtgttgaaattctgacctcgtgacctgcccacctcggcctcccaaagtgctggattacaggcgtgagccaccgtgcctggccagtcttgttctttctttgtgcaaaccctccaattcttccctctcttactctgagtaggcacaaaatgctttcaaagacatacatggcactaaataatgtgaacttactgtcccctctccaacctcacctcctacactcattcccttgctccctccactctagtcacactgtccctttgctttccttggaaaactctaagcacgtgtttttctcatgatctttgttttccatcccttctactgaaatactatttccccaaacaactatttggctcatcccttctctcctcaagtcttcacttcattttctattaaatattacaaagctcccttacccagagttagagaaagtcaagtttaatcttccagtcttcgaaattggtccaagatttctcacaccagtcgtaagtttagggtccttatggctaccctcacttcagactagctgtttacaaatatggagtccctgtggactctgtcagattttataactcagaagagctattcatagaactcagaaaagccctgtaattacaatgacagttttcttatagcaaaaagttacaaattagaaccagctgaggaatgagacacatagagcatcttggacttagaatgttccaaatgcaaaacttctctgtcctcagagatctattatcttcaggacatctattgtgccggtgtacttatggagtattgccaatctaagaagctcacctgtatctctagtttttattgggattttattactatatttaggcatgatcgattgaatcattgttcgcatggttaaaatcaatcttcagctccttcccctccatggaggtcagtatgatatcacatggctaaaagtctcaactctctaatcacatggacagtctttctggcagggagagacaaaggacaatcacatgttttattatggactccctcaccatccccccctcacacacacactgatacttactcacccgccatttctatttatccccagtcctcattttattatcactagcacctagtatcatctaacatattacatcatttctttattgatcttatttattgtctttctcatcaaataaaaatggcaagataaaggaatttctattttgtatttgttgaatctcttaccactcaaataatacctgatctagtacacactttataaatatggttgaatgaaggaatgaatctgttttctaaatttaggtcttcttatagcccttctattccttattttacaatagaatatcatttaagtgacatggaatggaatctataaatattttaacattttaaaatttattcaatatattttcctcaaacctcttatgacagtgaaagatttcatctagacttttaatatgtaactattaactatagcttcattttactagattttaaagctaattaaaatatattctctcaaaaattactatagcttacttagaaataactgtctctgaattcctaaggataattttaattctcgttttaggcttaggtaggcagcactaggattctataattccaagaatactttatttttgaagctagatgcataatttttcttcatatcagggcatcctgaatcaattgatgtctttttctttaatctgttcataaaatgagttatcaactatgtgctgaaatatcaatgacaagcaagtaattttctgtaacacagatgtaaaaaaaaaagatactctgcttttttttgttgttaagttagctgtgtcttaaaacctttcaaacctacatatgaagaaaattctaatgggtgatctgtagagcattttggtataccacaaagtagaaaaagaacctgatactaagaatagaacacatacaacttcatggaaagttttagttattactattttgaagtatttattttgtgacgagaacaaaaaattctttgagaaatagcaaagtcaagatgtttaaatttatgttataattttgaaataaaaaatatgtagtgttttggaattgtgcatggtggaaatatgttgtatttcacaaagcttttaattgatacagacagaattgtctctcttgttattttgtaagtctttggagatttcttcaaattatagaataaaatactgcatcacttcaatagctatttcaatcttttgaaatagctgcatctataggcaaaggaatcttattatctctaaattacaatttggtatgtcatgagttatttcataggacaaagtttgttaaatgaacactcactggcagtgtcattagtgctttgctcttgaactcaactacgagtcagctctgtttacgttgccattcacagaagacagaaatgaatgcgcagttaaaatggtgccataagtaaagtagagcagaattagaagaaaactggacaatttaggaacataagaattgctgtactgaatcagaccatcggttctcctggtttaatatccagcctccagcagctgtacttgttagtttctacagctttaaaagaaagaaaaaagactacataatttacctagacaattgtgccatctgtgatctggagaaatgttctccttgacctctctcaaataataccctaaagcaggaggtttcaatcttgctatgatattggtttagcttgaatagctctgattattaataattcttattaaattatccaattcctccataaaataaactagtacatcaagaaactgtttgtctctaaagctcctgaattcatggttgaacatgtctgcatctatgataaaatatgaatttatggtgcatattcaatataagttcttgatggcaaaaatctgcctcttgataaccatactggatgaatgtttacttcttccaaattctactggacttagagactttggccaaacaaaacaaaacaaaacaaaacaaacttagatcggctcatactactccaaaatttctatctattaataatatacagaaggtatctgaatgatgaaggattttttgtgttgaacttttagaaaatttcaaccagagtttttcttaatatgatttagcataaggtagaataagagcaaggaatgaattacttatctttgtcactttaatcttttgtttatgttagaaaaggctgaaaaactttatagtttcttgattattctaaataccaccttcagatcaatatttctaaaatattatgctcacactagccatttagtcaaaagttcctcaagagtagtaaatgcctacaagttcgatttcaaacaattttccagggctgttagaccttaatgtgacaacactaatatcctaagtccatatattcaattgtatctccttctatcctagaattcaacaaaactagttttttcgtcattatttgaactaagaagtagattaatcattaatgtctatgttaattctatccctttttctagctttcccgactttcctttctagctcaggtccttatttcctctctttcagccagattcccattccatcaggtaatttcctttcaagcatgtaatgactgctccttcttctgaacaattcgtggccctttttttagactcggtttatgctatcttatgttgtagttctttgtttccctgggttttcttgcttataaattccctgaggaaaactttgtgtttcatatttatatttctagaggctagatctgtgtctaactcatactaataacataaagatatattataaggaaatctacagatgtagtgactgtgtagagccacttttaaaaatctctgagttcctgtttgtgtgaccttggcattaatatattattgagtgctataaaggtataaatgagctcaacactgtagatattgaaaagatagagtcgacagttattcattttcaaataacaactataagcatgggaaatatcataaaaagataatatgaaagttttgaatgagtttagacacataaaattggaaaataaaagaattccaagcaaaagtaacagctagagcaaagagaagaaatgaaaaaaggagggatttactggggaactctatctaattccctaactcctattggctgggtgtataaaaagaatatctgaaaataaatttggaaatgtgggtggtaccatgttcattaaccttaatatgaaaccacttaagaattattgaaagatttttaattagtaaacagatctatgagatgttagctaaacttaaaagtgggactgaaagaagtttcctggagtaatgagattattacataataagatttgtaattaaacttggtcttaaactcaagcagtattaataagagtatatagaatgaaatagatgcaaaagatgagtaagtgatatgattccttattgtgaaatttttgggcctaggataagggaagataatgaaacaaaagtaacaccaccctttgagcacgtttaagtgtgaatgaagatatattttattgaaataaaaaatttcttcttccaatatgttaagcagaaatgcatataaaaaattcaactttaaatttcaattcttacaattttaaataacatagtggttctcagtgctcaaaccactaagcccagttcacatacgtttcatatcatcaatatatatccacattttttctgtcttaaattctttaaagctcttgtgaacagtgttagaaaacaatattctttttaatctaacaatgatttcaattttactataatgtctctattttattatttaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggtgtgtctgtttttagtgtttggttatttaatagatgatgggttatgtaaaaaagggatgaagtatactctccaaggcacggtgatggagttactatatgtatctctgactttaaaataacttggtttaatgaacacattatttttaagactttcttctatcaagtttagatatgttttgaactcttactatatgaccagtactttagtagttaaataaagaaaactaaaatatagatttcaccctgtggaaatataaaatagaaaaaggaaactaaaatagagccctacttgttattcagataatctttgtggaattaattaatggacaaagaaataaatatatcaaataatcataatgtatggaactaaaaaataagatgcataaattggtaaaaacagatttattgataaataatagaaccttgatttaaatggagaaaaaaactccgaagtttacatatttaaaaacacaataaagaatttctaaatattctgaacttggaaatatttatctaagagcacacacgcacattacataatatgatatgatataatattacatattataaacaaatagttatttagttaactagtcttaaggaagtgattggtgagaaatgggtaaggaaatacgatgaaaatttgttcagattattatctcaatattcattattaagaaaatatttcaatccacttgagtgatcaaacatgtgtcaccttagtttgatcttctctgacaaatatgacatatatccaactcactgtctagattttaaaatttcagctgtttataatccatgtggttccttaagtatactttctgaaagtaattgattttcagccatcagacatattgctggtcaggtccttcagagtttgctattctgctcatcatgacgatctgtaattttcaggctgtatatttggtatcataatacagtagatgttttccatttcttgtttagataagttgtgggctagtttcagcaaatatgggcatctcagagctgtatttgattgcttaatatgccttttgattatcagacattactcacaaaaattataattatgtactccatctgcttgggaaatgtttctgatataccagtgctctgtgtattaccaaatgttctgtgacataatatataaccagggatgggattctgcttctcttggcagagcaacagtgccatccttttgtcctccaggtgtaaataacgaagaggtaactcattaatatgccaagagacccaaagagatactatcatttatcatatcacatactatatattattaatctttatttaaaatatttttatatgagagggttataatttgagatataatgagtgggttattttaagtgacttatttattataagccaagctgagcccttctggttaaatcatgtgtgatctattgcaatttatgcgatgatacaataaaatttgaatatcagcattttaaaaaactatccttcacaaatttctatttccaaatacttacctgccagaaagcagattaaataaacaaactccaaagtttttgccagctgctgctatttcccatacaatgttgaacaaattcctagcttgtgtaacgctgagctctatggaaatacctacctagctgtggtctaggaccatgcttaaggttaggttcagtgtgtcttgaaaatataattttgtattataccattttttctaattaattcccccataataaggttttcatattagatatattttataattttgaagtaaatgcacgatacaattattgtaacatgtattcactagtaataaaaatgttacatttgaacaaaatcagtttgaagttacaaggatttaggttttataaataaatagtgtggacagattaaaaagattaagggcccatgttcttgccatatcttatatttttcaagtcacaaaacttcaaatattttaatctttaatgttttgagaatgcgttagtcagatgacctgggctaaagtttttggaattttttttaaagcaactttatacctaaagaaaaatttcaaagaataactactagctggctttcttaaaaggaaaaatgtttaccttactcaagatggaagcccaataagctttgtaagtaccacctcagcaatagtttacgtttgagcaataaatgttctcaaataaaatgattcttgaaacttgtttaaacacacaaattctaacacttaactttcagaccatacttcagcacatggctatgctgttattgcatgcacctgcaagaaataaaattcacaatatttatttcaaatgttatcaaattcagatttccacaaggatacaactattcaatattacaatatcataactatttgaaaaaagaaaaagaagtagaaaaatgacccactgtcaaggataataatattttttcactaaaagtggaagagtaaatttatttaaagaacagaagtccttcatattatcctaatgaagaaaaaaagttagatccaataattcctccattgacctttgaataaatcatgcttgccaacactaaaaagcacgtgtaaatttaagggccaaaataccctttgaactggttactttgaaaatcatttactactatttgctaatcagttagcaagactggcagtcaaggatgagggagtgcaaaggtgatttggagaaaatgttgaaactagtttattgtcttaatatgcctgaattatcaattcctcattaaaagcaaaacaaaacaaataaacaagtggtttcgaataacttaataatcaagttaaattaactgttccactttaaactacatgaagtcttcacaaagcctagcctaagtttatactagttcactctatgttcttaccccatgctcaaaattacgacagaacaattaatgattgagatttattgcataaagaaatatgcattccatgataagtttaataactgatcaaaaacagaaaaataataatgtgatggagacagattttcagtgaacactcaaatacatgaagaatgttgttgtttcttaattatgatggcagacttaattaaatatcagtataatctctcctatcttcacctccactagcaattgtgggttaattcacctttgcattctcttctgctagggtctgaatgtttgtgtccccctaaaattcatatgttgacatcctaaccactaaggtgctggtattagaaggtgaatcgttgcgggaggtgatgagttcatggagaaaaagcctgtttaaaagggattaatgctttaaaaaaaaaatcctgagggaactcccccattcttccatgtgagaacatagcaatgagactgccatctatgaaccagaaagcaggtcctcatcagacaacagtctacgttgcttgatcttagatggaagtataatctgctggaaagcctcctcaattgtgaaaaataaattgctgttgtatataagctatccagtgtatgatgttttgttatggcagtctgaatggactaaaatattttctaattccttagactttgttaaatagacttagctctggtgaaaatttactcagtgtcctttttggctagacaaaaaacaacaaccacacacaaaaaacttatcattattattttcatagaagagaaaacgattttttttccaaatgtgacaatacatgcaaaacaaagatcacaaagaagtgaactcaaaaagttatgccaatgtgtttataaatttaccgtttcacaaattgccttccacgactattcccttctctttaccctgtgaggcattaaacaaaaaattgattcccatcttttctatctccccaaaacccacacacaaagcaagttgtctctgttttacaatcacaacaagacttggtgacatttgaaataatcttaaagtactaaaatcattcatattactgagttggttaaaaaggatattattattgatttaaaattgggcatagaaagctgaagaataaaaatataacaaattaataggtcataggtatcaaggtgaatatatatatgtgatatattcatgtttatgtagagagcctctaacctcttattagatttatgtcctattaatatgctttgaaaatttatactaaaattgctagcctaggtataaagtactatcatttttccaaggaatactcaggtcaacaatatgagttgttacatttacttatgcatattgtatcatacaaattcacattttctgtgtgtgtttatcattcatccattaggcaattatttttagaaaataaaaactttattatttattatttttcataccacataaaaatttataatctgccagattttaactgttttatgtatattgagccatttggtcttttgcagaattttctttatttttttattttactttaagtgctgcgatacatgtgtagaacgtgcaggtttgttacataggtatacgtgtgtcatggcggcttgttgagcctatcaacacgtcatctaggttttaagccccgcatgcactagctatatgtcctaatgctctccctcccctcaccctccacccccgactggccccagtgtgtactgttcccctccctgtgtccatgtgttctcattgttcagctcccacttatgagtgagaacatgcagtattcggttttctgttcctgtgttagttgtgttagtctgctgatgatggtggcttccatcttcatccatgtccctgcaaaggacattatctcatacttttttatgacttcatagtattccatggtatatatgtgccacattttctttatccagtctatcactgataggcttttgggttggtttcatgtctttgctgttgtaaatagtgctgcaataaacatacatgtgcatgggctttatttatttatttttttgaggtgaagtttcactcttgttgcctaggctggagtgcaatgacgtgatcttggctcaccacaacctccatttcctgggttcaagcgatgttcctgcctcagcctcctgagtagctgggattagctgggattacaagcatatgccaccacgcctggctaattttgtatttttagtatagacagggtttctccatgttggtcaggctgatctcgaacccctgacctcaggtgatccacctacctcggcctcccaaagtgcagggattaaatgtgtgagccactgcacctagttgtgcatgggtttttatagttgcataatttatattcctttgggtatacacccagtaatgggattgctgggtcaaatgatatttctggttccagatccttgaggcattgccacactgtcttccacaatggttgaactaatttatattcccaccaatagcgtaaaaggattcctatttctccacagcctcaccagcatctattgtttcttgactttataataattgcctttctgactggtgtgagatggtatctcattgtggttttgatttttatttctctaatgatcagtgatgttgagctttttttcatacgtttgttggccacataaatgtcttcttttgagaagtgtctgttcgtattatgtgcccactttttgatggggttgtttgcttttctcttataaatttgtttaaattccttgtagattctggatattagacctttgtcagatggatagattgcagaaatgttctctcattctgtaggttgcctgttcactctgatgatagtttattttgctgtgcaaaagctctttagtttaattataccctatttgtcaattttggctttggctgcaattgcttttgacattttcgtcatgaagtctttgtccatgccttgttcctgaatggtactgcttagattttcttctagaattgttattttttgaggttttaccatcaagtctttaatccatcttgagttaatctttgtataaagtgtaaggaaggagtccagtttcagttttctgcatatggctaaccagttttcccagcaccatttattagatagggaatcttttccccattcttgatttttcaggtttgtcaaagaacaaatggttgtagatgtatgatgttatttctgagatttctgttttgtgtcattggtctatatgtctcttttggtagtaacaccatgctgttttggttactatagccttgtagtatagtttgaagtcaggtagcatgatacctacagctttcttctttttgcttaagattgtttttgctatgcaggctcttttttggttacatattaaatttaaagtagatttttctaattctgtgaagaaagtcaatagtagtttatgggaatagcattgaatctataaattaatttgggcagtatggccattttcacaatattgattcttcctatccatgaggatgaaatgtttttccatttgtttatgtactcttagttcattgagcaatggtttgtagttctccttgaagaggtctttaacatcctttgttagctgtgttcctacatagtttattctctttgtagcaattgtgaatggagttcattcatgatttggctctctgcttgtctattattggtgtataggaatgcttgtgatttctgcacattgattttgtacactgagactgctgaatttgcttatcagcttcaggaggttttgggctaagacgatggggtttcctaaacatagaatcatgttgtctacgaacaaagacaacttgacttcctttctttttatttgaataccctttctttctcttgtctgattgccctggccagaactcccaatactatgttgaataggagtgagagacggcatccttgtcttgtgccggttttcaaagggaatgcttccagcttttgcccatttaatatgatattggctatgggtttgtcataaatagctcttattattttgagatatgttccatcaatacctagtttattgagaatttttaacatgaggtgatgttgaatttcattgaaggccatttcccttgcagaattttcaaacagtttcttttcctacagagtggaaaatgtacttgcatccgtagtacgagattaatatgttgtcaaaattacaatcagtatgagtaatgctggtataatcccctctccaaaacaccacttaacatttttgttaaagccaacataagtattttgtgggtggggagggtgactggtttgcaaaatgtttattaatgaaaattaatgtgaaatattcctaatagcaattacccacaaaaatataaaaaatggaaagagaaaaaaattataaatagacatttgtggtggttttaaatgggttatctttcctaggtagttgacagttaactagtttctgaatgttttcaggacatcttatcagatgtataacaagatacctaatagaaatataatttatcttttaaaaagtcttttttgtcaactaatttgataacatttacagagcctatatgctgctactgtgagccaggaactgcactagcagctagagctgcacagatgaaaatgacagggtctgcttactcacagtgaagtggagtcagggcccaggaccatggaaagcttttaagaagagaagatacctgcactgaatctcaatgtgaaggcaaagtggagagaagccagataagcaggaaccagagatgaagtgtcttgtgcatcatgctaaagaatttaaattatattctgagtaaagccatttagtaattttaaatgagaaactgatatgttctggttattgattcataaatgtataatcttttactatattcacgagttattcttttttacctttgtcttcttagagtctagattgtaagaatattatatggcatcaacataataatttcatttctgaggtagggtctttcttccaaatagctgcttttgtttgctggttcattcgcatcaggaatatattcacttctcttatttttattttattttatttatgctttaaaaattattgtaaactggctttttcttgttttagtgtaaaagtatttactagtaaatttgcctctgaatgcaaatttggaaatatcatctatgtttgcataaacagttgactctggaaaaacaatctgggggttaggggcaccaacccctgcacagttgaaaatctgcctgtaactcttgaatcccccaaaatttaactactgattaagttgactaattaagcctacttgactggaccttaccaataatgtaaacatttgattaacatattttatgaataatatttttattatatgctatattattataataaagtaagctagtgtaaagaaaatgaaaatcataagagagaaaatatatttactacttattgagtggaagttgatcatcacaaaggttttcatacttgtcatcttcacattgagtaggctgaggagtaggaggaggggaaaaggagctgttggtctcgctgtctctggattgacagaggtggaagaaaatccacatgtaagtggacttgtgcagttcagactcatgttgttcaaggtcaactgtgtgtatattttttaccttttcttttaaacatttgtagttgcaaatttgctttgcccttgcacacagagatttgctttggagaaacttgtttttaatatctctatacatatgtgtacgttataaatattcacaaactatcttaagtattagataatctttttagttgatatgtctatttgatcattcgaaatcttgacataaatttttattttgtaaacatagattatacagttccctattttacatatttatatatttattaaatacaaatttaataagctttattggggtgataactaatgtaacacattatttttaacacattatttttcttttgcaaaaagtaaattatctgtctctaaggttacatatgttttaaatcaactgtattcttactacatagttatatgaataaggtcctcaatgtccttatttatttctgctctatttttatttaagaaataataaagttgcatgaaattctacaagaatgaagatatttctctgaaaaatagttacgagaattgtaagctttattaatattgaggatttaaaatcctattaatatatacttatttactcatttattttttggccttgatttttaccatgcctgctatacatttgccaactctatttttttcttttatttacatttctgctatatatttccccttgttcttttatcttcacttctctatattaccgtattttacacgtattatttaaatgccatcagctgaggtcaatggataaatactatgtgacctattgttgatattatgaattaagacactttttatacatattattatatagtatgatcattgtagtatgaataaagaggactttatatttactctctacataagaatctggaaaggtcaattgattcatttttctttataaaatataattaaaaccataatatattatggtagtctttccattatgttcacagtgtccaaaacacaaaatgttaccactataaagaagaaaaaataataataaaactctttctacaagttagggttctttatttctaaaattaatttttatcttgtttaaagaaaacgtcacatcaatatttgacctgtgaatttagtatcaagcctccactttctttttctcttttctacacatttccttttcttctctcattcagaatttgattattttttccctttctcataaaaaatatttacacttagagaatgacaatcaacattgctattatcattatatttgtggactttcagacaccatgaggcatgaaaagaaacattggtggcagcattattctttctttgtatctctgaattcatacaaaatatatattgatccccttcacaataagtacattgagttagaagcctgcattttggttgaggttacaattctaagaaacttacattgtttgagcattatgactgttctacaatataattatgttttaattaatcaattgtaaagcaaatacattgcctaccataaaggtctttatcctctcaaattttaaataagttaaaatttgctaatcaagtttaatccttgtttataatgtgccagccctaaattttttattatgatgttccagccacttaagttacatggtttttaatcatgaatattgctgacgttgataataatgtgaaaattgacttgtgactagattttgtcttcttagtaataaacaagccaatatgaaataagaagacaaagaaagagaggcagactaagaaaagaaggagaggaaagaggaaaacgtttaattttgattttgatttacttcaaactcaatattttatttactcattacggtgtattcactttctctggatttcattaggaaataattaaatgtttcatattttattgtctcaatcaatgccccctatttctaaagcagatttagatttatagagcatttgtgaactaaaaagcatttcaaaatactaaattgtatagacatttgataagacacataggaaaaaatgtaaatgtatgtaaatcagtgattttggtattattccatgaataaaaaaggaaaatcagatctaggactctttctataaggattaaaattcatggtctaaattttaaattaccaaaaatttatttatcaagaaaaattttttctggaatttagagtttttattttatataagtaagatttaaaacaacattttgttattttttaaaagaccataaaaatggataatttggtatgatatttaacatctttcttccacatctaatcttttttgaccctttatagaagttctattattcaccaaaaaattgtgattatagtgactgacctttttaaaagccatttttacatgaaagtgaaacactttatgtaaactttcaaatatttttccaatgtccaagcattgtgaacatttcaaacctaaatatatcctaaattacaagggatattgtaatgtctgcaaaaaggtttaaatatttttatttttgtactagcttaaaattagtcactaaattttctcctccaaagtaatatcttacaaagtttaattaatttcaaagatttctaactgaaaagtatatattaaaagagttgccagtccctattttcagtatacatgaaattacttaaaattttttgttagtttaatgactgtagcttagcattctaaaagtttaaaaagaaaaccacagttatatatattgcttattatgcctttataccaggaacaaaaatatgtgtcttaaaacattgtaatttaatagtttttactgttcacaatctgtattttttaacaatacacttccaaataaatcagaatttcaaagttcttgaagtatatagaccattagtggttcactgcctcacgctattcctacctacacacccctttctcctaacacatgcatatactttgcaaactacttgaaagcaggaattatctgaatcatctttctattttacaacacaattaataaactgctttcaaggtaagtggctgaaacaatgacttaatgttgtttcccattaaaatgtattggccagggatggtggctcatgactattcccagcactttgggaggctgaggcaggtggatcacctgaggtcaggaggtcgagaccagcctggccaaccaacatggtgaaaccccatctctaccaaaagtacaaaaattagccaaacatggtggtgcacgcgcctgtaatcccagctactcgggagtctgaggagggagaatctcttgaacccaggaggcagaggttgcggtgagccaagatggcgccattgcactccagcctgggtggcaagagtgaactctgtctcaaaaaaaaataaataaataaaataaaacattgtattataataagggtaaaatctatgtggaatgataattaaaaagttatccttatgcattaataaatacagtatgacctttgtatttgcgggttacacatccatggatttaaccaaccacgagtcaaaaacatttgataaataaatacatctatactaaacatatacagacctttttttcttatcattattccctaaacaatataatataataaacatttacacagcactttcattatattaggtatgaattatctagggatgtgcatggcttatgtgaaaatgttatgctattttacattagggacttgagcatgagaggattttggtatccctgagaggtcgtagaaccaactccccacaaatactaaggatgactgtagtcatatataattttcatcagaaataattatctgttatataactatatatgtaaatgagaccattaaatgaaatttgtgttattttaaagtgggtcaagaaaagagcataatatctacatatcctcttgaaaactaaagaaatatatgtaatgtaattatacataatacaatatataaactcattttccattttatatgttatacgttatataaattatatatacattatttgcattttcacataatctgtaaagattttattaaaatctcttttcaggcaaagcgagctaataacaaataataaagaataaataaagaaaataatgctgtactgtgtagttagagaaaatggcttttgtattcgaaattatttttcagttaatgaaacagataaaaattttgattaatacaacttattccatattttacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcattggtctctttgttttttatataaaggcaagaaagaatcttaaaatgagaggctcagccactttaaaacaccttataatagaaacagaatgctgctaccaagaaacaaaatataaaataatgtaattatttatgtaatgccttcaaattatattcttcatttgactcttgctctccctcacctcctctatcctcaaatcaccacaaacatgtacatatgtgaactacctttccgtaattcaaaaatttttaaaaagtggatgcatagaagtctaaagttaggttgtgtaccatctgggacagggcaacccttgcctggacccagaaatattaacatattaataggaaaattgttcaattccagaagagaaatggttgtactttctgtagacaaactgtcttatttttgcaattaaaaaaattacagagctgcatttattagcatgcttggcaagggagcacatgccattgaataaattcactgagtagtttactaaaggagagaagtcagagtattttaagttccaaaacaagggagtgtatattgtttatgctaattaagcattgaaaatttgccttcaggataggacaaattgaatgtataggtctgtgtactgatggttaaagcatgccctattgtttctttgtttttttgttttgttttgttttgttttgtttttttgagacggagtctccctctgtcgcccaggctggagtgcaatggtacaatctcagctcactgcaacttctgcctcccaggttcaagcaattctcctgcctcagcctcccaaatagctgggattacaggtgtgtgccaccacgccaggctaatttttgtatttttagtagagaaggtgtttcaccatgttggccatggtggtctcaaactcctgacctcaagttatccaccggccttgacctcccaaagtgctgggattacaggcatgagccactgtgcctggctgcaagccccattgtttattggtcaaaaagtgtctatagttagatacagtatgggtctgccatcttcactcagtcactcaaagttcatggtaccctagatacagttataataagagccaagtcagtgtttatattacttatgagttattgtaaataaagataaagatatttgctttatagcttctccctcattctgagaaaaaacaaccacacacaggatagatgggttattatactcaccatctttgtttcaggtgtcattctttccggattccactatgtttttctcaatcacttaagtctccttttgatgtagaatactctgatatataaaacaggatgacacctgttcaacaccattaaagatgctttaaaaatatacttgttaagattaatcattaggaaaacaacaaatgttcatagaacatctgtaaactgcttgatatgacaagtcctagtcataggaaaagatcctgtgaactactttgtcccatcttggacaaccaattggtgtgctcttgaattatatctagacattccttgacttattgtaatgcatttagccaaatgcaacaagaagtgttagccagcacataaacctctgcctgtttgttctataaaaatctaacatgaatctacttttcccagcactgttgcagaaatctaggttaagattataacaacaacaacaacaaacccacaaaaaagttgcctaacagaatctatgtgaatttctttactgatatcaccacgtaaaggtcagtttagagggaggattctaatacagggactcccaagtgatggtagaaacatggaagtcagtatctttggcttctccttggtacttcagtgggcacatagacggcaagaagtttggtgaatttaaacattaacagtgtgtaagtattaaaacaccaaatggaataaaacccttcctacagggcagactgtggtgagatgttatcttagcataaacacacaaagccacaggcatttgtattcgatacaaagccacaggggctattacctaattttgg

SEQ ID NO: 17018 - DNA, 11048 bp, Human
ataagaagaataattcttataagcttgaaacatgcgtatgttacagaataaaataacaatcccaggataacaaaacatttcactccctatccttttcataataatttaaaaggtatttcctcttgcattataccaaataatcctcacagcaacaggacacaaatgaagaaactgacatctgagaagacgaagtgacttgctcaatattatgtacccagaaattgatcacatactcccttgatcgttatcataattttgatctattcatctgaaaaaatgaaaagaatccctctccttctgcccgaccccatttcaggaaagatatactaagataatacatcacaatcccgcccagaaccttgcacttactaagtaaatgtgcaagagcaaccatgagtgtggatcaccgggccagactagcacagaccatagtggagatgtcacaaaggtgattgcaagcggaaggcaactgtaaagagaaacattctaggaaggtgagagttcctcagcttacactaaaggttgcctgataaatattaaattataatggtcaatcttgagcaataataagtgaaagaacataggatgccaatatttctaagcaaactcaaacatcctgctttttaagattctggccctaagtaaggcacaggctccccgctgttcccctccatccaccttcccatctgtggcctatccaagaaaatgaatgctgtcttcacaaaggtcccacagtggaaacaggagacaggcttctgagtcaaggaaacatcagtgggaaaaacgccaagttggaatttttcggatgaaggggtggcgactcaacatatttaagtccgtttcttaggtagatgagtagatggtaaattctgtagcaaaagctgtttctttgttttgttttgtttgatgctgttgttttggtaagtgctactgtcttcacacaacagacctttctcctgtcttctgcagcgggactatttataaactgtgtaccagtgctaccccagtcagcaacctccaaagcctgcattgtacttggtaaggttctctatcagtatcactaacctggaaaaactgactgtgaagaaacagcttgattatactggctgcacatgtaaatgttccaagaataatttctaactcaacccctttgaagttattgttttttcctccattagatcggtattagcatctggctaaattttgtatcctccacctccacctccaccttcctgaacacataagtacttatacacacacacacacacacacacacacacacacacgttttttttttccccctgcaggtttcacagctggtggctgaacagaaacagtctctgggttgagactttacactggtttccctgacctggaagagtgaaaaatctagattatttcaggaatttattgtaagctttccacccttctctgtctcatcatgtcttatctacaaaatggggtgttggggaggcaggagccctatctttctgatctagcatcgccttaggttgagatattaaaatttcaaaacacaagcaagcaaataaaaaaaataacaatttgttgaaagaatcaactgggtaactataaacaggattctaggtgtcctttaaaaggaagatattattatcaaggaacagaacctttgtagaatggcgctttgggggcctgggtgggtccagaactaaggaagtttgagttactgccaagctacagtcccaggccctgcggggagtcaggtccaagtttgagaaaacagtcatagtcaggggctattgtggcctggacagaggcagaaagacacgacacagcaggcttccttcctgtcttgctcttatctgaagttgcagagagtgggtgggagtatgcctgaggtgcaggtgaggcacgtttagcctgagccggccacggactccacttcccctgctcttcccccagtggcaaatccgcgccacctcgcaaacccccaactcaggcacttgggccccttttgggccccctctcgctcctccctttaggcacctccctgggcccgcccacggtctccccccagtttgggactgcgtcataagtatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggtagctgtcccagggcgggatgggggaggggtgggcgaaagaaagaaggctggtagcagaggagaaaatgtagcttccctgggagggcccctcttgctgctcttacgctgtctctggggtttacccggtcgcctcggttctgtctccttgcggcaccttctgcttaccgcaccctctgtcactctgcattcccgcgtgtcgtgccatgttctgtctgttccagctcacaccagctgtcctggagggaggtcagagagagtttgaggagatgccctgggactccttgtcattgtctcttgggtaacgtgtagggacctggggatcaaggaggggcatgtcgcccagtccccacctccaggggcgcgcatagtctccccagggacagaggggacacaggggggtgagcaagaccgggagatttaacatttctttctttccttttggtgtggatgaagttctaagactaaatctttctatgatctctgagtgttcgtggaggtggggtgagcagcaaagggcacttttaactccaagcagtatgggttggggcaagtggtctgcttgagcgcgcgaatattttccgtttctctctggtcataggtggctttaaacattagataaagaagctgtcaaaattgaggtggatcttaatgccagtgttgggtgttcactgtgcccttttactgcaagagccttgtatatttttagagtggtatttcctaaagaaaacactcttctcttgtaaaaataaatttgaggatacttttcaattatttttaaatttttttcttgttgaacaacatccccttccctctatttagagatctgaagcaggtccagtgttgtaatttaaactactagctttgacaggaactggggaagctcttccccaaaatgttatccattatttatttagtcctatttctacttcttttaaacacctactatgttttcagggttcgtatactactcctcagtataatctcaattttaaagggcaatagtattgtcttcgtgttctatgaaatctggaaagtgttggcgcttgcagatctgtcctgacttgtcttgttctctatatagttttaacttctgtgttcaaagtggagatataaaaagtcctttgagttaaatgagaatccatgtagtaaaagttgattgtacacacaatttgaaatgttaatgtgcttatccagctttttattatggaaactttcaatattaaatcctgcagtaaaactagcttttgtgtattatacattttagagctcaaaagtaacaccctcttgcattgttgaggttttgattaaatgacagaggtcaaatatgtaattgttctcctgcttagtttgtaggttaaacatggtcagattttttgggaggtctaattagaggccagtagttaaatatagccacacagtaatccttttttttttttttcttcaccgccaagcatttcatgacttgtagatagattcagttaatatgcaagcaatacttctgccaggattgtgggtgcgatgaggaataagcaaaactgagcatttgcactttgattatactttgctgttacgttttggagaaaacttaacaggatccttacctggccactataggacactgataataatatttgacatattgtgttgtaatacattgatcagctagctcattagaggttgagcatgacaaatatgatgtcagacatagtgtacaatcacttcgaaagagttccaagagaaattagctatggtaattgatggctcacaccaacctaaagtccaataaatgtaaatgaaaacaaaaaatccttatttctaggatgtaacatcttatgaaattgaaattctaatacttaggccttgcttaataaacttcctgaattattgaaagaataaatgaaattacagtgcaaactgttcttctcatgtctcagtagcaagaaaaaataaatttatttctcttagaatttcaaattaagctattatgtgacttatgagcaagttactttatctttatgaaactcattttagtcatctaaaatataattttaagtctccagttctagattattgtacagtaattccaaatcaaaatttatagttctatctttgtagtgctaatcttagtttaggtttttttttttaataaaaataattaaaagttcctgaaaattactgggacacagaaaagccttcaaggtttatagagtactaattagtggagggtttgaacttaaataaatttagttaagaaaatgggaatctcaaatttctttgaccttcaaagaaaaatatttttggaaaaataaacatttaacaaatgattgtcctttcatcttctgcattaacttgaaatctatgcatttgttttcaccaaatgaatttaaggttagttagctctgataaacattgcagtagttgtcctgaaaaagagctaatgacctaaaagactaaaacaattcgatttatatacacgtttgaatgatttactctttaatgatcagggcctagatttgcttacttcatttattcagtccttgagtaacaatgctgcttaggatgtattgtgacatacaaaaatgggattagaaagattggagtccactgccctgggaagggcacaatcagttgcttgtttgctttggatctttcttgtttcaatcccgaagcaaaatattgatttaacaaaatattacagtcactgttactacacagacaacttttgtgtctagctatcacaaatgctacacttcaaaatcaagtgtttcacccatgacgtggaaaatatttcattcatgcaatacacagttatagaatattgatcgatattaagaaacttttatttctcgattaaattaggaacattaaatttatatctctcccttcaatattttaatttctaaaatatggggaaaatggcatataccttatagaactcctacctttaaaacctaattttcaaaaatcagctttttgaaaaatcagttaataaattaatcaaaggatactaattctcttttaagttgacaaactgatttggaaaaaataatgaagaaacagaaccatatcccagaaagttagtgattatatcagtgtactagttcaaaaagtaattacttctgtttactgagtataatttctagagatcggctctactgcattgtgcctattgttaatactatattatacatttaaaaatgtgttaagagtcaatgtcgtgttaagtgttcttagcacagtaaaaaagaatatgacattgcataaataaatggtaattttaatttgattcttgatgcatgtattttgaaataatttcatatcgatatttgggtttagaaatgccaaatggaaggttaatataatcagagacattttttaacatctattagattcagaaattgtcttgaaataaattcagactacaattaaaatgagttaacatttaaaaaaatatcttgggtttcaagggaggtaaattgtacacaaaatcaactatgtgtctaaaagtacaatctggttttgtttttggttttgctttttaataaataggagctccgagttgccacccaggaaaaagagggctcctctgggagatgtatgcttactctcttaggcctttcattcatcttggcaggacttattgttggtggagcctgcatttacaagtacttcatgcccaaggtaataataataattataattattatactttggattactacttgctagacatttagtagcaacttaaaaaattctgtagtggtgactagagaaaagaagatttagggaaagttttcaagttgcctttcagttcataaaattgatttgtcttcattgtgataactgtagtcaacaagcctcggcttaacacatagtacaatgaattgatatgagtgtgaaaagccattcaaatatcatgatagtgattattagaaggttgtaattttccctttttgtcttttagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaaggtgggcttctcattcttataaatattccaggattttttttctctctctctctcttttttacttcattggcaggtattaaattcattcatgaatgcacatgtttttgaggcaaagccttttcattcttttgttgttgaatacacattagttgattttgaaaggatgtagccgcttaatctaatggtagttggaaaattcgcaatgttaatgccttctgtgtcttacctgacttttttcccctacctaacagggaatgactgcttacctggacttgttgctggggaactgctatctgatgcccctcaatacttctattgttatgcctccaaaaaatctggtagagctctttggcaaactggcggtatgtattttggaagtcaaatttttacataagcatttccaagtaattttacttccttgttttttaaaaaaataatgagtttgtccaaaacattttattttattgaaataattttgaaataaaaaacgttgtgaacctaaaactgctctagaaaataaagattattttttacagtcattatctggtgtaggaaaggatttaaatagtgtccttaagaatttgggcaaatgacatgaacagacattttccaaaagaagacatacatgcgggccacaaacatgaacaaaagctgagcatcactgaacattagataaatgcaaatcaaaatcacaatgagataccatctcacaccagtcagagtggctattactaaaaagtcaaaaaataacagatgctggtgaggttgtggagaaaaaggaatgcttatacaccattggtgttggtgtaaattagttcagccattatggaagatgctgtggtgatttctcagacctagacagaaatactattagacccagcaatcgcattactgggtgtatgcccaaagaaatataaatcattttattataaagacacatgcacaagtatgttcattgcagcaatatttataatagcaaagacatggtatcagcctaaatgtccatcaatgatagagtggataaagaaaatgcgatacatacacaccatggtatagtatgcagccaaaaaaaaaaaaatcacaaaaaaaaacaagatcatgtcctttgcagagacatggataaagctggaggccattatccttacaaactaacacagcaacagaaaaccaaataccgtatgttctcacttaagtgagagccaaatgcaaagaacacatggtcacatagaggggaataacacacactggggcctttcagagggtggaagatgggggaagggacaggatcaggaaaaataaccagtaggtactaggcttaatacctgggtgattaaataatctctacaacaaaccccatgacacaactttacttaagtaacaaacctgcacttttactcctgaacttcaaagttaaaaaggaaaaagaatttctcatttcaatctttgcttttgatttttagagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtaagtaactaatgtattccttccttcaccctgtgttacacagtggaagaaagtggaggtagaatacaggaaaaagtggggaacaagtctggatatattttcatttccacaaaaatttcaaaagccactttttttgcacatttccttacaggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtggagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctatacaaccactgtttcttttatttcatcacttgagatatagtcaatgtgaataattaatattacttatttagcttttggtgtacctgtaacagatctaaaattatgagcccaactttgcccccattcccacctacacatatttatatgttatagtttcatatttcactcccttttgacagtatattaattactcttttataaacatcccataattggcttatcatgtaaattcaactatttatttagaggcttcaggcgcatagcactttaaaatcttttgaagtgttttctttctcatcaaattaaacaactatacacagctataatggatcactaaggactaaccttggttaagatgttgatagcttttaagaacttcaaatgctgtgatcattactcatgtatctaagagtctaaacttcataccaaggggacatgagtactataaactatttcccttgtattaggtgaaaaatcgctcctgatatcccttattacctgctgggataccaactattggtcaatttcagtagccaaaactacttagtcgaatccatacccttaaatactaccattattttttaatgaaataaattaaacatttaactttaagaacttagaaataaagcgatggcacaaacaataaagcatacagaaagcaaaatgcagtatttagaagataataacagtaattgataaattcaagaactggctcttcataaagaagaatatgtaaaaagagtctgataaaatttaacacccattgcttgtcttaaaatatgcatagaaatttaggaaaaaggaaatacactatttccaaatttatcttaaataacatcacaactaatggtacaacacaggaaaggatgttggctattgaagctattcagtgttgttccagacattctggccaatgcaataatatgtaaaacaaataaaaatataacttttaaaggagggttaaaattatgtttattactagatagatttttacatataagatattagtggaataatcaaaactttaaaaattaatgagaagattcagtatgatagaaacaaaagccaattactttcctttataccacaaacaaccaattaaagggaaataccaccaggtaaaaaatattctcacaatagcaacagggacatcaagtagcaccaacaagaaatttatggaattattataaagaaagccatgaaacttaattaagagatataaaataaaagttaagtaaatagagaagagaggaagaacattacaaatagacaaattcttccacaattaaatttcttgttttaagcaatttcaattaaaatcccaaaataattggttttggaacttggcaaaattatttgaagtttcatctggaagcataaataagttagaatcactaaagaaaaaaatgaaaaaagagtaattggagacaggatgtcttacatgaacaactattaaaccacagccaaattcacaatagttttaaaggtaactttcacacaagatagaaaattatgatgccaagaaagagattctagtgtgtaaaagaacagtatcctaacagaagctccatgcaacgagatacattgtatatccaattttgcccccaaatctggctaaatgaaaacaaacaaacaaaaaagtcctagtggccatcgtataaaatagcataagggtaacagccctccaaatgcagcatctcctaaatttttactactaatgaatatttcttaaaagagaaaaacctttaaaaatgctaaaagtataactgaatgataacctgatgctggcatccatgagtaatggatatctgacagagactagctctctgattgtttttccagaaactcagagccccaaatctgtcaaaaaaccaaacaacgcatattctcactcataggtgggaattgaacaatgagaacacatggacacaggaaggggaacatcacactctggggactgctggggggtggggggaggggggagggataggtttaggagatataccta

SEQ ID NO: 17019 - DNA, 246230 bp, Human
  misc_feature (1)...(246230): n = A,T,C or G
aaaaaacaaacaaaaaacaaaacacttaggggcaggcatggtagctcacgcctgtaaatcctagcactttgggaagccgaggcgggcggattgcctgagttcaggaattcgagaacagcctgggcaacacggtgacacgtctctactaaaatacaaaaaaaattagctgggcgtggaagcgtgcgcctgtagtcccagctactcgggaagctgaggcaggagaattgcttgaaccggggaggcagaggttgcagtgagctgagattgttccactgcactccactctgggcgacagagcaagactccatctcaaaaaaacaaaaaacaaaaaacaaaaacacttcggaccccaattcactattccaaaaggaaaaaattaagttgaaagctgagtcatgcacaaactgcctttcattcctaagcagacatacttgacataatacacaattgactattcccctacctgctccttttctcttgttccctccctattttccctccagcccacttttcccctttaaatactgaattcctcaaattcatctttggagaaaggcagagaccacagactgtttctgtgattctgtgttttttcctttcaggaatgtccttcaccttggcaaaataaatttctaaatcaattgagacctgtctcagatacttcttggtttacagaagggatggaagattccaatacttttgagttttcctagccatctaactacaaaggagctcaaagccaattctattcctgaagtctgggacaggaatatgctggctactccaggcagcaggaagaatgatcaaagtaactttaaagctcccacctgtgtgttttcctacaacagtaagttaaggattctacaaaatctggggctttggaatgaagtaatgttaatttcaacagaaaaggaaacctattttttttatttgagacagggtctcactctgttgcccaggctggagtgcagtggtgcgatctcagctcactgcaacctccgcctcccgggttcaagcaattctcctgcctcacgttccgaagtaactgggattacaggcacttgccaccacgcccggctaatttttgtatttttagtagagacgaagtttcaccatgttggtcagggtggtctcgaactccggacctcaagtgatccacccgcctcggccttccagagtgctgggattacaggcgtgagccaccgcgcccggcctcaatatttcttagttaaccaaatataccccaactgtcatcaattttgttataattaattatcccacttgtaaccatttaaaaattatagatgagttttttttttttttcggtactaagtcttggaaatttggtgtgtattgtacacttacagcacatctcaacttgggccagccacgtttcagagctcaccagccacatgcggctcacggaagcggagccccgccgaggacctgtggcgtcctcccgctcctctaagggttccttccagagcccagatggcccgcgacctaggccccgccccgcgcccctcccaagttacatcacagagcccacaggccccacccgctggtggcccggtccgcgtgtgcgccgactctcgcactctcctcgctccgggcgcccagactctgagagagagcgacggccatcatagaacagcgaaggcagtcgatcggcctgcggtccgcttcggcattcgcaggccgcaggcgggaggctagagcccccaggcgcacctcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggaagcggccgcctccctgcgccccgcccctccggctagctcgctggctcccggctcctcccgacgtctcctacctcctcacggctcttcccggcgctctcctggctcccttctgccccagctccgtctcggcggcggcgggtaggtgcagccgcaggcggggtccgattggaggggcggcctcctcactgtcccggggctgcccgagccttgccctgcggcagctgggtaccccacggggcccgcccgaggcgtggaagggcggtggccgccggcctgcgagacgcgggggcgtccgagggagggggccaggcggggggctggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttggaaacattaccccagaacagagattgtgatttagcacatggaacaagttctccgccggtgtgagttagatccctttggtgaaattgtccctgtggaggagttgtgagggttttgctcacttccaggaacgggtaaattaaatgcatttgctgctttggggaagaggcagtgattgattacctttaggtttgtgctttaggacccaagctcggatgaaatacgtgttcctcgcgaaggttagtgttacccagctttctactggaaacccccttttctcctttgccttctctggtcctgttacagtattgctccccagggcctctcgattctctctccctggttgcatagcattgcagtgtttcttgcagtgtgtgtgtgtgtgtgtgtgtgtgtgtgtgtgtgtgcgtgcgtgtgtgtgcgcgtgcgtgtgtatgtgtgtgtgcgcgcgcgcgcgtctcccgcccatttccctgctgctgtgcttttggcaactgcctctgctctttcccagggatggttgtggcattgcatcaggggatatttgtgcttgtaatttgctcactcagcccaggaggagggtgaatagtatgctgtagagatggggggcgggggcagggtgccgtcagcttggctgggtagacagagaaatgggtgtggtgagggaatacagctgctctaggcctttggggtaacactgcccagtcatcagcccaaagagattcaaagagcaccaccagcagctatttttataaatcaatcctgaatccaagctgagcacatggatttagagtgaacagttgtcatgctctattacaagctgggtgtttggtagacaacattaaagttgctaagcaggagactcccatctgtactgtgcagtgtgtactttacttgcaacttttaaactttgcttttctcaactccaaagattgggacatctctcttcaggctgtgtcttttaaattaacgtagtttgctgatccgtactactacttttcaaatgaaatgttttcacctcagttacacacttcctttcaaatttagcttcaaaataataaagctgtcactttttgagcacttgccatctcccaggcactagctatgtttgttaacagatgaggaaattgagactgatgggaagaagaggtcacacagatagttaagtggcaaaaatggtatccaaccaaaccaaggtctctccaacccccacatagtagttcagaaacttcagaattttggtttacattgggatgattcaagtgcttgagaatttattcatgcaaagtaaacaaactcaccagagactgataaaccagataccagttaatgcatgttggaagtattaagtgccatgtgcacaattggatttaattgtccactgaccaggacacctccattgttctgggctgcctaatcagtaataaaaaggtagttgattatggaattggaaaggcactagatattcttagtgggtattttttaaatttaaattttatttatttatttatttttgagacagggtcttgctctgtcgcccaggctggacagtggcaggatctcggctcactgcagactctacctccggagttcaagcagttctcctgccacagcctccggagtagctgggattataggcatgtgccaccacactcggctgatttttgtatttttagtagagacggggtttcgccacgttggacagactggtctcaaactcctgacctcaagtgatccgcctgctttggcctcccaaagtgccctgggattacaggtgcaagccaccatgcccggccatttatttttattttattctattttattttttaagatggagtctcgctgtgtcatccaggctggagtgcagtggcatgatcttggctcactgcaacctctgcctcccaggttcaagtgattctcctgcctcagcttcctgatagctgggattataggcacccaccaccacacctggctaatttgtgtgtgtgtgtgtgtgtgagtgtgtgtatatacgtgcacacacatacatatatacatacacatatacatatatatacacacatacatacatatacacacacatatatatatatttttttgagatggagtcttactctgttgcccaggctggagtgcagtggcacgatctcagctcactgcaaccttcgcctcctgggttcaagtgattctcctgcctcagcctccctagtggctggaactacaggcacgtgccaccacgcctggctaattttttgtatttttagtagagacagggtttcactgtgttagggtggtctctatctcctgacctcgtgttccgcctgcctcggcctcccaaagtcctgggattacaggcgtgagccaccgcgcctggctaatttttgaatttttagtaaagatggggtttcaccatgttggccaggctggtcttgaactcctgacctcagatgatccacctacctcggcctcccagagtgttgggattacaggcatgagccatcacgcctggccttacgggtattttaatcaaggaacaaaagtctagtgagtctccctttccccagtgtaaaaacacatacagtgctggaggatgtcttaacacattttcctactctgtctcacttgttttttaagtagtctcttcaaatatttgtcattccagcatccctttgttaaaattttcaaatttacaaatacatttatattacctattaaaaagtcattttccattgtttgctgacagtgaaggaagcacctggattttcttatatataggcggcttagctttagtcagagagtagattcttcctaatctcatagtgtcttgttcttcctaatctcatagtgtcttgttctttcctaatcttgtttctgaatttggtgatcaatcctttggctctgtaaacttttgctcttgacagtttttggaatcactttgcttttttttttttttttttttaaagattaagcgtgagtagttgctatgtagcttttagatttccttaagatgtgagaaaatctgagaggaacattttgacccagtggaaggcatcttggcagttcatgtatatagtcaatttgaaaaggaaaccaagtaagtatcagtgatttcactttgtctttctaaacagcacttttagaaccaggttattgtagacttattgctaggagtgagtgggttgagaacaattaaggttaagaagggggattgtagggctgggtggctcatgcctgtaattccagcactttgggagcctgaggcggaggattgcttgaggccagaagtttgataccagcctggataacatagtgagaccctgtctccattaaaaaaaaataaaaacaacttagtcggtccccagataattttagtgtacagcaaaacaacaaaaacaacaacaacaaacttagctaggtgtggtggcatgtgtctatagtcccagctactctggaggctggggtgggaggatcactggagcccaggagttcaaggctccagtgatatgattgtgccactgcacttcagccttgctgaaagagccagacctgctcacccctgcaaaaaaaaaaaaaaggggtaataaagcacactgatacatataggggatcatattcatcatactcatctaccattttagagctcctaggccagtctttaaatgcagaccttatggtgaactattttggatgtcattaacattttaaggttgaaagtcaacacaattactttcgtgattctttttccttttttttttttttttttagagatgagatcatgttctgtcagcagtgggggagatcatagctcactgcagccttgaacttctggcctcaagtgatcctcctgcctcagcctccccagtagttcagactgtgtatgtgcaccatcacacctggctaacttttgtgattcttgttcttattcttttttttttttttttgagactgagtctcgctgtattcccaggctggagtacagtggcgcgatctcagctcaccacaacctccacctcccgggttcaagcaattctcctgcctcagcctcctgagtagctgggattacaggcactcccgctgcgaccagctattgtgattatttataggttaaaaaagttaatcttcttggcttgggcatgatggctcatgcctgtaatcccagcactttgggaggccgaggcagggggatcacttgaggtcaggagttcgagaccagccggccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaagagtggaactccatctcaaaaaaaaaaagttaatcttactgtaaactaatattttattagtttgcatatatttaaatatgtttaaaaatttatttatgctgggtgcggtggctcatgcctgtaatcccagcactttgggaggctgaggtgggcagatcaagaggtcaggagttcgagaccagcctggccaacatggtaaaaaccccgtctctactaaaaatacaaaaattagctgggcctggtggcgggcgcctgtaatcccagctactcgggaagctgaggcaggagaatcacttgaacccgggaggcagaggttgcagtgagccgagactgcaccattgcactccagcctgggctacagcgagactgtctcaaaaaataaatttttttatttataactttcctcacttctttttatatggaaaatagtttaaaactccttttaaataatttcaggtttacagaagagttgtaaaggtagtacagactttctatatacattctgtattcattccatttctcttagcgttaacattttatataacctgatacccttatcaaaattaagaaattagcattagtggaatattattgagcaaactacagactttcctctgattttcctgtgttttccactgatgtccttttcctgttacaggatccaatccaggataccacattgcatttagatgtcacaattctttagtttcttccaataggtgacagtttcttagtctctccttccctatctttccttgacacctttaaagatgagtggtcatgcatttgtagaatggttctcattttgggttttctggtgctttctcatgattagcccgaggttatgcattttggggaaaaataccatagagatggtttacccttcttgtcacatcatatctgggaatacctgatatcaacatgactcgttactgattaacttttttttttttttttttttttgagacaaagtcttgctctgttgcccaggctggagtgcagtagcatgatcttggctcacggcaacctctgcctacccaattcaagtgatttttgtgccttagcctcccaagtagctgggaccacaggcacgtgccaccacacctaatttttgtatttttagtaaaggcagggttttgccatgttgcccaggctggtcttgaactcctggcctcatgcagtccaccggcctcatcctccgaaaatgctaggatagcaggcatgagccattgtgccttgttaactttgataacttgattaaagtgatgttctgcactgtaaagtgactgttgttctgctttttaattttacttgatagaacctagaaatgagtcaccaagtcatatccatattctgggggaagggaattaagctccaacccctgaagggaggagtatcaaagaatttgtgggcatgttaaaattcctaaagtaattagttaatattttggggaacataactgtgaggttatacagaatctgatttctccttaaaaatttcctctacttattttagcattcattagtgaatcttgcctgcggcagcgttgattatattattctgttggttttctatttttctaattctttctacttttatgatttggaatccttttgtaaggaagatttatgcctcccccatttatttattaaatcatttatgtcaacatggacccatgaatatttttttctttgcttataatccagtactatattttgttgctcaagttgttccagctttggccattctaacattggcacctatgttcttttgaaatacctttccctacctttctttgtcttttagcacttttgtacttcctggcactgtaagatgccccagtctcatcttgtactttacctgccccaaccctaaaatcagccatttctccaaggtgtcctggttccttctgttggagaagagtatttggaaaccactatctggtttctaaatgagcttgatgcactcattactgctagggtatcactgcttctaggccctctcaggggatagttaggaagtaatatatatatatactgacccacacatatcttcgtttacttccgtatctgtctgtatataaatataaacatgagtttatactgatatctctgatgctgatccagcaccacagagttcattctagcattctcttccttgcttctttctctgaaagtgagaaatttggctgatttaatgaataatacatgctaattttttcaactctaatatatatatgaagtaaaaaatagtcttaattgtcatataaagtaaatttccaaagcattttgcagttgttaactaatttaaattatactcctataatattggtattttaaattactgtttttcagctcaggtagagagatgaaatcatttacccttggccaaacaggaagtgagtgattgtatctagaattgaagatttattatttatttatttatttatttattttatttatttattttttttgagatggagtctcgctgtttcccaggctggagttcagtggcgcaatctcggctcactgcaagctgcgcctccggggttcacaccattctcctgcctcagcctcctgagtagctgggactacaggcgcctgccaccactcccggctaatgttttttctgttttttgagatggagtctcgctctgtcgcctgggctggagtgcagtggcatgatctcggctcactgaaagctctgcctcccgggttcacgccattctcctgcctcagcctctttagtagctgggaatacaggagcccgccaccacgcctggctaattttttgtatttttagtagagacggggtttcaccgtgttagccaggatggtctcgatctcctgacttcgtgatctgcccaccttggcctcccaaagtgctcggattacaggcgtgagccagggcgcccggccaactggctaattttttgtatttttttagtagagacagagtttccccatgttagccaggatggtctcgatctcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccatattgttttaaaattatgattattttttgaggaggagcctctctgttgcccaggctggagtgcagtggcacaatctctgctcactgtaacctctgcttcccaggttcaaatgattctcctgcctcagcctcctgagtaggtgggattacgggcatgtgccaccatttttagtagacagggtttcaccatgttggccaggctcgtctccaactcctgacctcaagtgatccaccagcttcagcctcccaaagtgctgggattacaggcgtgagccactgcacttggcctaaaattaaatatatcttgtcactggcctgagagtcccttgaagtcagagaccatacttcatttcttgtttctctttctctactggcaaatgtatgttcaattgatgctgcagtcaggtgctacagtagtgggacttagcggagcataatgccactaatgacttggaaaatggcacagaagggaagtgggatattgtaaaactatttttacctattataaaatgcttcctgaggtccaggaaaggcaattctcacgtttgtctctgctcttctataccttttgcccctaattatcctttgtttctggaactcagaatactaaggatcataaagttaggcatttaagaataggaacattaatttgattttatatattatttccctagggaaatgtgttctggcctcattaaaaaaatagttttttcatgaatttataatttatttttttgggacagagtctcactctgttgcccaggctggagtgcagtggcgccttcttggctcactgcagcctctgcttcctgggttcaagtgattctcctgtctcaccctcccaagtagctgggactacaggcacacgctgccacacccaggtaatttttgtagagacgcagttttgccatgttggccaggctggtcttgtgaatgcctgacctcaagtgatccgcccacctcggcctcccaaagtgctgggattacaggcatgagccagcgtgcctggccaaatttattattagtagtagtagtagtatttttgagatggagtttccatcccaggctggagtgaagtgacatgatcttggctcactgcaacttccgcctcctgggttcaagtgattctcctgcatcagcctcccgagtagctgggattataggcgcatgtcaccatgcctggctaatgtttatgtttttagtagccaggctggtctcgaactcctgacctcaagcgatccacctgcctgggcctcccaaaatgctagggttacagacgtgagccactgctcctggcctcattaatttatttatttttattttttatttttttgagaccaagtctaactctgttgcctaggctggagtgaagtggcgcgatcttggctcgctgcaacctctgcctcctgggttcaagcaattctcctgctttagcctcccgagtatctgggactacaggtacgcaccaccacaccctgctaatggggtttcaccacattagcccagccagtctcgagctcctgacctctagtgatctacctgccttggcctcccaaagtgctggagttacaggtgtgagcgactgcacccggctacttttttcatgaatttagaagtatttatcgtaatgattggctatgttcattgttaattctgtgttcagattttttctcttttctttttttcttgagatgggtctcagtccattgcccaggctctggagtgtggtttggcatcatggctcattgcagccttgaccttctggtttcaggtgatcctcccaacttcagccttatgggtatctgggactgcaggcgtgtgccaccacacctggctgattttttttggtattttttttgtagagacagggtttcactatgttgcccaggctggtctcgaactcctgagctcgagcgatctgcccatcttggcctcccagagttctgggattacagctgtgagccaccgtgcctggccctcagcatttcttcttgagtaaactcaagcttacttattttcctttccctcttattcactaagttacagagacatgggggtaacaaaccatttgcagttaaagggcagtatctgacccatttgtttgttatatttttgtctgccctttattacgagacatggagaaatgctttttaaaagcacactgtacttcaaaaaggggtagttcctttttacttcattttatttatttttttgagacaaggtcccactctgtcacccaggctggagtgcagtggtgtgatcactgctccctgtagccttgacctcccaggctccagtgatcctcctgccttagcctaccaagttgataggactacaggcgctcaccaccatatggacctggacctggctaagtttttgcttttttttttttttttcctgtagagacgagatctcactatgttgcccaggctggtctcttaactcctggcctcaagtgatcctcctgtctctgcctcccaaagtgctgagattataggcacaagccaccacacctggccttacttttgtcagtcttgctagggatttatccattttattgattttgttgaagaaccagcttttggtttcattgatttttctctattatattcttattttcaatttaattgatttttgctctctttattttttttcttcctcttgttgctttgcatttattttgctgtacatttctagcttcttgaaataggaatttacattactggtttgagacttttcttcttttctaatgtatgcatctagtgctataaatttccctcttggcactgctttaactgtgtctcacaaattttgacatgggttttaactttcattcagttttattatatttaaaattttttctgaggctttctcttggacccttgatttatttagaagtgtgttgtttacattccaaatgtttggagatttttctcttatctttcttctgctgatttctagttttattctattatggcgagagaatacactctgtatgcttcagttaagtttgctgatttttttttaatgacccaagatatggtctgtgttccatgggctcttgagaaaaatgtatattctgctgttgttgggtgaagtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatccacatgcaaaagaataaagcaggactcctatctcatcccatagacaccaagttaactcaaaattgattaaaaacttaagacctgaaactataaaattactacaagagtacatagtgggaaagctacacaacattagtctgggcaatgattttttaggtttgacatagaacaggcaacacaagcaaaaataaacaaataggattacatcaaaccaaaaagcttctgcatagcaacagaaacaacagtatgaggagacacctatggattgggagaaaatatttgcaagccatatgtctattaagaggttaatattcaaaataaatcaggaactcaacagcaagaaaacaaataacttgattttaaaaataggcaaaggatctgaatagacatttctcaaaagaagatatacaaatggtcatcatatatatgaaaaaatgtttaatatcaccagtcattaggaaaatgcaaattaaaaccacaacgagatatcatcgcaaacctgtcggaacagttattataaaaaaaactgaagataattgttgagaaggtggagaaaaggtacccttgtacactgttggtgggaatgtaaattagtacagctgttatgaaaaactgtatggagttttcttgaaaatctaaaaatagaattaccatatgatccagcagtcccacttctgggtatgtatccaaaggatttgaaattagtatgtcaaagagatatctgcactctcatgttcatttcagccacaatattcacaatagctaagatatggaataaatctaagtatctatcaatcgatgaatggataaagaaaatgtgatgtatattcacaatggaataatattcaccctttaaagaaaagaaaattctgtcttttatgacaacatggatgaacctgaaaggcattatgctaagtgaagtaagccaggcacagaaggacaaaaccacattttctcacttatatgtggaatctaaattaatcagactcatagaagcagagagtagaatggaggttaccagagggtgaagggtgaggggaattgggagatgttggtcaaagggttacaaagtttcagttagacagggggaataagttgtttgagatccattgcataacatggtgactatagttaataatgatgtatatttcaaagttgctaacagtaaatttcaaatgttcacaccacaaaaaattaagtatttgaggtgatagacatgttaatttgcttgatttaatcattccatattgtatacctatatcataacaacactttgtactccataaatgtatacaattaaaaaataggcaaaggacttggatggacattttactaaagaagttatacacgtggccaataaacaaacaaaaaggtgctcaacagcactagtcattagggaaatacaaatcaaaatcaccatgagataccacttcacacccattaaaatggctattatcaaaaaaaacaataacaaccaaaaacagaaaaataataagaggtggcaaggatgtagagaaactggaacccttgtgcatcgctggtggaaatgtaaaatggtgcagctgccgtggaaaacaatactctgtggtggttcctcagaaaaattaaacagagaactaccagatgatgcagcaattccacctctaggcatatgctcaaaataattgaaagcaaggactcaaacaattagatacttgtatttctgtgttcatagcaggattattcacaactcaaatgtccatcaacagaagaatggataaacaaaatgtagtatgtatataaattgaacattattcagtttttaaaaagcaatgaaattctaacatatgctacaacgtggatgaaccttaaaaacattatgctaagtgaattaagccagacacaaaaggacaaatattgtatgattccacatatataaaatacctagaataaacaaatgcccactaactggagagaggagggtatggaggttattttttaacgtgtacagagtttcagtttgggatgataaaaaatagttccagaaatggttagtggtgatagctgtacaacactgtgaatgttgtgatgccactgaactgtaaacttaacaatggttaaaatggtaaaaaaaaaaaaagttatgtatattttatcacaataaaatttatgcaaaaaaaagcttatggtttgattttttagaagtatttatcctgtatgactaaagtgtttgtttccatgcagcttatgatggctcactgtcaagagttccttcctcatccctacccgatcccaattttgttttgtttactttgggcaacttgaatctatttcacccaggtttcctgctgcatcaattagaaggtatatatttttttgccaccatatgatgataggaacaaaaatagccaaggaatatcaatgctttgctcaggaagtgtcgtctcttcatctggccacttgtggtcactgaagacaatattgccctcagtgaatagcagcaattccacctttaagcatatattcaaaagaattgaaagcaaggactaaaacaatcacatacctgtacatgggtgttcatagcagcattattcacaactcaaatgtccatcaacggaaaagtgcataaacaaaatgtagtatgtacataaattgaatattattcagtcttaaaaagcaatgaaattctgatatatgctttgacctaccgctttctgttactgagaccgtgatacaatatgggcagcattaagacccaggagccctgggatctgcccttagcaaggttgtgtgggccttgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattgtctaaaacttttctgtcttgctagactgctactttcttggtcttttagctaaagaagactgacttttgttggggcttttcttttcttttttttttttggagacagagtcttgctttgtcgcccaggctggagtgcagtggtatgatcttggctcactgcaacctctgctttcaggtttcaagtgattctcgtgtctcagcctcctgagtagctgggattacaggagcccgccaccatggccagctaatttttttttttttttttttttttttttttgagatggagtcttacactgtcgcccaggttggcgtgcagtggcatgatctcggctcactgcaacctctgcctctcgagttcaagtgattctcctgcctcagcctcctgagtagctaggattacaggcgcccgccaccacacctgtaatcctagctactttattgtatttttggtagagacggggtttcactatgttggccaggctggtcttgaacttctgacctcatgatccacccaccttggcctcccaaagtgggattacaggcgtgagccaccgtgcctggcctgctccagctgattttttgtttttgttttttgttttttttgttttttgaggtagagtcttgctctctcgccaggctggagtgcaatggcgcgatctcggctcactgcgatctccgcctcctgggttcaagtgattctccttcctcagcctcctgacttgctgagactacaggtgcgtgccaccacacctaatttttgtatttttagtagagatggggtttcaccatgttggccaggatggtcttggtctcttaacctcatgatctgcctgcctcggccttccaaagttttgggatcacaggtgtgagccaccatgcctggctgggtatgtttttaaaatgacatttattttttctttttgcaaaagttttatttaatgtagataatttagaaacacaaaaattataaaagagaataacattttcatatatattcttctagacatttcctgtgaatatatatacatatttttcttgtgaaaataagaactatatatactactcatgaactttttgctcgatataagcatcattccttgttaataaatgcatgaatatagcaccaatttggtatcaatcaggttgtaatgtgcacattctggagatcatcaatatgtgttactcccctaggtcgagtgcctgagagacagatcatgtacaaataaacgacgtacattttcacatgaatctcatagttcagacatcacttatatactagagagagttagaagtaaatcagatttagtcattagttttagaaacactgggtatttgggtaggtatttagattttaaagtttaaaaataaaaaaaataaaagtgttcatgtggctttacgaatgctattttgattaaaattcttgttcatattttccataatattataagaagggtcattatacttttcagaagaacatttgagataataatggctttcttgtttgttcttggaggaaataggagatactagcagtgttgtttcaatgaaccctagcattagttttctgctggaacttgcaaaacagaaaccagaacgacttaaatcttttccatagtacagttttttctaattgctatgtggtatacttgcagatgttcagatttattgggaaatttagatttcatagcttaggatttttggtattagctattcagattgatgcatcaggtctaattaaaaattatactcaagtttattcttgtactttatgttgtctttttcttatgatgtgagtagctgcagtataactcaaaaccagtaattataaaaccacttaatgaatgaatgtagatgtaaaagcatataatatttggagttgttttagtttctgtttctttaaaggtgaaggtacatatgtcataatttgggaagctatcctttcaacttaacatggagttgaaattgaaatgtgttcttagacataaatttgagatgtgttattgaacatatttaacacgttatcagtttccatatttttccaagcagttaaccattgggtagtgcacagcaagctcattttcctcttagccgttctgtgcatcttgtggtttgagatgttcatcactgtctggctgtgaaccccaaatgtcctcctagtgatcctggaaggtattttagaatagttttggctttctgcttttgattctaatttatgagatctggagtggagtccagaatctgaattttaaaaagaatagctctattgagatacaatttataaaacatacagttcagccacttaaaatgtacagttcagtggttttcagtattttcacagttgtgcatccattaccacaatcagttttagaacattttcattactcaggcaggacgcggtggctcacaccagtaatcccagcactttgggatgctgaggcgggtagatcacttgaggccaggagttcaagaccagcccgaccgatatagcgaaaccctgtctttcctaagaatacaaaaagttagctgggtgtgatagtgcacgcctataatcccagctactcgggaggctgaggcacgagaatagcttgaaccaggacgtggaggttgcagtgagccaagatcgcgccaccgcactccagcctgggcgacagagcgagactctgtctcaaaaaacaaaaacaaaaaaacccaccctgttctccttagctactcttccacctaatccttccatttccctgcactcacaactcctagatttttatggtgtatggctctcagttggcgtaggggtagagttgtgattttgccctttaggggacatttgacagtgtctggaaacattctcatgggtcacaactgggaaggtgctattggcatgctattaaacatcttccagtttagaggacaacctctcataacaattttcttgtccaaaatttcagtagtgaaggtgttaagaaactctggaagagagttagactaaacaaattgcaagatcaaatttttagccctcacattggcagtaggatattatcttacatggtcgatttataatttatgtaaaattgttaaatgtattggggttatacagatgatagaaaaaagagtcttagggacctaagggactcagtttagtctagtctggaatagtatgatgtcctcgctgggagccatgaaccctagtctagagcctgggatgtagttgttgaatgaacatgattatgtggtggtagtttgaactaaaatgattcttagttatttcataattgatggatatctagattggtagacttcacatagctgtatagactattccctcttttaatcctcctatcttgccaaaatcaataaccataaaaaagaatgtgtagaagagtctgatttttatagtttatttcaaagaaatttaagagtctcaatggtgctataaagaaattaaagactggctgtggtttggttgacttgaaaaggatatgtgggtctgagtgtgtgtgtttaattttttaaattttcttttgtttttgttttcagagagagtcttgctctgtctcactgcagcctctgcctcccgggttcaagcagttctcctgcctcagcctcctggtagctgggattacaggtgcacaccaccacacccagctaatttttgtatttttagtagagacggggttttgccatgttgcccaggctggtcttgaactcctgacctcagatgatccatccaccttggcctcccaaagtgctgggattacaggcatgagccaccacagccagcctaagtgtgtgtgtgtgtgtgtgtgtgtgtgtgtgtgtggaaattgaatggttttcaaaggtgatttgattagcatttgcatagactgtgaatccaagatgtttgtgttcccttccctcattcttccattcttttctctgtttgtcaatttttgtaccgcgatatatgagggattaaagaaaaatcttttagaatagttttggctttctgccttttttttttttttgagatggagtttcactcttgttgcccaggctggagtgcaatggcgcgatctcagctcaccgcaacctctgcctcctgggttcaagcgattctcttgcctcagcctcccgagtagctgggattacaggcatgcgccaccatgcccagctaagttttgtagtttcagtagagatggatttcaccatgttggccaggatggtctcgatctcttgacctgtgatccgcctgcctcagcctcccaaagtgttgggattacagttgtgggccaccgcgcacgtcctctatagtttttttttttttttaagtttatgataaattgaaacaacactaagaaaatcagataatacaggaatattaaatgaaaaccgaatctttctgagaaatgaaaaatagtatctcattgtttaatttgtatttctttttagatgaaagaggctgaatttttttttcacatttattatttggatttctatgaagagtttgtgtcctggactcatttttctgttgggttgttgatagttgttctgtttgtttgtgagagcacttagtatattataaaaattaatccattgtgtagtacatgtaacacaaatattttcttctactccgttatttgccttttgactttactattttttttttttttttgagatggagtctcgctcttttgccaggctggagtgcagtagtgtcatctcggctcacttcaatctctggctcccgggttcaagcgattctcctgcctcaacctcccgagtagctgggattacaggtgtgtgccaccacgcccagctactttttgtatttttagtagagacggggtttcaccatgttggccaggctggtctcaaactcttgacctccggtgatccacccgccttggcctcccaaattgctgggattacaggtatgggccactgcacccggccaaaaatttttaatttaatttaatgaatttattttttttnnnnnnnnnnnnnnnnnnnnnnnnnnnnnnnnnnnnnnnnnnnnncctgggttcaagcgattctactacctcagcctcccgatagctgggactacaggcacgcgccaccatgcccagctatttttttgtgtgtgtgtttttagtagagacagggtttcactatgttggccaggctggtctcaaactcctgacgtcgcgatccgcctgccttggcctcccaaagtgctgggattacaggcatgagccaccacacctggccttaatttaatttttactagtcaatttttttagtagacctggtctcactctgttaccctggctggagtgcagtggtgccatcattgctcactgcaacctgaactcctgggctcaagtgatcttcccacttcatcctcccaagtagctgggtctataggtatgcactatcatgcccggctgatttttgcattttttgtagagacagggtacggttatgttactcagactggtctcagactcctaggctcaaacgatcctcctgccttggcctcccaaagtgctaggattacaggtgctggatccagctggcagtttctttaaaaattaaacatgtacttaccatactacccagaaatcactcctttggttatttactccaaataaaataaaatttatgttcacttaaaaacttgtacgtaactgttcatagcagacttattcaaaacagcaaaatgtgaaccaatccaaatgttgtgtcaacaagtgtaaagcaaaacatatgacatccatagcatggaatactactgagtaatcaaaaggaacaagcaagctatagataacctgcaacaccttgaatagactacaagggtaatgtgcttagtggaaaagcttatctcaagaggtcacatattatatagttccatttatatgacattctcaaagtgacaaaactgtaaagatgaagaatagattagtgattgccaggggacaggggggtagtaggtggaggggctataaatacagagaggtagcagaacagttctgtatcttgattgcagttgtggttataaaaatctatacatgagacaaaactgcttagaaatacacacacaaatgcaggttaaaaaaaatagtgaaaactgaataaggtctgtagtctagttaacagttatgtatcagtgtcataatgtttgagaccagcctgggcaacatagtgagatcctgtctctacaaaaaaatttaaaaaattagcccagtgtggcggcatgcacctgtggtctcagctactctggaggctgaggtgggagatcacttgagtcctggaggttgaggatgcagtgagccttggcgctgccactgcactctagcctgagtgacagagtgaagactttgtctcaaaaaaaaaaaaaaaaaaaaaaaaaaaggataattgagatctggatctacctgatgataaagtgtgtgttccttgcacagtaccatccagtcttgcctggtaattcctttcaggcctttacttggttcttaaatactagatgttgccaaataagtgatgctacttttactaggtgtggttaggaggcacagcatccaaagcaaggacatgagattgtaatacaaggaaggtgatgacttgctccattgtctgtggctttcttatgttgtaatgggagcttatcagtgtgcaccatgatcaggttacagcatcaggaggagctctacaacctattttagattcacagttaatattgtctgcttttttctttgttcttgtcattttcttttctcttttgtactttctctttctctctctctttttaaaagatgggagtctagatacattgcccagtacagtggctgttcacaggcataatcatagctcattgcagccttgaactcctggactcaagcaatcctttctgtctcagccttccaagtagatggaactataggctgtgtgtcactgtgccaaacatctctctctgtctctttattttttaagtgatagagaaccacaaatgtgttttttaaagaaccagcattttttcaaataccaaatatttgtgtagctgatgatgaggcatcactaggagtttccttttgttgacaaattcaagagagacatcattccaaatgaaattttattccgaaagtgaattttgtgaaaaccagtgctaagaaaataacaaaatgaacgaacaccaaaacacccatgtgtttacaaggaaacaagaaaacatggagttaaagtaagtaattgtgtctacttgacagatgttgggttttctttccctcttggactattgtgtttcctcaatttgtaggtttcatgtcatctttttaaaatagtagccgtcttttgactccttataagttatgttgggccaggccaccttaccacatgaattccctccccactttgcttggtatttgataccctgctttcagccaccatggcttcctccccacccctaaacgaagactctgattttgctctgcttgctctaccctacctgatggctttaggctaaattgtttatgctgaccggagtcagattttatttttagagagataattctggtgaccatatggagaactgggtgagagactgtcagtgttcagttgagtctagtgcagaatctaggtgaggggtttgaaccaaagtacatggggatggataaggaagactaagcactctacagacgatgatgataatatgataaattatataggttataatttactgaacacttgccatccctcataacaacttcatgattgaaggccttaacatttttatttattttatttatttatttatttatttatttatttttgagacggagtctcactctgttgcccaggctggagtgcagtggtgtggtctcggcttactgcaagctccgcctcctgggttcacgccattctcctgcctcagcctcccgagtagctgggactacaggcgcctgccaccacgcccggctcattttttgtatttttagtagagacggggtttaaccgtgttaaccaggatggtctcgatctcctgacctcgtgatccacccgcctcagcctcccaaagtgctgggattacaggcgtgagccaccgcgcccggctaacatttttattttatagatgagtaaacagtcatggagagattacataccttgcccaaatttacctagctcaacagaggaaaagaaaggataggaattcaggtggtctgattttagaacctgtgcttttgaccattatactagctgggggctttatttttctaactgttagaagtgttcaacaatgaaagagccaccctgtgaagtaatgtgggcatcacttgaaatggtcaggcaggaagtagacgggtcattaatactacatcaagggtccacatacacactgtggctagattactgtgaagaaggcttttaagttctgtgattttgtgatgtgatatacagggagttgttgctttatgtggttctcatatacactttcacttaccatggtttggttaaataataccaattccctaataacatggtttaaattttacacagcatattaactgtgaataatcgtataaagtacaaaattcgctgccagctcttctgtcactacataagtaacaactgtgcaaagcatgggtttgtgttacctccttgtctcccagtgataaatctatgtgatagttaagaaaaatcgataaccgatagagagaattggccgaaaaagatgaaagttcaggaaaaaaccaaaaagtaacaacagtggaagtgaaattcaaattgaactcaaatggagttatagaagaaatagatcactgagggaatgctgatgctctcattcaaaacactctggatatgtagccgaaataacttagtgaaggtgagcttatctacataagtgaagaaagtggtttggtaaaaaaaaaaaaaaaaaaaagaagtgatgcaagaaattttgtagtgaaagaactctcgaaggtattctgtgatattgaaatatgaaacataaagtatttgatgctattccagactcagacaggagtgtgacaattggctaaggcatagaaaagatgtctattgcagccgggcgcggtggcttacgcctgtaatcccagcactttgggaggccgaggcaggcggatcacaaggtcaggagatcgagaccattcctggctaacagggtgaaaccccgtctctattgtatgatgagaagaatgtaagcactatttaaactacccctaataaattttttcaaagaacttaaacattataattttcaatatttctatgttctctagtgcagtggtcctcaacctttttagcactgatttagtggaagacagtttttccatggaaggggacgctgggggaggggatgttttcgggataaaactcttccacctcagaagatcatcaggcattggattctcataaagagtgcacagtctagagccctcgcatgcacagttcacagtagggtttgtgctcttatgagaatctaatgccacgactgatgtgacaggaggcggagatgctcgcctgcccttcgctcacctcctgctttagtgcattaatgattagttttcctgttctttcaattttcctataattataactgacagagtttttaatgtttcaatgaaattttttttttttttttttttgagactgagtctcactcttgtcacccaggctggaacacagtggtgcgatctcggctcactgcaacctccgcctcctgggttcaagcgattctcctgcctcaggctccctagcagctgggattataggcatgcaccaccatgcctgactaattttttgtatttttagtagagatgggttttcaccatgttgtccaggctggtcttgaactcctgacctcaggtgatttgcctgcctcagcttcccaaagtgctgggatctcaggtgtgagacactgtgcctggcctcaacaaaaaaaaaattcttttttttgagataggatcttgctctgttgcccaggctggagtgcagtggtgtgatctcggctcactgcaacctctacctcctggattcaagcaattctcctgcctcagcctcccgagtagctgggattacaggtgctcaccaccacccctgggtaatatttattttattttttaaattattttttgagatggagtctcactgtgtcacttaggctggagtacagtggtgcagtctcagctcacgcaacctctgtagtgaacccgtcctaggttcaaacaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtcttttgtgatgttttcgggttcacccatcttgtagcatgtattaggactttattcccttttatggctgaataatattccattgtatgtatgtacctcattttatttatcatttatttgttgaggaacatttgggttatttctgctttcatatggtaactctgtttaatcttttgaggagctcccagactttttcaaggtggctgcaccattttatgttctcattagcagtatatgagggttccagttcttgccacatctaaaacacttgccattcattacctgtttttttttattttagtcatgctactgggtgtaggatctcattgtggttttgactttcatttttctggtgactaatgtgtttattggccatttgtatattatctttggagaaatgtacagattctttgttcatttttaaattaatttgcctttttattattaagttgccagagtttttggtattttagatacaggtgtgtgtggaaaaaacaaactccgtttctcctactgctgatattcttatagcaccctactgaaagcagatgtgtggggatttctccccaccagcaggcaagcaagcagtcatttctgcagctgacagccactcaattctgacataatcaacctggagatagcatcaagattccacaggttgagggctcagtttccaagactgcctctccccacacttcacatgccagttgtaagctcccgcttattttacctgtgcttctgactgactggctataaattggtgttcccatttatagccatgggcttaacttgctagagcagctcgcacaactcgaaaacacatgtttaccagtttattacaaaggatattttaaaggatacacataaatagccagctgaagagatatataagacaaggtctggaaaggtcctgagagcaggagcatctctcctggtggaattcgggtgtgctaccctcccaggactttgtctgtgcttatactagtaccacattgtcttgactattatagctttctgtagtatgttatgaaagtggaaagtatgtgtccgtcaaccttgtttttatttcagggttgttttagctattctgggtcccttgaatttccatatgaattttaggattgattgtcaatttctacaaagaagcttggtgtgattttcatgtatttttttggacacagggtcgcaccgcatcacccagactgagatggggttttgccatgttgcccaggctggtcttgaactcctgggctcaagtaataatgcccagtttggcctaccaaagtgttgggattacaggagtgagccactgtgcctgaatctgtagatcagtttgggaagcattgccatcttagcaatgttaaatcttctgatccatgaacttaaatgtctttccatttatttaaatcttccttaatttctttcaggaattttttttttttaatttttcagagtataaattgttcacttcagccgggcacggtggcttatgcctgttatctcagcactttgggaggccaaggcaggtggattacctgaggtcaggagtttgagactagcctgaccaacattatgaaaccccatttctactaaaaatacaaaaattagccgggcatggtggcatgtgcctgtaatctctgttactcaggaggctgaggcaggagaatcgcttgaacccgggaggcggaggttgcagtgagccaagattgtgccactgcactccagcctgggcagcaggagcaaaactccatctcaaaataaataaataaattgttcacttcttttaagtatttttttatgctattttaagcagaattgttttcttaatatcatttttggattgttgacgcaggtacttggtgcatttaaaatacaattttattggctgggcatggtggcttatacctgtaatcccagcactttgggaggccaaggcttgcagatacctgaggtcaggggttcaagaccagcctggctaacaacggcaaaaccccgtctctatcaaaaatacaaaaattggctggatgtggtggcgcacgcacgcctttaatcccagcactttgggaggctgaggcgggcagatcataaggtcagcagttcaagaccagcctgaccaattggtgaaaccccgtctctactaaaaatacaaaaattagctgggtgtggtggcgcatgcctatagtcccagctactcaggaggctgaggcaggagaattgcttgaacctgggaggcagaggctgcagtgagccgaggttgcggcactgcactccagctgggtgacagtgagactctgtcttacaaaataaataaataggctgggcgcggtggctcacgcctgtaatcccagcactttgggaggccgaggcgggcggatcacaaggtcaggagatcgagaccgtcctggctaacatggtgaaaccccatctctactaacaataaaaaaaaattagttgggcatggctgcaggcgcctgtagtctcagctactcgggaggctgaggcaggagaatggcctgaacccaggaggcggagcttgcagtgagccgagatcacgccactgaactctagcctgggggacagagcaagatgccgtctcaaaaaaaaataaaaaaataaaaataaataatatgattttgtcaaatttaaaaccttaagatcctattggcttgtaatagcaaggagtagaagcgtggattgtagaatgttcttatgaaggctttatttcatcaatggcttttaagcactttggggtcagactttgagctgttagtgattgtttttgagctgtagtccttagagattccaaactgatgactgcatatgtcacttgtatagtcaatgtgactggttttcaaaagccctttcagttatagagccaatgactgggcaacagaaatgcctttcatttatatcattcttctgttttcttggtgcaaagggctgtagttaagaggaacagttagattttagtggcttaccaagttgctttagaggaagtctatgaaaggactgttgagccaaacaatgttcagattaaaaaccagtctgttagcaggacagaatcctcttgcagatactttgtttaacctttaacttagtgcaagaagagttcaagctatgacttttgagattaaatcttaaattatgtaagcatgtttctgataaggattgttttatcatctgcatcagaaccatttggactgctttaaaatacagatttctggactcctacccagatttactaaatcaaattctgggaatagaacttcataatctcttttaaaccacctttccatgggatgtccacgttaaagtttgaaaactacttttatttatttttggcatccatatgtgtttattgatatagtttcccactcatcttgattcagggttctttcagtgctgtctctatctgaaggagagccttcctgtaggctggcagaggacagcagagcagccagacacacaactactattgtgcatgactgacgaccatggtgattttatagcatcctgggcatttcacgttcaggaagtaagaattggggctctgcaccaggcacttcttgtgcttgctctttttttctggagagggagggagattctttgtgagaggcctgttctcgtgaggggatcgtcagcactggaaaactgaaaaccagttttaatagtacctctttctgttaagagattggtttttaccaggactgaaatttttcaaattatgactcactgccaactattttttctgttgctgtttttgtttgtttgttttttttgagacagagtttccctctgtctcccaggctggagtgcagtggtatgatctcggctcactgcagcctttacctccccaggcttaggtaattctcctatcttagccctcccaaataggtgggactataggcgtgcatcaccatgcctggctaatttttgtattttttgtagagactggatctcaccatgttgcccaggctgatcttgaactcctgggctcgtgtgatctgcctacctcagcctcccaaaatgctgggattacaggcatgagccatcgcccttggcctacagccaactcttaaaagcaaaacaacactagaagataatggaatagaagatttcagtaggccgggcacagtggctcacgcctgtaatcccagcactctgggaggccgaggcgggcggatcacgaggtcaggagctcaagaccatcctggctaacacggtgaaaccccgtccctgctaaaaatacaaaaaattagctgggcgtggtggcaggcgcctgtagtccccgctgcttgggaggctgaggcgggagaatggcatgaacctggaaggcagagcttgcagtgagccaagatcgtgccactgcactccagcctgggcaacagagtgggactccatctcaaaaaaaaaaaaaaaaaaagtttcagtgcattgtacatagtatggatgagtattgatttataaaacttctgtttcatttatatatgtgtatgtgaatatggatcataatataaatttttttttgccatggatggtgataaaaagaaaaaaatgaagacttgagaattagaaaaacacatatttttctttccttcactctttcatacgttcttttgcatctgccatgctcctggaactgggataggtgctgggtgagcatccaaatattccgaaaatcctcactctttttttttttttttttctttttttggagatggagtcttgctctgatgcccaggctggaatgcaatggcgtgatctcggctcactgcaaactccacctgctgggttgaagcgattctcttgcctcagcctcctgagtagctgggattatagacgcctgccaccaatgcttggctaatttttgtatatttagtagagatggcattttgccatgttggccaggctggtttcaaactcctgacctcaggtgatccacccaccttggcctcccaaagtgctgggattacaggcgtgagccactgtgcctggccgaaaatcctcactcttgagctcacagtttatagagggtaataggcacataaataataaagtggtatagtagaagcacatgtcatacattaactgtgtactagaagtacatatcatatagagtgctcctgaagtcatggcgactttcatagggatggaggtaggttgaggggtaggtactgaaaatattgaagctgggtgctgtggttcacacctgtaatcctagcactttgggaggccaaggtgacaggatcgcttgggcccacgagtttgagaccagcctgggcaacatggagaagccctgtctctacaaaaaatacaaaaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgggtgacagaggcgagactccccgtttcaaaaaaattaaaaataaaaataaaaaaattcttaaggacagtttgaaactggagagaaatcataatgtactttaaaatggttaattgtatgttatgtaaacttcacttcaattaaaaaaattaaggacagctggaaagaaaactaatatacttttctgtttgtacaaaataaaatggtagatttaagaagctttaaccagggcttcaactttcacatcatagatactaactgtagaagcatagtgcgataactgatagttaaatagaagataaaaatccacatgaggagggcatgccattttaaaaaggagagctatgtgatgctatttccaatacatagatatagctggacttaccttctttatccctgagaaacgaaagcattctaagttagcagaggaaatgatgatcagaatgataatacctcctaccttttccccttgcttcctgatttgggatataggacagaaaagaaattctacttttagttgagaactcagggatgactttgaacaaatatatttgttaatctccttggacttttctcacttttaaaataaggaggttggattcaaatgccctttctaaagttttgtgatttggttggaaatattagatgtgcacatcaccaagttactttgttttgtttctgtgtacatgaataagcttttattagacttggtcactgttgtctctctgtgatcaacaagggtaagttagcttctaagagtaccagtggtagaactttaagatttgaagctttaacgagagtcagctagtttgcagtgattagagacttgtaagttaattgatatacacacttttgtctatatttattaagtttctcaggggaattgtagattatttcagagtgcagttttaggtcgtggatcagatttaagttggaagtaaataatggttattactagaattttttgtttttgtttgtttttgagaaggagtctttctctgtcacccaggctggagtgcagtgccacaatctcagctcactgcaacctctgtctcctgggttcaagcgattctcctgcctcagcctcctgagtagctgggattacaggtgcctgccaccacacctggctaatttttttttttttgagacggagtcttgctctcttgcccaggctggagtgtagtggtgcgatcttgggctaactgcaacctccgcctccgagattcaagtaattctcctgcctgagtctccctagtagctgggattacaggcgcacaccaccatgcccatctaatttttttattatttttttttagtagaaatgcagtttcaccatgttggccaggccgctcgcgaactcctgacctcaattttcatacattattattaactaaagttcatagtttatttagatttccttaatttttacctaaatacctttttctgttctaggatctcatctaggataccacattatgtttagttatcatacttagctttctcttggctatgacagtttcttacacctcccttgtttttgatgactttgacagttttgaggagtactggtctgatattttgtagagtgtccttcagttgggagttgtctgatctttttctcatgattagacagaggttatgctttttagaaggaagatcacagaggtaaagtgccactcttatcacattatatcaagggtgcatactatcaaatcatgtcagcatgatttatgtctgtgtgtgtgtgtgtgtgtatgtgtgtgtgtatgtgtgtgttttgctttatcactcaagctggagtacagtgctgtgatcacagttcactggaacctcctggactcgactcaagcttcctctcaactcagcttcccaaatagctgggaccataggcacatgccaccaagcccagctaatttttttttgagaaagagtcttgctctgttgcccaggctgggttgcagtggcacgatcgtggcttaccgcaaccctggcctccagggcccaagtgatcctcccacctcagcctcccgggtagttgggactacaggcacgtaccaccatgcctggctaatttttttgtttttttgtttttttttgagatggagtcttgctctgtcgcccaggctggagtgcagtggcgcgaccttggctcactgtaacttccgtctcctgggttcaagtgattctcctgcctcggcctcccaagtaggtgggactacaggcatgtgccaccacacccagctaactttttgtatttttagtagagacagggtttcaccatgttagccaggatgatctcaatctcctgaccttgagatccccctactttggcttcccaaagtgctgggattacaggtgtgagccaccgcacccagcctaatttttgtatttttcatagagatggggtttcgccatgttgcttgcctaagttggtgtcagaactcctggcctcaagtgaacctcctgccttggcctgccaaagtgctgggattacagatgtaagccattgcacccagctgatttatcactattgatattagtcttgatcacttggcttaggtagtatttgtcatatttctcttacccccccctcccattttcatattgtactctttagaaggaggtcactatgtgctatgcacatgtaaaggatgaagggttatgttctacctcttggaagtggagtatcttgtttggaattcttcactgaagacttgcttattctctctcatttatttattcagtctattgtttatattgttccagctttggtcattgggaacttttttagttgactcctgtgtaattgagttacccctatctttttttttttttttttttttttttgagatggagtcttactctgtcgcccaggctggagtgcagtggtacaatctcggctcagtgctacctacacttcctgggttcaagcaattctcctgtctcagcctcccgagtagctgggattacaggcacccaccatcatgcctggttaatatttgggttttttatagagacgggttttaatcatgttggtcaggctggtcttgaactcctgacttcaggtgatctgcctgccttggcctcccaaagtgctggcattacaggcctgagccacctcgtccggccaacttacccctatcgttgtttttttttttatttttatttttagcacttcctaactttctggaaatacaaggtacttcaggctcatcttgaatattttgttctcagtcctagaattagtcatttctccaaagagtcttggtttctttatcagagaatggtattagaaaccagcatctgggtgtgaggtatgctgttgctttactggggtgtcccctgaagattttaattaaacttcatctgagtttgaaaggactggaaatgctgtgtttaaatttttttttattttctaattgagacagggtctcactgtgttgccaagactgaaatcaaattcttagccttagatgatcctcccacctcagcctttcaaagtggtgggattacagacgtgagccaccacacctggccagaaatgccatatatataaaatatataatatatattacatgtgaatatgtaatatataatacataatattacatatgaatatataatacatatattatatatatatttttttttttttgagatggaatcttgctcagttgctctgtgcagtagggatctcggctcactgcaacctctgcctcctgggttcaagcgatttccctacctcagcctcctgagtagctgggactacaggtgcatgccaccacgcccagctaattttttgtattttaatagagacggggtttcaccgtgttagccagaatggccttgatcccctgacctcgtgatcctcccacctcggcctcccaaagtgctgggattacaggcgtaagccaccgtgcccgacctacctctttttactacgattttattactactggaactagatcttaaaatatcatgtaagatctctgccattatactagttgtctgtagctacatgtatggaattttaaaccgttcagattactaccttaggaatcagtatgcattcttgccttttccataaagcagaggtgtcaggaccaagcttttcaggtcattgacaaaactgaaaaaggagttagtgattattgcttcctagggaagtaagacttaaaaaaatatgcatttacttatttatttatttagagacagagtctcgctctgtcacccatgctggagttcagtggcgccatctcggctcactgcagcctccgcctcctgggttttaagcattctcatgccagcctcccgagtagctgggattatgggtgtgcaccaccacgcctggctaatttttgtatttttagtagagacagggttttaccatgtcggccaggctggtcttgaactcctgacctcaagtgatctgcccgctttggcctcacaaagtgctgggattacaggtgtgagccaccccacctggcttatttaattttgagacagagtctcactctgttgcccaggctggagtgcagtggcacaatttcggctcactcatcctcaacttcccagactccagtgatcctcacacctcagcctcccaagtagctgggactacaggtgtgtgccaccacaaccagctaaccttttttgtattttttatcgaggcaggggttcaccatgttgcccaggctggtcttgaactcctgggctcaagcgatctgcccgcctcggcctcccagtatgctgggattacagacctttgccacggtgcctgaccagaagtaagacattttggatgtgtgaatgaagttctgattatgttctaaaggaattaccactagttttgtggtaccttttttttttttgagaaggagtctcactctgttgcctaggctggagtgcagtggcgcaatcttggctcactgccacctccgcctcctgggttcaagcagttctctgcctcagcctcctgagtaattgggactacaggcgccggccaccatgcccagctaattttcgtatttttagtagagacggggtttcaccatcttggccaggctggtctggaactcctgaccttgtgatccacctgcctcaccctcccaaagtgctgggattacaggtgtgagccaccgtgcccagccattttgtggtacttttgttttccatttctctccctctcacacctttcctgtctactgactttgtgatttagttaaaccaagccactaaaacccagccaaaattctactaccaataagaaatgtttagagttgatgttgatttaaatagctttagtgcagctgtgtcgtacttaaactcctgcaaatttccctccccccccagagatggtgtcttgctttgttgcccatgctagagtacagtggtgcgattttggctcgctacaacctccgcctcctgggtttgagtgattctcctgcgtcagcctcccaagtagttgggactataggcgtgtgccaccacacctggctaatttttgtgtttttagtagagatgaggtttcactatgttggccaggctgatctcaaactcctggcctcaggtgatctgcccaccttggcctcccaaagtactgggattacaggcgtgagccacagtgcctggcccctgcaacgttcttgaagttaaagtgagtgaagttggtcttgattaagaacttatgctgcagatattgtgtgaatgggtatctacagaggcagttatttctcagctccagtatattgttgctaagtggaaatacatagtcatggcctgatcttcggattttttatttttttgagacagggtcttacactatcacccaaggctgaggtgcagttccgcaatcatggctcactgcagccttgacctcccgggctcaaacaatcctcccattttagtctcctgagtagctggaaccacaggtgcatgctcggctaattttttttattttttgtagacacggagtttcactgtgctgcccaggctggtctcgagcccctgggcttaagggatcctcccatttcagcctcctaaagttctgggattacaggactgagccaacgcgcctggccctgttttttaaaaaagctgtaaaactgtattttcattcaaagattactgattttggagatattggccatttttcaaaacactatatgggccactgcaccaaggggcctgtttgacctaggtttgcactctgaactggtgcttctcttgtgggttcagtgagtattcattttggggagggaactctgggcttggtgggagttgggagatgtttgtcctaattgtagctttgtctctagttttctagatggcttttggcaaagggaaaccactttggatctctcttttctgagttttaaaatttgagagtaaactggagaatttaaggttctcccttactcttttttattttacatgttcatacatgtatttacttgagctgtgaaacaatgaccatttatgagttggagacttcaggaagtcttactagtcttaagtgctttgggaatagaggagactattatgttttctctagatacacttttttctaggctacagaagattctcacctgctttttggactcttggcatacttgccgcctctaatcattatctggcagatgtgtacatagtaatgggtgatgcatatgtttctgttttttcaagcaaattgattctaatttgatgaaagctgtattgatatgtagggtttttggggggtagtcgtggtgatgggtagaaatagtaaagctgacagtgacagtattttcttagttatggagaacattttaatactttatttcattatttttagtttgaactaattaattgttggtggttctatatggaaataatgatgtaggtgggtgttcatcacttaaaatcaactgcataagataatggcataacttaattactgtaacagcaaaaatgaaatctgagaaacttctgaaatttagtcttttattaatttgagataagatttatttggagataagatttcagacttccttttatcagacaggtggttttataggaagattaagattcttctagaaaaatcttaaagacaagggaaataagtttttcttacactctaaccatatattcacttgacatatagtgtttttgtaaaaatatattcgtttcttacatcttcagaataaagcatcttgatgtaatgtgatttactaagaatcatacctctctgtcctgaaggccaatctaaattgctgttttgtatagattgccaatttttaaaagagaaactgttgtatttgagtgggatgtaataaatatgagcgtttatgatgtagtctcttgtgggaatgtttatttacaagtaatttaagcctctgtgagcctgacaaggcaaactcaatcttaaatccttgattaagtggaagtataaactgatggaataataggcaagcaggatttatgtttacatggtaattgcaacaattttggccaaaacatttggcctaatagtcactaattttgatcctttatgttcattagctgaaattgtatatgtagtagtttctttgtaaggtaatacaaagcagtaaggacacaggagaagagtatatttaaaagaaatttctcttcagatgtatagactttgctttatagttctaatgacaatagtccaggagcctctaagtcagcatattattattattgttattattattattattattattattattattattatttttgaggcagagtttcgcacttgtagcccaggctggagtgcagtggtgtgatctcggctcactgcaacctccgccttccaggttcaagtaattctcctgcctcagcctcctgagtagctgggattatgggtgtgctccaccacgcctggctaatttttgtatttttagtagagacaggatttcaccatgttggcctggatggtctcgatctcttgacatcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcgcaccattgcactctagcctgcatgacagagactctgtctcaaaaaaaaaaaaaaaaaagtgtgtaggtatgtatacctaataaaattagcgctttctaaaaatgcagtgcttgtcatttactattaagtcaagccatatgaaatcacattttgtcagtaaataaatgttcagatatccacaatcttatacagttctaatagatactcaagaaattttgtcgacatgaagagagtcaaatcataaaatggtagactgaaaaagaacttcgtggagaattcttttctttttgcaaacagaggtgactgggaggtcgaggctgcagtaagtcatggtcatgccactgcactcgagcctggacaccagagtgagaccctgcttcaaaaaaaaaaagaaaaagaaatgattgcactgcctttttttggttttggaacaaatattgtgataataacttttacttataaatgtagcacagaaatcttttactttgtaaaagtccctgaatagaaagtcaggagacctgtttctcctaccaactagtataatttttggaaagctcattgttcatcagtttccttatttgtaaaatgaggatgttagatatgtaagatctctgtattaattaggatagttgatgctaactctttaacataactagcatttcagtgacttaacacaataatggtttatttcttgctcacgtcatagtgtgagtgtttagcctgtggctgtcatgtaattgaggaatttcaactccttccatctggtgtcttggagtctcctgctggattctttgtatttagttggttgatagcaaagagcaccagcaagcagaatttcatcaagtgctttgtagtgaagcataattcttcagctcacattgcactgtctagaacccactcacatggtctcaacttctaactccaagggaaataggaaatgtctttctgagcacccagggagaagaaacagaatccccatctttgccacggtccctttcattttgtacatttttaaaatttttttatttattattttttttaaagacagagtcaaactctgttgcccaggctggagtgcagtggtgtgatctcagctcactgcaacctctgcctcccaggttcaagcgattctcctgcctcagcctcccgagtagctgggactacaggcacgctccaccacgcccagctaatttttgtatttttagtagagacaggatttcaccatgttggcctggatggtctcgatctcttgacctcatgatccacctgcctcggcctccccaagtgctgggattactggcgtgagccactgcacctggcccattttttgattctttattcacacccaaatactttctcctgttgcatattgctttttgtatctttggttactctgaatttacttccaaatttcttggaaggagtttagtattgcaagtcaaagcagccctttggtgcttgctatgtttaggagagggtctccccccaacccctgccatccccagatgagtatatttgttatttttgttagtagtttcatttgtggtgtaagtttgtcttttatattgtcatggcttgcttagttttaaatgattaaaaatacatcaattgcaaaaatctcccagtgcttgtataagaaaaacaatagaatattgaacacagccaacttcagagggaaagtcattgtctaccatgttcagtctagcagcctgctagcagaagggaaaacagacaaaccttatactgtcttttaaaggtcagcacatgcagacttagagaccaatagagaaacacattccagtgagcaggcaaagttctctttgacttctgcccacttaagagtaaactcagagagtcagcaaaagtctttcagttgatttcagctgctgttttggagtcatctccatctttccgaagcctccttctcttttctccttttttgttctttcttgatacattatattgtacatgttcatttgtatgtaaatacaaaatatccttctttatggatccatcttatgttggtaagtttgatgagagtgttctaattctaagccttgtctccttaaaatatataattatctcagaataatgccatagttcagtttgccttatgtttggattagtactttcttgtgtagttctctttcagtaaactgctcccctcccctgtttttaattgcaccttttttcatataccatttgcaccacatgtctaagtcattggtctttttaaattacactatggaaaggttaattttggacagagttgtttctagatcctagtgcattatcgtcatcctaggattgcatttcatttctcttgtaggctaatggtactattttttggatattgcagctttaataggatgctgtgttcatttttcatttcctggagtctgtgctgaagttcattttcagaaagaatgcctggaaaataaattttttttttcccccctgagatggagtgtcgctctgttgcccaggctggagtgccgtggcgcaatcttggctcactgcaacctctgcctcccgggttcaagtgattcttctgcctcagccccctgagtagctgggactataggcgcatgccaccacgcacagctaattttgttgtgtttttcgtagagacggggtttcaccatgttggctaggatggtctccatctcttgaccttgtgatccgctcgcctcagcctcgcaaagtgctgggattacaggcatgagccaccacgcccagccaataattttttttaaattgtgtgtttgaatttcccattttagccttcacttaatggatgagttggctgtaaaaatctagcttcaaaatagtttttctcagttttaaaggcatcacttcattttttaaaaaaaatcatttagtgttacaattagaaataagcccatctgtttcttgtaagttggtaagtactgctgaggggaatttccctccctcccttcttgccaccttgccgaggctgtattcaaattcctgggctcaaatgatcctcccacctcatcatcttctttttgcttttcttttttccttcttttgtccctgtctctctactctctccattgtctgttcgttttcttcatctgcctctgtgatcatgaaaatattcgccatgttattgtttaccgttcacatttagggctgccatccacctggaattactttttgtatatactgtgaggtagagctcaaaatatccagttgacccagcaccacttattgaaaagacagttaattcccccactattttgcagtgtcacatttgtcagatattaagtatccatatgcatgtggttccgtttcaaaaccatttttttgcattggcctcttgttttgttttgttttgtttttccatatgttcagcacaccaagtacattggcctctttcttggtgattgtgcaggtaccacaatgttttcattactatatttatgtatttttagtttcaaacatatgacattgccataggttagaaactcatcagttttcagcattttcacatggttcaatccatcagtaagttttgatatccagtagtttaagttcctctaagtttgttctcaaagattatcttagctgttcttgactttttaaattactatgtaaaacttaggatcaacttttcagtttgatttgaaaagaaaaaacctactggactttgcttggggttatgttaaatctatagattaggccgggcgtggtgtctcacgcctgtaatcccaacactttaggaggccaagacaggtggatcacaaggtcaggagtttgagaacagcctggccaacatggtgaaaccctgtctctactaaaaatacaaaaattagccggatgtggtggcgcacgcctgtggtcccagctattcaggaggctgaggcaggagaattgcttgaacctgggaggcggaggttgcagtgagccaagatcatgtgccactgcactccagcctgggcaacagagtgagactctgtctaaaaaaaaaaacaaaaacaaacaaaaactatagattagtttggggatagttgatacctttaaaatatcataaaaccttaaaataaaataaaaccttataggtttttcctaaaagcactcccttagtaaatcacttgtacaaaaatccgtgcctcagattctacatctagtaaactgattctaaaacaccttcctaacaagggggagtgtgatgtctttctattgttaagttgtattaatcctgtgttgcatttcatttcagtgaattttatcttgaatggattaggtagattgttgattaattcagtgaccctcaattgtgggtgcctctcggactcaactttaatgagatttctctgtgtcatgattacccttactgcaagaaaaccaacaacactgagatttttggtgcagtagcacatgcttctagtctcagctacctgggaggttgaggctggaggatcgcttgagcccaggagcttgaagctgtagtgtacaatgagcacacctgtgactagccaatgcactccagcctgggcaacatagtgtgacttgtctctaaaaaaaacaaaacaacaacaacaaataatactcatattgcttaaccctgtccctgaacaattctgatccagcgtgttttttttgtttttttaatacttttaattcagatttttacttgtatttcaggtaaaatattaaaagttatgttactaataacttgaaagatctcttcaacttttgctgttcaattttcatttaataatgatattccccccctcctttttgaaagcatctgtaagatattaggtcaaagtaaggcctttgccacgactacaaaatgcttgttaagtactcccatagagtttgtatcttctccttcttgctcagaaaagctgagctactctacccttagtcgtgcctagaaccaatacttagaagaactatgagggtgcttccagctgtgcaaacatcaaccccagcaagagaaggctggtatggtatggagcagagcgcacctagcaggacaaatgtgcatttaatgagagcctgtgaggtttcaagtttattatatttagatgtccaggataaaaggtgagaaagatgctatcctagccatcgaggaactcaagcgttaaggggaactctgggtgggacacacattgtaaataaacaattacaagggtgggcatggtggctcacacctgtaatcccaacactttgggaggctgaggcaggcgaatcacttgaggtcaggagttcaagaccagcctgactaacatggtgaaaccctgtctctactaaaaatacaaaaatctccgtctcaaaaaccccacaaaaaacaaaacaaaacaaaaattatagaattggcagcacaaattcctatgtcctcttctaccttccacttttctttattttcactgatataaaatagagtgaaacttcactttgcttaatgggagaagtttttcttttgttatctattattttcaagacagggcctcactctgtagcccaggctggagtgcagtggtgctatcacggctcactgcagccttgaacttcctctgctgaagtgatccgtccacctcagcctcccaagagctgggaccacaggtgtgcaggctaattttaaaatgttttctgtggagacgcagtctcaactgtgttgcccaggctggtcttgtactcttgggctcaagcagttttcctgcctcagccttccagaatgttgggattataggcatgaaccaccatgcccagccaaaagagagttttttctttaataaaatagttctcaaaagctaagagctgatcaagtatgaatattcttcctttcttccaatctcctcagcactaagtcatcctaaagttacatgatatgcttattactttctgacagatatatgagctgataactatagagatttaatattttaataattataaagttttaatatttatatgatcatattaacatgatggtagtggctgatatctttctctctttctctctctgtccctcagagatgtggtctcactttctcgcccagactggagtacagtgttgtaatcatagctcactgcatcctcaagctcctgggctcaaggaatcctactgcctcagcctcctgagaggctggcactacaggcacacaccaccatgcccagctaattaaaaacatttttttttgtagagatggtgtcttgccatcttgcccaggctagtcttgaattcctgggctcaagtggtcttcctgctttggcctcccagagttctgggattacaggtgtgagtcaccatgccaggccagtaactggtcgaccatcttgaatatttgtttttgccacattgcatcatgtcatgcttttctaaaagcagagagagctatttttattgctatgcctaataatgataagatgaccagcatggagagctggttcgtacggttactccttactggctttctttctataattccagacaacatgcttgctcttgtacaaactgtgtttagaaagtggaagaaaataggtgaatattcttttttatttttatttttttgagacagagtctcactctgtcacccaggctggagtgcagtgacacgatcttggctcactgcaacctccacctcccaggttcaagtgattctcctgcctcagcctctcgagtagctgggactacaggtgcacaccaccacgcccggctaatttttgtatttttagtagagaggggtttcaccttgttggccaggatggtctcaatctcttgacctcataatccacccacctcagcctcccaaagtgctgagtgctgggattacaagcatgagccaccacacctagccaaggtgaatatttgtaattggtgataacctttcagccttgaatctgtttattctttttctagttgtgaagagtttttgtaattttggaacttctgattaatttcaaattagattcaatttctaataactttcatcgtgtcattttagaaatgtgtttttagccccttgttttgttggtttttatcattttggcctgtctcctctgtagtctactaggaacagagaaggtgtgcacatcactttgatgtggtcctctcttctgggacccagcagtttacaggagctggtatatacaactaactacagtggggggtccccaaccctcggtctgtagattggtaccagtccatggccagttaggaactgggctgcacggcaggaggtgagcagcaggtgaacagcattacattaactttgcgataagtgtgcctgagttctgccttctgtcagatcagcagtggttttagattatcataggagcgcaaaccctattgtgaactgcacatgcgatggatctaggttgcatgctcctgtgagaatctaatgactgatgatcggaggtggaagagtttcatcccgaaaccatctcctccctctcacccctcctgctatctgtggaaaaattgttttccacgaaacctgtccctggtgccaaaaggtttggggaccactgaactacagtatagatcagactctactgttacaagtacagatgatgtattagttctgaatactactgggagaaagattctaaaaagcagtcacagaaaaggtggtaagacaatttatgtggaccttgatttcaagactttcacaaatgaggagggagagaagataacttcaagtttggagagcaaatgagcatagggtgtacagtgataatgtaagatggtagatggtcccatgtgactaaattgtagggagaccctacatggaaagctgctgatgattatggtgggtgataggactgagtcttgtcagtcagccttgatattacacgtaagagtttggatttacaaaaaaaaaaaaaaagaaaaaagaaaaagacatctaggcattggggtccctttaaagatcaggtggaatgttttcctgatgttcaggattcttcctgcctgcctccctccttgcagaagaaaagataggtaggtataagtagtaggtaggtaaaggtatgtataagcaggtataattcaaaaggtatatgaagtacagcgaagtcattgtgttagataaaagcagaaactacaaaactgtaaggttttgcttattttgtcacgctctgcttctgtttttggtgttctgtggctcttttcgccgatcctttgtctcagcctcatttgtaagtgacttgttttttccatttctcatttttttttccatctattaaagtgaggggattggatcctagatcagttcaactggtgtaagcctttagagccaggcatggtggctcatgcctgtaatcccagcactttgggaggccaagatgggtggatcacttgaggccaggagtttgagaccagtctggccaacatgatgaaacctcgtctctactgaagatacaaaaattagccaggcatggtggtgtgcatgcctgcaatcgcagctactcaggaggctgagttaggagaatcacttgaacccaggaggcggaggttgtagtgagctgagatcatgccactgcattctccagcctgggcaacaggccaagaccctgtctcaaaaaaaaaaaaaatgcctttagaatgtggttagaaataatttttggattggtatagattaactctgaatgttttcctgtgttagaggaaggaagtgggataaatgtaaagtttaaaaaaaatgctcctttttcaaaattttgaggggttaggtattaagaatcttttaaagttttactcatttaaaaaatttagataaaatggaagattcattcttaaggttggtgatatcagaaatgtaagtgctgtgtcattgtcatttcttattttggcctacataaccgtaaccagacttcagacatcatgctgcctgtatcacatggctaacagtgggaggtatctggtgtgttcttcctggagaaatagattgaaattcatttggacagaaatgttgaaggcaggtgcctgatccaaaatgcatttagtcaggactgaacacaagctgcctggatagttcctgtaagtaagcaaggtagccttttaactttgtgatgcaaggttttatgtatgtgagtatgtgtgtgcaagtgtatacagtatttttatatccagagaacagggctcccttaaatggggggtgggggggactctggtaactacatgaaagtaaaatataacttctttaaacctatatcagtgtgttctttcatgtaggaatgtagctgtgtgatggcctcagctattctagtaatcaagggctctctgctgttgctaatcctatgatgaacaggacaaatggtggttacgaacagaaccctgtcaagcctggaaattccatcagtttgtaatagcacagctgttgtccttgaactgtgtagggaggaacctaggggtggacagttaatatattcttcaggggggttgtagtttattgctcaggatagtcaagatcttcctcagttgtctgttgctatctgcaagtctggtttggaggagaagcaggagaaattcagatttgtctgaggaatcatatgtgtctgtgaactgtgtaagttggtagttgattcctgtagacatccttgctaaagatttatttttaagtaaaatatcattttgcttgaaagtataaatcaaggttttgtggttaaataaattaaaaacagcacagctgccagacaaagttcagcttgatgtataacaggcctctgaaagaagttcagtaagaaacaaatctgggtaataaagttaattagtaactaaaaacctgctaggcatactaaaaaaaaatctgatgttgaatattaaattattatgaagcaggctatacctgtatccatcaagattataaatgatctcccacactggcgacgtggggttcctttcaagcctgaggaatgagcactatattttggccacagcattctcactaatgtcctaggatagcagcttagtgttggctttagaattctctgtcatttaaatgtcatgcaaaaacaaacgtataaaagaaaacattaacccagatatctttatggttccttgtcttgtccataaccgcccccgcccccacccacccaaaaaggacaggctatcagttatagagaaaatataagtgagcattataagcagtatcctacctttagtaataattatttaaagtttattaaatgggttgtttggaactcaaaatgatttgcctcaaagtagcctaggtcactgagaagaaagtttatttctttctgctgaaactgacaggaggcgatattttgaaagatagcaagcttgtctttggcatggtattaactccctttcttttgcctcctagggctcctgggcctgtataccctttccctactttgataccatatctatatctgctttattccctgaaagttcccatgttgccataatatttttcttcctttttcacaccggaaccaaaaactcagacatcttcaatagaaccatctctgggatgaacaatggtctttccagggatgtacattttcttacccacttttaaattaagaaataggattctatacttttaaaaagagaatgctggctactgcaaatgaatgtcggtagaaatttggctaatgtgacacagtaaaatgaaggtttcctaacacagtggttaggaaaagtgagtatgatggtgggaatcaggcttctgttcttgctttttttttttgagtcagggtttcactctgttgcccacgccggagtgcagtggtgcaatagtggctcactgcagcctcaacctcctgggctcaatcagtcctcccacctcagcctcctgagtagcagggactacaggcatgtgccaccatgcctggctaatttttacatgtttttgtagagatggggttttgccattttgcccaagctctgttctagcttttcatgagttttttccctgcattttagctcccatagtagcacctttcaaggggtgaatagaagaggacagagacagcaacaggccattggtaaaccagattgccaatttctcatcagacagaatgagcacagaccccgagtgagtggctctagatgcgaatgacctaaaattttcaggaggacttcatggagcttaaaaggttcttcagaacttctgtgtaattaagttagatattaacactgtttaatctgtatagacctgtaaaatatttttagtacagtaattaattccagagtttgtgaactatccaaagtaaagcatacaacaaagtactgtggcctcatcatatatccttatttcctgtttatgagcacctagctcttaatagtgagattgtagtcaagagagtattttatcatcatgccatgtagttgcctcttgccttagtttacctattttaaaaaacccggctcactaatagtttcacttcaggcatgtcatcagaatgaaagatcagatatacaaagtgctgtgcttgaaaactgtgtgttcccttagtgcctggttagataatacagggcttattttctggcagagtggtgttgagtctcctttgatgttagccagaactgggtggagtttcttaagctccagtcagattggctcaagcagggcaccatgcactggtgaatttgttttcagtccctccctttgccaaaaagcttttttttttttttttttaataaacctcaacccaattataaatgagaatacttgatatatgaaataatatgaaatgatagttgttcatattcacactgagggtcttagggggtttatttatagctaactgaaatgatgcagctgaattacaagtagctgatagaataatcaacctcagtaaacatttaacataacactctcattttacagattagagaactcagccctgaaaggtgactcattcaaggccacagtgagtgtcagattaaactggtgcttcagtaaagcatacagacttctgtacccagctttcaaattctcttgactcttactcacaaatctatttaaagttaactttattatctgtatggatagaagaggaatagtataaatggtcaattggtcagtgagaggttttttttttagagtaaatgcttctcattcacaagggttcattttttgatcctcctgaacatccagatttgaaaataatagtgtcatatccttttatccataaaatatgtaactaagcatttaaggcataaccgaatagtaagtaacttcaagtgattctgtgtgagatgaaattcatacatgaatttattaaaattaattttggaatacttgaaccagtttaacatctatagagcatttaaagagtgtactgtacttatacatgtttcagaataaaataactataaaattggataatcgctttaatttattgaaaactggggatttctgggaaaaaaaaaacagtactttaacttgaaagatgacactagcattacctttctaggatcattttccataagggggtgtgtgtgtgtattttaaaatcatattctatttatgtggtgacaagtaaagaatagcttaactgttgatgaaatacagatgctaagtggctagctagatgtgctcatagcttcatgaccttcccactttccaattgtataattttctatcagttttaccctcttaggctgaatttcagctactgttcatattccatgaaccacatgcagcccaggaagtcatctgagagtgtgtggctgggggcggggtgggggtgctgagggttggataggggaaagattacaatggataaaagctgccctttgataatctgcattctgataaatgatatttaaaatgtattggtgtttttgactgtatttttaccctgtgccttaaatgaggaaaagatttgagtagattgcatcttatgtcattatgtatttctggggaaaattaaattttggatttttatggtatgttgttaaggatggcacagatgtccttttaagttctctttgaccatgaaactgatgcaggatttttgctccttagctcaactaggtccaggttcttatctcaggagcggaagaattaggcacgtggacatcaaagagtgagtggagtagaatctattaatcgaaaggaaagctcttagcaaaaagagagaacatggtaggtggttctactacctgaagacaggaaagttccgtaatatggctgagcctggggctctttattggttcagaatgggagtgtgtggtcattggtttgtgagtatgcaaaaaaggtcaaagcgaagacaccactccaaggtgggcaggacagtgtagaaaaccaattaggaaagggtaggtacaggttaaataggtgaaggatggggatcaatcatgccaaacgggaaggcaggttcttaatccgatctcaggatttacccaggacagtttccggattaaagttcgggtttcactgaggacccgcccctgtctgcctagacatttgtttgcctcttgcctctatcaaaactagttacagacgtcctttttagtttttggttcataacagctcccaaaggataactactaataatagttgtcagagatagaatagggaaatggcataaccgaatagtaaaagcaactgaatagttgcttttcatggaaccctttgacattataatctgttaggcttttaaaagctctttaatgaactcatttctcagcattttccctgtcatgatctggagttacaataatactttatatgtaaagtaggctggacgagcatagaatagggcttcccacccacattcgtctgttgtaaatgggtcacaggtgtgccactactactataggaacttttttttttttttttgagacggagtcttgctctgttacgtaggctggagtgcagtggcgtgatcttggctcactgcagcctccacctcctgggttcaagcaattttcctgcctcagcctcctgagtagctgggattacaggtgcataccatctaaataataaaaatcagtgcccagctagttattctgtttttgtatttttagtagagatagggttttactgtgttggccaggctggtctcaatctcctggcttcaagtgatccacccgccttggcctcccaaagtgctgggagattacaggctgggattaccaagtccagttcctactataggaaccattgaattcctatttatggttccttcagaaaagctgctaaatcctgaattcggcagtggttattcaaatagtggaatttataattccagtagtgtgagatggcatttgctgtggacaacagctctgtcatgccacaggagcccctttggcagcaaagctatcagtttttgtcacgagccccacactacttgttttagtcaggattctcttagagggacagaactaataggatatatctccaaaggagagtttattaagtattgatttacgtgatcacaaggtcccacagtaggctgtctgcaagctgagaagcaaggagagccaatccgagtccccaaaatgaagaacttggagtccgatgttcgagggcaggaagcatccagcacgggagaaagatataggctgggaggctaggcccatctcttcatgtttttcttcctgctctatattcgctggtggctgattagatggtgcccaccccagttagggtgggtctgccttccccagccactgactcaaatgttaatctcctttggcaacaccctcacagatacacccaagatcaatattgcatccttcagtccaatcaagttgacagtattaacattacaagtccactccttgtcaacttgaacccatatacatctgagatcgtatgttatcttaaaataaagacaactataaggtcataattacacctaatgttataaaactatccttcatacggccagaaacacaccaatccccaacccaaatactattacataaagttaataatacttaaatgctgttatgaaatcaataaatcttatgtcacatgataaaggaaaaggaaatataaagtgaagatattagtacatgtgtatacatacacaaacatgtttttaacaaatgaaggaggaaatactcatggcagttacagtcctcatttctgcagctggtcacgtggtcatagctggtattgatgactaccttcttctacccattctgtattaactttgccttccccaaatacctcagcaggtcatgggtttttttcctggtggagtgatccaaaccttcattcctgaatggtccggatcatttgtagtcctgcctggatttggctgttgtggttttgcattgacagtaatcacagggcatggtaatacgaagagatgccctaatgggtctcatgtattccatgcatactcttccttacttccgttgtgaagttgtagactgatttcatcttgatagtctgggtcagtcaccttagccaacactgtaactccccctctgagcctgttgacttaaagggaggaggagcccaaagtgtccaggtgacaatcttaacttccagtttaatggaatcattgttgtgtctcctggtggcagcattcttccctctggaattaagacctctaggccagcagaacataatgttgcaggagaggaagcaaaaattttgctagtggatcactaggggtgatggtgagtggtgccacttccagttccacccctcgattcctggacctgtgaatcctggctatgggagaaacagtaccttatattggacgctgattcagaggatacacggccttctggaggactttcccacagttctgcaaagtattgtcacctagttggcgttgtaattgtgacttcaataggccattccactgttctgtcaatccagctgctttaggatgatggagagcatggtaagaccagtgaattccatgagcatgagcctgctgccgcacttctttagctgtaaagtgagtgccttggtcagaggcaatgctgcgtggcataccatgatggtggataaggcattccatgagtcagctgggtgcggtggctcacgcctgtaatcccagcactttgggaggccgaggcaggcagatcacttgaagtcaggagttcaagaccagcctggccaacatggtgaaaccctgtctctactgaaaatacaaaaattagctgggtgtggtggcgggtgcctgtaatcctagctacttgggaggcggaggcaggagaatcacttgaacccgggaggcggatgttgcaatgagccaagattgtgccactgcactccagcctgggcaacagagtgagaccccttctcaaaacaacaacaacaacaacaacaacaaaccaaaaaaacattccacaaatggtagtcttggtagaagcattgcatacaggataggcgaacccatatccagagtaagtgtctatttgagtgaggacaatcctctgccctttccatgatggaagaggtccaatataatcaatccgccaccaggtagctggctgatcacccaaggaatggtgacatactgagggcttggtgtcggtctctgctgctggcaaattaggcactcagcagtggccgtagccaggtcagccttggtgagtggaagtccatgttgctgagcccaagcattacttccatccctgccaccatggccactttgttggccatgggcgatggcaggggaaagaggctgagtggtgtccacaaaatgggtcatcctatccactagattattaaacccctcctccgctgaggtcacttgttggtgagcactcacatgggatacaaatatcttgtctttgaccactcagagaggtccatccacatacctcttccccaaatttgtcaccaagtttccaatcatgctccttccaagtccctgaccagccaaaccattggctacagcccatgaatgagtatataatcacacatctggccatttctccttccattcaaagtgcacaaccaggtgcactgctcgaagttctgcccactgggaagatttcccttcattgttgtccttcagggatgtcctagaaaggggttgtagtgctgcagctctccactttcgggtgttgtctgcatatgatgcagaaccgtctgtgaagcaggccctaatcttcttttcctctgtcagctgatcatagggaactccccatgaggccatcagtgcaggctgggagagagaaggcagggtggcaggagtggaggccatgggcatttgagccacttcctcatgtaatttacttgtgccttcaggacgtgcttgagcccgatcacgtatataccacttccatttgatgatggaatgctgctgtgcacaatccactgtatggctagatgggtctgaaagcacccagctcatgataggcagggcagttcaggtcgcatggtgacttgatgacccatagtcaaacattcaatttccactaaagcccagtaacaggccaagagctgactctcaaaaggagagtagttagctgtaatcagcactttgggaggctgaggtgggcggatcacaaggtcaagagatcgagaccatcctggccaacatggtgaaaccccatctttactaaaaatacaaaaattagctggatgtggtggcacgcacctgtattcccagctacttgggaggctgaggcaggagaatcgcttgaacctgggaggtggaggttgcattgagccgagatcgcaccactgcactccagtttggcaacagagtgacactgcgtctcaaaaaaaaaaaaaaggagagtagttatctgtagaagatggcagggccttgctccaaaatcctagaagtctccattgcgattcacctatgggagcctgccaaagactccaaacaacatccccatctgccactgacacattaagcaccattggatctgctgggtcatatggcccaggtggcagagcagcttgcacagcagcctggacctgttgcagagccttctcctgttctggaccccactcaaaactggcagcctttcaggtcactcagtaaatgggccggagtaatacacccaaatgaggaacgtgttgcttccaaaatccaaatatgcccactaggcattgtgcctctttcttggttgtgggagagaccaaacacaacaacttatcctttaacttaaagggaatatctcaacaggtcccacaacactagatccctagaaattttactgagacagaaggtccctgaattttagtcggatttatttctcatcctctggcatgcaaatgtcacaccaataagtccagtgtgtttgctatttcttgatcactggatccagtcagcataatgtcatcaatgtaatggaccagtgtgatatcttgcggaagcgaaaagcgatcaagatctctccaaataagattatgacacaaagccggagagttgatatacccctgaggtaggacagtaaaggtatattgctggccttgccagctgaaggcagattgcttctgatgggccttatggacaggaatagagaaaaaggcatttgcagagtcagtggctgcatagcaggtaccaggagatgtgttaatttgctcaagcaatgaaaccacatctggtaacagcagcagcaattggagtcaccacttggttaagcttatgataatccactatcattctccaggatccatctgtcttctgcacaggccaaatgagagagttaatggggatgtggtgggaatcaccacttctgcatctttcaagtccttgatggtggcactgatctctgcataccttccagggatgtgatattgtttttgatttactatttttttaggtagaggcaactctaagggcttctatttggcctttcccaccatgatagccctcaacctagcagtcagggagccagtgtgggggttttgccagctgctaagtatgtctatgccaattatgcattctggcactggggtaatgaccacaggatgagtccagggacccactgggcccactgtaagtcagacctaagctaaaacttcattaattacctgacttccatgagcccctagtttaactggaagaccacaatgatgttttaagtcccctggagtcatcatcagcccagagccagtgtccagtagtccccaaagtgaaaggttggatggaggtctccttggggaaggatgggagaaagattcactgcataaattgtcagtaaagtagtggggtcctttctcaagggtacctggcctccccttcattcaaggggttctgggtctgtaaactggctgaagtctggaaatggattgagtgaggggccatgattctctttttataattcaaattagtcttttgtccattcgacctagaagttttgtgtttgtataaattaagtgggaatgcagtaggcttcctgtccgtttcacttctaggaataccgtgattaattagccaatgccagagctctacatgagtcagactattctgattgtcactttgcctctgctgtccattacggtagctacgcccaccttgcctttgatggttgagtgctgctacttggcccctgccaccttgggatccagttattcccctcgtatttcaattttgtaattgagtgactgcggttctcaccattaggtctgacatgcagagaagagcaattacagggctcttcaaagattcaagtgctgccctcacaaatctatttcacaaggcattggtcaagggtatatcttctggaccctcccagctgggatgagtaggtctaaagtgagtaatccactccaccacctcaatctccctaagcttttggatgccttcctctacattaaaccaagagatatcaggcatttccagctccctcacagtgggccatcttttaatgcatatttcagctaaccaagcaaataaactattagaaccttattttaactccccgagctgcaacattaaatgcagagtccctacttagtgggcccaaatcaataaattcagcctgatccaactctatgttccttccaccattatcccatacccttaatacccattcccatgcctggtctccagattgctgtttatataaattagagaacagttcttttttttttcttagagggagtctcgttctgttgcccaggttagagtgcagtggcacaatctcagctcactgcaacctccgcctcccgggttcatgcaattctcctgcctcagcctgccgagtagctgggattacaggggtgcaccaccacgcccggctaattttttgtatttttagtagagacagggtttcactatgttggccagactggtcttgaactcctgacctcgtgatccgcccacctcggcctcacaaagtgttgggattacaggcgtgagccaccgtgcctggccgagaacagttctttttgagtgtagcgcacctcctcctgggtcacactctcaacctcacctctagggacctgtgggacttgagttataggtctagaagcaaatgggtgttgcaggtaccttctaaggagaatcaacattatcttgcctggcaactgcctgagaggaggccatgactcttgcctcaggcagctcagggtttatgtccgtagacaaagatggaaaggttgatggcggggatggggggttatgctgccactatgggggatggggaagctgttccttctggcaaaaaaagttcaccagagtttataaactcagtgttcccagcttcatcagggtcctcccacacatccccattccaagtttctgggtctcattcttttccaatcaatgccctcactttagcagtagacacctcaggtggctgtgcatgcatcttttgttgcaggtcagccactcgcatgataagagcttatgtctgtttttccacaatttcagctctttctcaacaggagctaagactctcactcagggcaatcttagcagatttgagactcagtatctgcttctgaagccaggaaacagaatccctgagttcatcattttctttcatcactttgttcactgaacttaggagcaaccaaccagcttcattatgttcgttggttttccacatatggtcaaaggtattatgtatagagtcactaaagtccttacctttcatgagcagtgaatcaggagtgtcaaatgcatttattttgcataactctctaaatagttcacgccaaggactatgaatgttctccatgctattagaagtagagtcctcagcatttttggatcaatcatattaagcagccaactccagaaacccccaaaccaacaaaagaactccatccttaacattctgttcctctggaaccactcctggtaccagagtctgtgttagtctggggtcagagttttcttagaggaacagaactaataggatatatatgtatgtttataaaaaggggaatttagtaagtattgacttacacaatcacagggtcccacaaaaggctgtctgcaagctgaggagcgaggaaagccagtccaagtcccaaaactgaagaacgtggagtccgatgttcgagggcagaaagtatccagcacaggagaaagatgtagactgggaggctaggcccctcttgcctcttcatatttttctgcctgctttatgttcgctggtggctgattagatggtgcccacccaattaagggtgtgtctgccttccccagcccactgactcaaatgttaatctcctttggcaacaccctcacagacacacccaggatcaatgttgcatcctttattccaatcaagttgatgctcagtgttaaccatcacactaataaaagtgtaattcttgctgaccaaactgagctgtgggctaagatgggagtggaaacagctctagacaaaagggccatagactcttcctggtcttaaccaaagctcaagcagatttcgagaatgcaaagcttctcaacttgtgttctacagtttgttgatgtccagtgctttggaatggctgatcataacagttttgtacaatttaatatgtttttttttttttttttgagaaggagtctcactctgtcacccaggctggagtgcagtggcgcgatctctgctcactgcaacctccacctcctgggttcaagcgattctcctgcctcagcctcccgagcagctgggattacaggtgcccaccaccatgcttggctaatattttgtatttttagtagagaggaggtttcaccatgttaaccaggatggtctcgatcttctgactttgtgatctgcctacgtcagcctcccaaagtgctgggattacaggtgtgagccattgcgcccggcccatatttacttttttatggagaagattcaacagcttctttatgacatctattattaaactctctcagtgcgtgtctttctttgacataatttgctcttgtcgctatttttcttctaacagactgattaaattggatttaactttattatagttattagatatttctaaatggaattaaatttatttatttatttatttatttatttatttatttatttatttttggccttaatgttaacagccagagtgtgatttattttttacttatttatttaaaagtttttaaatttaatttttgttttttgagacaaattttctgtcacccaggctggagtacagtggtgcaatctcggctcactgcaacctccacctcccaggttccagtgattctcatgcctcagcctcctgagtaactgggaccacaagtatgtgataccacgcccagctaatttttgtgtttttagtagaaatggggtttcaccgtgttggccaggctggtctcgaactcctggcctcaagtgatccagctgcctcaggctctcaaattgttggggttacaggcatgagcctctgtaccctatttattttttatttttatttttaaaaattttttgagacagggtctcactctgtcacccaggctggagtacagtggtgccatcacaatcatggctcactgcagtcttaaactcccgggttcaagcgattgtgacacttcagcttcctgagtagctaggactataagtgtatgccaccgtacccagctaatttttttttagtttttgtagaggcagggtctcagtatgttgcctagctggtcttgaattcctagtctcaagtaatcctcccacttcagcctctgaaagtgctgggattacaggtgtgaaccaccacgcctggctcagagtgtgattttttttttcttttttttttctttttgagactagagtcttgctctgtcacccaggctagagtgcagtgatgcaatcgtggctccacacctggagttgtggtggctattcacagacgtgatcattgcacactatagcttggaactcctagttacaatctccctgccccagcctcctgaaaggctagaactacaggtgcatgccaccacatctgggtcacacgtatcttttgacattttttgagacctaaatgaacttcatcaaattccaagtagtatgatgacagagtcgcatgaacctgggaggtggaggttccggtgagctgagatggtgccgttgcactccagcctgggcaacaagagtgaaactctgtctgaaaaaaataaaaaataaaaagatatgatttaggaactcattagtatagtcacaggaaatttaaatatcacatttgctttgagaaaagtaagcaggctgggcgcaggggctcacacctgtaatcctggcactttgggaggccgaggtgggtggatcactttgaggtcaggagttcgagaccagcctaaccaacatggtggcaccctgtctctactaaaaatgcaaaaattagctgggtgtggcggtgcgtacctgtaatcccagctactagagaggctgaggcaggaggatcacttgaacctgggaggtggaggttgcagtgaggcaagactctgcctcaaaaagaaaagaaatcagagaaacagctcttttctactacatttttgtataatggtactacctagaatttgaaaagataatcatttaaaattattgatgaggaattaaggttgttatttcaaataggaaaactcataaaattaggcacatggaagaaggcttaaatttatttgaaatttttagattttatttggaagtctatataaatataattgattatttaatatctttccaaatcttggtattgtatttttttcttagataatataaagaatatgtaatgaatgttttcactaagctccatataggtagagacaaactatctccagcattcccagtactgaacacatactatcttttttttctagacacttgcctagaagatgtagatcttgcccctggccttaattatcctgtctgtacttatttgggtatcggatcttgattcttaagcctctgtgccaccactctaatatatagcaacaccctttgcttgttggatttgggaattgggggtacgatgacttctgatttttcagggtctggaagtatttgctttgtacatgttttgtaatcatggtagcctcacagcatgtaagtgggaggagaggagtgtgtgggaacaaagatgaagataaaataagaaggaaggaagataggaccatattccttgctttaattctatttctttttcctaagtacatttgttggagagaggtagacggtggataacagcttgaaaggaaagcctgaaaattaagtggcttgaatcatagtatatttttactttttcaagtttgggttggagaaagactgtgtattagttgagattcttccattgtaaacaacagaaatagattggctaaattaggcaaaagaaagatgaaggccgctcacttagacttgaagtagtcaaccagggcaactaaatagctgtcactcatggacttttcttccagcgtgtagtcaataaatgatcctttccaactgtcttcttcttgacttctgattgacccaactctagtcatgtcccaaaccctataggggtagggattggtttgtattaggggagataggaagaatagatttctggacaaacacaagtagtggccattacattgtgcaactaaggatctgtttgacttgtatttaccttgtcaacaacatagcttatatgtcaacttatcctatggagtctcttggagtttctgttagactttttgaaagcaggcgtagtaccttgcacactttatttcctattatgccctgcatttgaatggtgcccaatttattgcaggcctttggctcttttttttttttttttttttttttttgatgggggagtcggagacttcctctgtcgcccatgctggagtgcagtggcgcaacctcggttcactgtagcctccatctcccgggttcaagcgattctcgtacctcagcctcacaagtagctgggattataggtgtccaccaccatgccttgctaatttttgcatttttagtagagatggggtttcaccatgttggccaggctggtcttgaactcctggtctcaagtgatcctcctgcctcggcctcccaaagtgctgggattacaggtgtgagccactgcacctggcccctttggctctttttactacattatttctgtattttctaggctattcacctatggtttgcttatagatttacttttttttttttttaaactttattttaggttcaagggtatatgtgaaggtttgttgcataggtaaacacatgtcacaagggtttgttgtacagattatttcaattaagtctagtacccaatagttatcttttctgctcctttccctcctcccaccctccaccctccaggagaccccagtgtctgcagtttctttgtattcgtaagttatcatttagcttccacttacaagtaagaacatgtggtatttggttttctgttcctgcgtcagtttgctgcggataatatcctcctgcttcccatctatgttcccacaaaggacatgatctcgttcttttttatggctgccagtagatttacttaactgcagattatgtaattaagaagctggtagtctgtaaaaatggtaatatacgtgactacagagagggaccatctcccttagctaattgagggaaacgtgtctttttttttttatgctggcagggctaagtagtttggttgacaggactatccacaagtgattcatgaagaagcaggtactcactccaagataagatccatactcacagtctttggtcaagaaagttgatttcatttgtccgatagtaatgtaactatgtaaagacctgatttgaatcttactggctatagctttggatatgttgattgtggggtttttttacacctcacttttcttataaatagaaaggacacaattgcaattgctttgtcctgccaccaccacctccctccacccccagaaatgtgagaaaagagtaactagcggtgagttaccttgggtcagactgtccatttcttagctttatttttctcatctttcaaatgagggagcctcttctagctgtaaaatcttagattttgattcttttgtttgtttcaaacaattgacaagagtttctagaaatgtttttccttttgcagtgctcgttacatgaaagatctttttcctcttcaccaggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaaggtaagtatttaaaccagactgcttatatatgttcagaaagcaggttagggattatgcctttggtataatcttggaaactgagaattgagctgagtttttttagtgtaggctagtaactttatgtttctttgttagataccgaggaggtagacttaccaccctttgagtgagcgttcatgagtctgtggatgacttttaaccctaatgtttcttctctaatgtttcaacaaccatataatcttcttcttaatttcctaaattaaactgtctactgtgccttttctctgaaagtagctttgaaaagttaaataaaattctgcggttatatcagaacttcatttagactggaatcagatgccatttgttgtctttggagtcatcccacctcaggattaaagcataattaaagcctttaagagaaatttgccattttcctggatcagatgtgctaataattggctgagtatttttgtatctgtgttcatgagggaattggtctgtagttttctcataatgtcttctgtccagttttagaattgaggtcacgccgacttcataaaatgaattgggaagtgttcccttctttctcttttctagaatagtttgcatagaattgatattttttcttcttttcagtgtttgatagaattcatcaataaagctatctgggcctggaattttctgtcggatttttaaactaggaatttagtttctttcagagatcatagaactattccagttatctgtttcttaagttagctttggtagtttgtatctttcaaggaattccttggtccctttcctggcataaatgttgcagattaatggagatatgcttttaatgtctgtaggatctattatgtcccctttttcatttcttatactagtaatttgtgatgtttctttctttctttctttctttctttctttgataagtctaggtagaggtttatcaattgtattgaaagatccagcttttggtttcattaatttttttctattgtctttctgtttttaatttcttctcatatctttgttttttcctttcttctgtttacttaagttgatttattctttttctggtttcttaaggtgacagcttaaatcaggttttgatctgagacatttcttttctaatgtaattacttaatgttataaattaccctctaatcaccattttagctgtgtcccatggattttgatatgttgtatttttattttcattcatttaaaaatatttaaaaatatttcctttgtgaattcctctttgtgtctgcctttaagattttatctttttttttttttttttttagcagtttaaatatgttgtgtttagatgatattttggaagttttcttcttgggcttttctgagcttcttgatctgtgcttttgaagtggttaagtcagctggaaaatttttggccattatcttttaaaatatttcttctgccccattctttttcttttctcctgggattccaattatatttttgttaaattgttggatagtgtcctgtatctcttggatgcattgttggtttttttctctctttatttctgtttgtgttttactttgggtactttcttttgacctatcttccaattccctgatcttttcatagttgtgttgaatctaatgatgagctttcagtggcattatctactttagcattttttatgtttttaatttctagcatttctgtttgcctctcttataagcttccttatttctgtcaaaatttcccatctgttcacctatgttttccaccttttctactgtagactttaacatattaatcatagttgttttaaatctctgtgtgataatttgaaaatctgggtcatctctcagtctgattgctctgtgtgtgtgtgtgtgtgtgtgtgtgtgtgtgtgtgtgtcttagtttttgattgaatgctggatctcacatgtaaaatagtaggctgaggccaaaaggtgttatggttggaaataggcatgtctcttgggtttagtcattttaacaggagctgagctagttttgggttttgtcattaccgtaattgccttcagtgtactactgtcttcaatccctttaattctatgcttagagtggggactgaggccctggaaggtatttctttaatgtgcttgctccactctttcagccttccctgtgtacccgtgcctcagaggggtccttgtccatgctcttttctctcttatcggaagagttctagccaggtggcaggcagagtttgtttttttattgtcccattttgtgcttaatcctgtgcttaatctcacggtttgggtctttctcaacgttattatccttttcacagtagtagcgtcttctcatggtattggtgtaggatcctggatgaggagtttttcttgctcctctctcaggtttataaagtatgtttctattactctttccctagctacagccggtcttcttgtgtgctctggggttgacagggtttgtactccttccccaggagagaaagatcccagtgggaggggttcatgcttttcccttaatggtggtggccttctccaggtctgtaccatggagggaggctctgtctggtccctcaccctgcttccaatctttcctgtgagcatgcggcagacatctgtgaagacaatcctgcaaatgagtgtgaattccctttgtgtctgtggatttgaggggccccatagtctcatgctagccttcatttacctttgacaaatcactacaatttttacttgaatttttcttacctgcttgtagggtacccaatgtctcttctgcacatgctctgatacaggagagctggtgttcacctcccatatttcctggaggggcttgtttttctttggatttcatactactaggtggctttccaattaattcaagttttttgtagttgatatggctgtttcttgttgttagggtgggagtgacgttgcttttggctttctacagccaagtggaagaagaaaacctgcttccttaatatatgtttaatttgtgtgttggggagggggggcagaccacaactcatttaaaaaagtactgagagttctaattatatccatataaatatttactccagaccaggtgcagtggctcacgcctgtaatcccagcactttgggagaccaaggcaggtggctcacctgaggtcaggagtttgagaccagcctggccaacatggtgaaaccatacctctactaaaaatacaaaaattagccaggggtaatggtgtgcacctgtaatcccaggtactcaggaggctgaggtacaagaatcacttgaacctgggaggcggaggtggcagtgagtggagagcgtgccactgcactccagcctgggcgagagaacgagactctgtctcaaaaaaaaaaaaaaaaagaaaagaaaaaaagttgctatcattgcttacaaaagtatcttgatgttgcaaaagcttatgttgagaagtaaagttcatattttatttttatcctttaattcaattttccagaaactcatacattttttgaacaggctaaaaaatacacatgtacaaaatccaattggtccaaagggatgtacggtaaaacaaattctcccaatccctacaccctagccagacagttctccttcctggagtaaccactcgccaatttctggagtagtctttctgagttaatgaactttttttttttttttttgagatggagtcccgctctattgcacaggctggagtgcagtggcacgatctctgctcactgcatcctccgcctcccaggttcaagcgatcctcctgcctcaacaccccagtagctgggattacaggcctgcaccaccatgcctggctaatttttgtatttttagtagagatggggtttcgccctgttggccaggctggtctcaaactcctgacctcaggtgatccacttgccttggcctcccaaagtgctgggattacaggcatgagccaccatttacatatcaaaagtagcagggaggatttaattttttataaataaaataatgtcttaaaaactttcctcctcttgggccaagttaatgttacatggatcaaataactcaagatgaagcacaagaaaatctactgctaccacctcactgtccttatccacctaggctcattcccagatgatggaaacaatgcacagttaaaggaaattagaaaacgaaaagcagctagcttctttcacctatgactgatgagggtaagttaatattaggatgggaagagcatctcaaccatgactagttgctaccatatttacatcttatcattcctttcttcatactaggttttctttgtttatgttagtcagtcaaagaacaaatgtctccaccgtgcattatggattaagagagaatagattttcccgttttccattaaggaatccaaattttttggagtaaatatttgtttttcttttgtgctgggattataggtgtgagccactgtgcctggcttttttacattattaaatgaagaaaaatgaagaaatgaagaaaaatggatgccctttaaagttttttttggtttaagtttttaattttttgttgctaccaaagatttttttaaagattaggaaacaaaaaagaaggaaccaaatcaggactgttgtaaggtggttgcctaatgatttctcatcaaaactgtcacaaattatctttgttgatgaaaggaatgaacaggagcattgtcctggtggagaaggactctctgatgaagctttcctggctgtttttctgctaaagcattggctgactttctcaaaacaccctcataataagatgttgtcattctttggctctccagaaagtcaacagacaaagtgctttgagcatcctaaaaaactcttgtgtttgctcttgactgatccacttttgctttgactacagcacttacgcctcttggtagccattgctttgattgtgctttgtctttaggattatactggtaaaaccatatttcatctcctgttacaattcttcaaagaaatgcttcaggatcttgatcccacttgtttaaaatttacatcgaaagctctgctctttgcagctcatctggatgcaaccattttggcaccagttgagtggaaagtttgctcaattttaatttatcagccaaaattgtataaactgaaccaattgagatgtctgtggtattggctattgtttctgctaattgtcaatcctcttcaattagatcattcttttttcctctcaaattgatattggtggtctgccacggtgggcttcatcttcaacatcatctcctcctttattttttttctttttttgagacagagtcttactacattgcccaaattagagtatagtgactatttacaggtgtaaccatagcacactacagccttgaactcctgggctcaagtgatcctcctgtctcagccttccaagtagctgggactataggtgcggaccactgcatctggctgatgtcttaaaacaagttattcatgtgtaaactactgatttgtttggggcattgtccccataaactttacacaaagcatcagtgatttcaccattctttcatccaagcttcaccataaatttaccatttgcttttgcttcaattttagcagaattcatgttgctttattaggggctcttttcaaactgatgttttatcctttttagtgcttcaaactagatcctgttcagacgtgttataacaagttagtatgagctttttttttttttttttaagatggagtgtctctctgtcacccaggctggagtgcggtggcacagtctcggctcactgcaacctctacctcctgtgttcaagagattctcctgcctcagcctcctgagtagctgggcttataggcacatgctaccatgcccagctaatttttgtatttttagtagagatggggtttcgccatattggtcaggctggagtatgagttattttgatacaaaaaaactcccttgaaatccatgaataattttttcatagaatgcattttccacgaacttgttgaagataccatgtttaaagtttataattatagctgggcgtggtagtgtgcgcctgtagtccgagctacacaggaagctgaggtaggaggcaatcacttgagccccagaggtcgaggctgcagtgagccataaaagcaccactgtgctgcagcctgggtgacagagagagaccccgtctctaaaaataataataataataaagtttataattatgataggttgtaaattactacattttttccataccagcttcctaaaagttgtagaagtcttaacttaaaggaaggggtgatggctgtttggagacatcaaataagaaaaacgaaggaagccgccttatttagtcttgtagaaatctggtgcaattagtgagttctttatgaatggagacttctctgctgtgggtctgatttttatacattatcggactgatggtttttgccataatgacaggtttcatatttgtgtttttcctggagaacattctaaacaagatgttcttctgaatacatctttagaagtgatggaagggccctagacttcattaatgttttattatacatctaactttaagtttgattttgttcttagatgaggttcagtaaactactgctgattgctgacactttttttttttttgaagacagggtcttactgggcgcggtggttcacgcctataatcccagcactttgggaggctgaggcgggtggatcacctgaggtcaggagttcgagaccagcctggctaacatggtgaaaccctgtctctactaaaaacacaaaaaaattagctgggcgtggtggtgggcacctgtaatcccagctactcaggaggctgaggcaagagtaatcacttgaacccgggaggcagaggttgccgtgagccgagatcgtgccattgttgcactccagcctgggcaacaagagcgaaattccgtctcaaaaaaaaaaaagaaaagacagattctttccatgtcacctaggctggagtgcagtggcacaatcatagcttactgcaacatctaacgtaactcctgggctcaaacgttcctcctgcctcaggctcctgaatagcttggactacaggtgcgcgtgccttgcttatccttttatttttatagcgacagtcagactgtgttcctctggctggtctggaactcatggcctcaagcgatcctcctgccttagcctcccaaagcactgggattacaggtgtgagccaccacacccagcctagtgctctcgatatgttcttacaacaggcttagttaggccaaccagtggaagtttatcaaccattttcttgcctctagatatagaagggacggttgagtaggttacacataatagaactctttgaacaatggtgttttatttcctttaattcttacatgtccaccctaattgtcttcaacttataaaatgagaagtaagaaagcagggttgcttttatggcatttatgacaaagtaggaaaattgcttttttctctaagtatgatttctgccttcatgcctggcaacacaagaaccccccgacctttattccttttctttggatctactatactcatttccttttgcacttcaacttattcttgcttctacaagtattttatcttagcattgcctgtgtaaaccatctaaataccaatacctagaaataaaattggtgtcaaactcttcttctaaaatgcctatcaccttgggaaacaattctcaaatactttttcaggatatgtgtactacttgttttgaaccacggctgtaataagaaaaaaaataaaaagaaaattatgtacttcctgacttttttccttaaaaaatggtgttttccttaattgttcattatcagcattatatggccctattttctaggtgagggagacaaaagatagaaccctttctcttagatgtgaatgacgaagcaaacatctgtgactcttgttctttcagatgatcatctagcacagtattgaccctcagacacaaatagcacatttatggaacaagtcacttaatttttctgttctctgtgtgattaaatagttcttcttctgaagtcgagaaaatgctttctcctcaacattccataaggcctttgaagctaaaagcttattcccatagaataagaagttaacacagggcaatggcctggctaagttttttgcatttttagtaaagacaaggtctcactgtgttgcctggactggactggttttgaactgctgggctcaagtgatcctcctgccttgacttcccatagtgctgggattacaggtgggagacaccgtaccctgccacacaccagcagtctgttttaacaagccataataggtgactcggatacacatgcatgattgagaaacactaatccatggaaaagggcctaagtgacaactattaatagatactgcagaatttctccttaatacactggtatttcttttgcagaaaattgcaaccagcttaattggccagtagagggcagtgttggcatgggtctgacagcaccagagggttcccttgcattgagacctggctgttttgcccaaggctgactcacagcacacatgccttctcaggttcttgctacttctctgccaagctgatttgcctgctgtgggaatctgacatctcctggggagagggaatcaacaaaataaagtaaatttgaatatctttatatctcagagaatgtgattagtttctaaaaaaaaaaagtgtgctattttcgatgctgtgtgtatttcactgagaaagttttcatttcatgaaatgggggttctctggggaagtcagtcagtgagaaaacacattatagcatcttttgaattaggacttttccagtaatgtgcagtatgattagggtccagtatgtcttatctggcagggaaatatacaagccttttttctacttgtcaaccttattgtttttagtgttgttacgttgtttttattctctcctgggcttatatttttagattgtgaggtgttgtatgtatagtagaatccagcttctcttcttcctttctaacctcttcttgctttcattttattttattctagtaaagtttcttgatcagcctacagttattctataggtggttgatagataaatttacagttggtcaacatatagttaataacagtgagaataacaatagctaataacagtgagaataacaattactatttagcactgtacagttgacatcctgtattactgcatttagtcccacttcccaggtgaagcttaagtattagaaatgagaaggttgcatttgatcatttagttaataatgacagcacaacctgaacccagatcttctaatctcacttttatttttattaaacaattaaaacaatattttttaaatagagatgtggtcttgctatattgcccaggttggtctcaaactcctggcctcaagcagcccttccgcctaggcctcccaaagtgctgggattacagacatgagctactggatcttctcattttaaacccctgttctggctgggcatggtggctcatgcctgtaatccccagcactttgagaggctgaagcaggcagatcacgaagtcaggagttcgagaccagcctgatcaacatggtgaaatctcatctctactaaaaatacaaaaaattagccaggcgtggtggtgctcaccagtaatcccagctactcagggggctggggcaagagagtcttgaacccagaaggtggaggttgcagtgagccaagatcgtgccactgcattcaagcctgggcgacagcgagactccgtctcaaaaaataaataaataaaataaacccctgttctttctgtgaaactatacctttttcatgaacacatactttctacttgatctagtatctcactgatagtttttaaaaactaaaaatccattttttaaattcaaatagaattattagatgtatgttcaggaaatgtaaaagaatcttgcttcatttcaatacagagcacaaactgagggactctgccactaattcacatgagtttgtaaaatatttcactttcctagacaactgtttcacatctactctctgaaacttctggcacttgctctcctgttcatattcataagtcatattcataaattaattggcttaatcagaacagaacttccacatggtcccaccacatatttcctcctcacctatgttcatctatgcccttattgtctgctctttttctgttatgggtgaactgttcatgctgtcactcaggccactgctgtcacagttacctcttctgtctcctgcatcatcagttcttttctttcaattgggtcattcaccagcatcaaacatactataatttttttatcattaaaaaaaaaatcctgtctgaatctcacatccatctcatctatctttttgctttgctttctttttttttttttttgagacggagtcttgctatgtcacccaggctggagtgcagtggcgcgatcttggctcactgcaagctccgcctcccgggttcacgccattctcctgcctcagcctcctgagtagctgggactacaggcgtgtgccgccacgcccggctaattttttgtatttttagtagagacggggtttcaccgtgttagccaggatggtctcaatctcctgacctcgtgatccgcccaccgtagcctcccaaagtgctgggattacaggcgtgagccaccgtgcccggcctgccttcttttaaagagacgtttctactacctgtcaccaattcctttccttccatttcctcttgaattcactctcatcagactttaacatatgcatgaccccaaaacttctcttacctaaagtataaggccttgatgttgccaaggacaaatccagtattactccaggggttttgcctgagcaactgaaaggaaagaattgccatcatctgagatggggaaagctacagaaggagtaggatttgaagggaagagaagaaatttagcttgggatatgttcacattgagttacctgctagtcatcgaaatggagaagatggatacacagataaggagtccggagtttggaggacggttctgggctggaggttgatgttatataaagcttttgctagagttgttgttctaaaatcctttaagattggatttagatgtaactttccagaacattccctgacttctgttccctttcccttctagacctcccactacccccacaccctgccagcctttcttttcatcttcctcttggtaagtgcttttcttccctgaactttcctctttcctctgtggtacttgtaagatcataattaagctatttgttatcttacacttattaacatgctctagcacaggaataatattttgtttactgccatatttcatggagaatgacacatttagcgaaagcaggatggcacagcataatcaaagtttactagcgacctcaagtttctcagggttaagaaatcaaaggttacagtgacaagtgaccggagagaatcatggagaagcagatcaagtgaaattatgaagaatctcatggtttgtgagaaactgagggcgcaggggtactgagaaacctggccagatctgcattagagaccactgctcttggcacatgatagatgtgtaatcattgcttattacactgaattgaaatggtttttgtttgtcagtttattcaggtttgggttgtgttaatgtacagactaacaaacaattgtgtctccaaaatggtagatatttatttagggtaggtgtacttggtctaatcctaaaccctcttaatagtctcatgatcatatttagggaagtttatatatatgcataaaaaattagtgtgacatttttgcaaaaatagttattttctgactttgatttgaaaacagacttttatctcataactaatagttctttttggggaaaaaaaatatcgtaccaaaatgtatagttcataataatagtaccctagtctgtaagaagagcaggggaccgggacccgggggctcaagcctgtaatctcagcacttgggaggccgaggcagatggatcacctgaggtcaggagtttgagaccagcctggccaacatggcaaaaccccgcctctactaaaaatacaaaaattagccaggtgtggtggcatgcgcctgtaatcccggctgctcaggaggctgagaaacgagaattgcttgaacccaggaggtggaggttgcagtgagctgagattgtgccactgcactccagcctgggcgacagagtgactccatctaaaaaaaaatacaaaaaaaacccccaaaaaacaaaaaacaaagcaacaaaaaaaccacttcattgctaaaaatattctgcaagcaagccaggatggtggtatgtacctgtagccctgcccgagctacttaataggaaggaggattgcttaagcctaggagtttgagtccagcctgggtaacatagcaagaccccaaagaccccacctcttaaataatattctgcaagcaaatgactttgttaaacttcacactgcaagaacagagccaagaacctaccatgtaccctttacttggatttatcattactgttttgcacatttgctttatcattcttgttatatttacatatagttccttccccttggattatttgagaacaaactgcagaactcacacctctttccccgaagaactaggcattagcacattacaagaatacgatgatagagatcagaagttaaatgctgatgagatattcctgtctaatccacgaaccttatttcattgtcatcagttgtcccaacagattcaacacattcctttctcatttttttcttcttgtctgcaattaaatctggaatcacgttagttttcatgtctcttcagtcttctttaattggaacagttcctcaactcttctttgtctttcatgaccttaatattttgaatagtatgggcaagttattttttagaagtcccctaatttgggtttgcctggcatttcctcataattagattcaagttccacatttttggcagtagtactatgtaaatatgatgtgtcctaagtgcaccacatcaggaagcacatgatgtcactaaatcacattattggtgataataactttcatcacttgttagtgtctgcctgttttctttactgtaatttttttccaattaaaaaaaagcatttatttatttagagacagggccttactctgtcaccctagctggagtgcagtggcacaatcttggctccctgcagccttgacctccccaggctcaagcagtcttccagcctcagcctcccaagtagctgggactgcaggcatgcaccaccatgcctggttaatttttttttttgacaaagtcttgctctgttgcccagactggagtgcagtggcaccatcttggctcactgcaacctccgcctcccaggttcaggtgatcctcctgcctcagcctcccgagtagctgggattacaggcatgcaccaccatgcctggctaatttttgtatttttagtagagatggggtttcaccacgttggccaggctggtctcaaactcctgacctcaggtgattcacccacctctgcctcccaaagtgctgggattacaggcatgagccaccccccagcctaatttttatttttattttttaattttttttaagacggggtctcactttgtctcccagtctggagggcagtggcatgatctcggctcactgcaacctccgccttctgggttcaagtgattctcctgcctcagcctcctgagtagctgggattacaggtgcgtgccaccacacctggctaatttttgtatctttattagagacaggttttcaccatattggccaggctagtctcgaactcctgacctcatgtgatctgcctgcctcggtctcccaaagtgctgagccaccacccctggccacctggttaatttgtgtatttttttttttttaatagagacagggttttgtgatgttacccaggctggtcttgaactcctgggctcaagccatctgctctccccaccctcccaaagtgctaggattacaggcatgagccaccacgcccagcctctttactgtaaaatttatatttttctccttgtaatgaataagtaatttgtgaggagatattttgaggctatgtatgtatcctgtatctaatccaactttcacctactattttagtatctaagcaaatagcttttgaataattttctggtttccaagccagttgaaatgtgttctgctgcatcttatatgaaagtcacattttatgaatcagaaattcccttttgcacattttaggtcaaaaataccagggaggccgggcatggtgactcacacttgtaatcctagctctttgggaggcagaggcgggaagagtacttgaagccaggagtttgataccagccccagcaacacagcaagactgcatctctacaaagaaaaaaaaaataaaaaattaactgggtgtggtggtagtcttaactactcaggaggctgaggcaggaggaaaggcagggagaaagtaaacagatatgtgcaaatgagacttccattatgcatattattcgcaattaaatctcattatttatgcccttcactggaaaaaaaaattacctttaattgcacagatcatttataaaaagactgttggagttatgctccaaagcccacaatgacagagatagtgtgtcagagggacacaggagtcaactgaaagagttcccaatagccaacactggaaaaatttgagcaacaaaataaataaagtagcattgaattaaagctcagtggacgaggctgatcatggtggctcacgcctgtagtcccagctacttgggagactgaggcaggagtaccacttgagcccaggagtttgagaccagcctgagcaacttagtgagaccctgtctttatacaaatagaattgtctgggcgtggtggctcactcctgtaatcccagcactttgggaggccgaagcaggtggatcacctgaggtcaggagttagagaccagcctggccaacacggtgaaatcctgtttctactaaaaatacaaaaaattagccgggcatggtggcacgtgcctgtagccccagctactcaggaggctgaggcatgagaatcgcttgaacctgggaggcagaggttgcagtgagctgagattgtgccactgcactccagcctgggtgacagagggagactcagtctcaaattaaataaataaataaataaataaataagccaactgtggcggtgcacacctgttgtcaccatatacttgggaggctgagggaggaggatcatttgaacccagcattttgaggttacagtgaggtgtgattataccactgcattccagcctgggcaacagagcaaaaccctctctcttaaaaattaagtcaaaatctttgccgggtgccatggctcatgcctgtaattctatcactttgggaggctgaggcaggcagatcactagaggtcgggagtttgacatcagcctggccaatatggtgaaaacctgtctctaatgaagataaaaaaattagctgagagtggtggcgcacgcctgtagtcccagctaccagctacttgggatgttgagacaggagaattgcttgaacccgggagacagaggttgcagtgagccaagattgcgccactgcactccagtcttggcgatagagctagactctgtctcaaacaaaaaacaaagaaaactcccttcattttcatgtaatcttatttatttcctcaagaagggtagatcttttaagactttattctttgcagttacaaacatacaataaaaaatttagtggctttactttcatttgattccattttacaaatggaatcaaatcgtatgaattttaacttgctttttttagtttattatcttagaaaactttctgtcagtatatatcaagctttctttttaacttggtctaaagtagtggtcttaacttttggtcacatactcagaattctgataaattctgtctctttgtacattaagtttacatctaaaattttgtagcaaaagtttagttgtaaaacatgtaattttgagaatgttttacttttgccacataaaaataagttacctcattctgctaaatgtatccaaatgcttctaaatatatagcattttggtttccatcatctagtttaaaaatatacgaacaagctgttctttatcattggaaatttaaattcttcttttgagtccttgaacttttatttccataacatgtctcagacttttatcctaatgtaatatatttttatgcttaaaagttttttcttgattgtgctaatatgtttctgctactaaatatgtatgtaaacttaaattttaatttttaaagttcctgtgacaaaggttctgtgttttaacttggtccagaggaaatttatcagtctattgcatgtattatgttttttttaaatctcccttcattttcacttaatcctatttgtttcctcaagaagagtagagatgggctttactgtgttgaccaggctggtctcgaattcctggcctcaagtgatctgctcaccttggcttcccaaattgctgggattacaggcatgagccactgtgcccggccaacataggttgtaatttttgatgttattactatacaagttgaattttattggaaatgcttttcttatgagatgatggggtctgttatttttctcaattaaatcatgggtctgtggatcaatatttctttctctgatgaaataggattggcaatttttcctgtttttgtagctatcatagtgaagaaaccctaatcacataggtaaatatatgggaataaagcttttttttttttttgggagatggagtcttgctctgtcgcccagactggagtgcagtggcacgatctcagctcactgcaacctctgcctcccaggttcaagctattcttgtgcttcagcctctagagtagttgtgattcacacgccactatgcctggctaattttttgtattttagtagatatggggtttcaccgcattggccaggcaggtctcgaactcctgacctcaagtgatccacctgcctcagcctcccaaagtgctgggattataggcttgagccactgcacctggccaggttcttttttattattattattttttattacgagataaggactataggcgtgtgccaccacacccagctaatttatttatttatttatttatttttagagatggggtcacactatgttgcccaggctggtctcaaattcctggactcaagacacccctctgccttagcctccctaatagctgggactataggcataccctagggtgtcttggcctttatctatatttagctattagatacctgttatcttcctgtatcggtaacacgaagtgctctcatttcttttattactgtgtactattttacaatattataatctgttggtggacatttgttgtttttaagcagtgccatcataaacattctgtttatattcacttttttatacttttatgtctctttttgaactaaatacctaaaactgattgttgagttgagtattgcagaatttgataggctgccaaattgtctcataaaaaggttattcctatttacattcccccaaatgatgtaatgaaattacccttgtcaatgctggttatcaaattttaaaaggttttatcactgtaatagctgctcttataccactcgctggatatcagtttttgtaatttccattttcttataatatgcattctttaatgaagcaagtttttaaaaatatgcattctttcttgagcgaggaagaataaatcttataagcttattgtgtgaatgtgaaagggaatttacttatgccaaatgtgggatggagcatatttatggcatctctctggataagtaaaatgcagtttgtgaagacttagcagggtatatgttacatagcggctatttaatagaattctgttgtctttccttccttatttctttcttttatttaaattatattctggttttggactgccttgttcttttagattgttctctttggctgttcctcttaagtaacagaatgaatgatcttttcaacaagaagcttgtgtgaaagatttctgccttgtatttatgaggactaaggggttggacagcatgtttgtggtcttccaaagtaaaatcttgcattttttattttagtagcatatattgtagatattcacttattgtcttaggaataatatctctgaattcttcggtcagcaaggtgactgcagagctaggctggttgctaaaatgttagatatagtcagagactttcagaaaaagttgtacatccccaaattgatctatatagtcaatccccaaattgatctatatagtcttatatgcaattgcatataagatcccatcaagaattttagtataaatcaaaaactgattctaaaatttatatggaaaagcaaagaaacaaaacaaggccaggcgcagtgactcacacctgtaataccaacactttgggaggccaaggtgggaggattgcttgaggtcaggagtttgagagcagtctgggaaacatagggagaccccgtttttccaaaaaataataataatgaaaaattaggcaggcgtggtagcatgcacctgtggtcccagctacttgggaggctgaggcgggaggattgcttgagcctgagcagtcgaggctccagtgagccacgattgcactactgcactccagcctgagtgacagaatgagaccctgtctcgaaaaaacaaaacaaaacaaacaaaaacatttttggaaaagactcaagttggagggctcatattaccttatttaagacttatggctgggcacagtggctcatgcctgtaatcccagcactttgggaggccgaagcaggcggatcacctgaggtcaagagtttgagaccagcttggccaacatagtgaaacctcgtctctactaaaaatacaaaaaaaaattagctggacgtggtggcacgtgcctgtagtcccagctacttggggaggctgagcctggagaatctcttgaacccaggaggtggaggttgcagagcgtcaagattgcgccactgcactccagcctgggcgacagagagagactccctgtcaagaagacttactgtacaaatacagtaatcaagacaggatggtattggcaaaatggatagccttacaaattgatggaacataacagcccagaaataaacccaatgtaatatggtcagttgatttttttacaaaggtgcaaaggcaattcaatagaatgcagatgactttttccacaaatgactctgtaataattacctaattacctaattattaggtgattaggtaactacctaatcacctaattattaggtacaggaatagaaacttaggaatgtacaggaatagaaacttagacccacatcattacaccatatacaaaatttaactcaaaatgtaccgtaggcctcaatatgaaatgtaaatatgaaaactataagacttctagaagaaaacatggggaaaaaaatcctgtgacctacttcataaaaattaaaaactatttgaaaggcacagttaagtaaatgaaaatacagtataagttagaaacagggaagaaatttttacaaaatttatctgataaaggagtgatatttggaatacataaagaattttcaaaactcaataataagaaaataaacagttcagttttaaaatagtcaaaaaatttgaccattcaagtcaccaaagaagacaaagggatggcagagaaacacatgaaaagatgctcaacatccttagtcattagggaataagatacaactaatttccttaaaaaaaaaaaaaagagggaaaaaaaaaaaggagtcctctgcttccagaaatacagctggttacctccatgcaatcttcatccagaagcaatgatggtaccctggatttcctgtgtgggaattaataagtaattaataaatggcctccgctgggcatggtggctcacatctgtaatctcagcactttgggaggccaaggcggtgaatcacctgaggtcaggagtttgagcccgcctggccaacatggtgaaatcccatttctactaaaaatacaaaaattagctggtcatgggggcgggtgcctgcaatcccaactactcgggaggctgaggcaggagaatcactcgaacccagaaggcggaggttgcagtgagccgaggttgcaccatggcactccagtctgggtgacaagagcaaaaccccatctcaaaaataataataataataaaacaaatgccctcgtgttcttggagcgtttgatttggatttgaattgctgataccaaacctgtgttgctccatgatggttttactgaatttaatggtaatctttgataatttacagaatgaaaaagatttagacttgctattatgaggggctctcctatggaactggtactttacagagcttgggtgccctaggaattaatgattctgttcagttctgtttctgggtttccttttgttaaatgtttaaattttgaacagtttttaattgctttaacctaatgctacaaagagtgagaaaaactccattaataagacagtggttggatctgtttttcatttttctgtctgtcacaatgggtaattatttgtcattgttgcagatactccatcttctaaaccaacactcctagccaatggtggtcatggagtagaagggagcgatactacaggtaagtgattcccaggattccccaaatgtgtaggtgatgcacttacaatgaacaccttgataatctcctttgaagagcattattaatggaagcatacgaattatttctgagggtggtagtgtccttgttggaggtatttaaacccaggacattgccatgtaaaatctccaacaatggaaggagaataatgagtttgctttgatattttttgaatatttattggagctgtaccacacaagaactggatcaaccttaaaatacttttgtagatgcagaataatgatcaccaaaatatgttacatgggaggaatttggccactacaactcttaaaacagcaggtctgttccctgaatcacattgcgtttagctttctacagttcaatgttaggaagccagtgaacaacaaattaggagttatttattttgcccccagtgtgtttcctttatctttcccttaactgttgcttttgaaatttacttctaattaaactcttagctctttactagggttttgatattctttcagttagcattgagtttctgtgggttcctgtctcataaccagcaccaaccccctgccccaatgtctttgtagtgagcaaaattctcaaagcagtagcaggagtcccagggatatactatataaatattttcttaagtagctgatgtgagagttgcgtgttttattttcataaatacctgcatttactttgcagttgtgatcaggccaacactgctaacccaaatgagttgacttctaatgatcaatcccattgtttcctgcaagtgtgctcttaactgggccatacatttgattcatattattgcagtggaggtagttactagatttgtcatatttctgtatttctcttatatgcatacctcagctatgagaagcccttctgtgaggcaccacagtatttctctttttctaaggcttccagaaagccttctgttagcaatagcagctattctaggatttattctttattctatgaccataggaaagttgtatatatctttatacatcagattttttgatgaccaagttctttttgttgtgaatgtttaccaagtgacatatacatccttattagcaacttaataaattaggaactctttactttagaagctagaaacaaccagaaatgccactttatcttccagttttgtgaattgatgtttttgtatttctttgataatctcagtcaaatgtagtattgactttctgtgtctgctttgaaagcagtcatctatgtgatgtggtttttaagaaaacatttatgcaaatatccctgtgattaaaggagaagtttgaacatgaacttttaaaaaatgagtaaattcagctttctttaagcaggaaccagttaaccagggtaaggaaaggctggaggggattgacttgattaggcagttgaaagagtggatgccattttcatccaggaaggaaacaactacaaaaacgagtagatttcttctccagtaggaagtcatgcctgaccagaagagactcaaactctgtgtagcaggtgcttaccgctgccaggccttagtagtacagaatagaagggtaaaaactgtatcctggccctcactgtttcaggattcccttgtgacaaaaaagaacctggctctttatgaactacccagtggcattatgagagtaggtcgttctgttcttggatacctctctgcccttaggtagcatatagtttgcacacctggattgagttttgaattgaaccacttaactgtattaaaatagatactaggccgggcgcggtggctcacgcctgtaatcccagcactttgggagaccgaggcgggcggatcacctgaggttgggagtttgagaccagcctagccaatatggtgaaaccccatctctgctaaaaatacaaaaattagctggacgtggtggcacgtgcctgtagtcccagctacttgggaggctgaggcagaagaatcgcttgaacccaggaggcggaggtttcagtgagccgagatcgcaccactgcactccagcctggtcaacagagcaagactccgtctcaaaaaaaaaaaaaaagatactttactgaaaatatgcatgttttatttggggagggaaggtggagggaggggatggcagtgcatgtttttggagcatgtggtgacttcattctaatttggccatcactacctggagcatctaactcaatgccattttgaaaattcccatttctgtttccttcagaatgttatctatagtcccgagagcaaaccagcttcattaatagctttggtttatgagcatcttgtgatattgaacttgctgtttactaatgacctgtgcttttccacccttttcttccccttcctacttcttcctccctctctatttttctcctcctagaagcctagcgtgtctctcaacactggggctgctgcaacaccagaccagtgatctttcctaagcatcgttatacttctaaaaccttcagcattttgcagagctttgcttttcattcctggacatgatgtagaagaaactgagggtagttcttcggggcctatttctgctgatgcctgagcaaacaacctgcttcctcttgtgctctgcagggtttgatggagcctcatttccctttgtgaacacaaagtgcaaaatgaattctttttaattttagtaatttttacaaaggttatctaatgtcttttatttcttgttttctttatgattttatcatttgattcattctcacatttttttcctttaaatatttttagttgacctttttcctttggttttcaaatgttcaacatgaatcagaatagtgtaacaccaaatgagaacatgtgttttcataaaggggttgaggccaccagtactgcagcgaatttccttttcttctccctcctccttccttctctgagcttgcttttagggaaggttaatcttacaggctacctatgtttctctccaccttactaaaatctaaataatgatagatattttaagtttttaaattgagtagttctgagtaatcctagaatatttttccaaattaaataatcctttattatttgcaagttgggccaaatttttttttttttggagacggactcttaacaatctaagattgtttcaacaggactttcttattcccattcctaattttttcaaactaattgcttagatctagaaccagttgagattagtactgtacaatggtatgctttgattgtatttatagaaatataacataaaacatggaccatgttttgaaatcttagaggaattctggtttaaaatctgaaatactttaaagttttctatccttttactgattatgcagcttcttataacccccaaggtacagattatttcagcttaaaagaaataattggcaccatgttctgagaaagattttgagatatacattgttttttgtttttgagacagggtctcactcttgcctaggctggagtgcggtggcgcgatcttggcttactgcaccctctgcctcccaggttcaagtggttctcctgcctcagcctcccaagtagctgggattataggtgtgcgccaccacaccagctaatttttgtatttttagtagagacggggttttactttgttggccaggctggtctcgaactcctgatctcaagtgatccacccgccttggccacccaaagtgctgggattacaggtgtgagacactgtgcctggccagatatacattgttttagatcccctgatacagaactacttttgagatggtaagattagaatatcatgaaagtttaaactgaatccttgcagcgacttccggaatttaggaagcattccctcttctacaggggtctggtcacaagggctggattctctgacaaaaatttcttctatggattctggacagaagacacttgagggtgatatgttttaaaggaaagaggttatgcttatcttcttagcagttgataaaatattaaaactctcttgccatagagaatacaccatcaaagaaaacacaaccctttccctttggtgtacagttatttattaagttgattttggggtttctttcgccagggatcttttcaaaactggtagtagttatttttaaaaatcatgtttgacatctttctattgctcgtaaccagtccctgtagctgtctaagttatgggtggagaagcctgggtatgactttccgttgtgtacactcacacttcatgattgacatttatttattcttttatttccatttggttatgcttatttttgtttgaaatttgtttttttcaaatatgtttcctttttgaacttacagaattgttgaaattttctactaacagccagctaaaatttggtatatgttagctctatctgtttcacttggacgtttcattttgaaagaaagaaattttatgtttcacatatagttttatacaaagtagccagtcccataatgaaatgctgtattgccatagtggtcacacccaagtggtccagtatctcaatggtgaggcagccagactggtcagggctgctttgttgaaatgtgatgattttcatatgccttctttctctttctctctctctttttttttccttttttggcccaatgttgaagatgtagaactttgtttttaaataatgtttttataatttcattcgtatacctaagtttgtattttttgtgactttggacttcaacagtttgtatattgggacttctaatgtgattactgtactaaataaattccactaataaacatcttacattaacaccttatggactggatttggttggggtcataattgttgaaatataatgttactaaaacacaagttgggtaaagacttgaggcccaagttctaggtctaatatagcttctaatcccacccggattaattgtatggacttttaagtttttgtcaagcattttcacttatgaatttttttttcttttttcttttttttttttgagacggagtctcgctctgtcgcccaggctggagtgcagtggcatgatctcggctcattgcaagctccgcttcccgggttcacgccattctcctgcctcagcctcctgagtagctgggactacaggcgcccgccaccacgcccagctaattttttgtatttttagtagaggcggggtttcaccatgttagccaggatggtctcgatctcctgacctcatgatccggccaccttagcctcccaaagtgctgggattacaggcgtgagccaccgcgcccagcccacttatgatttttgatagttattgtaaactctcttttatccagaattataaaagttaagaagttcaaatgactactgatatttaatgtcatttggtgagaaagtcacttgacagaaaggtgtgaagaagttattccaaaaggaggtttccatggtatatcaattgttgttagatgctttctaatactacatttattaatttctaacactacatttagtttagtgcagttaaaattcacattcaaagtcttcctaaagtgcctcctgaattatcaaataaaatttactacattcagtaacatttaatttgataactttgttatttgataacccagtatgcagtatctgggaagaattcaacaaaatgcgcagttccctagccattctgggttagtgtttgtttacagtagggttgcaagtacaatatgttgactgaattaagacattaaaaatattttatatctaagtaatttgcatagcataaggaactttttaagcttggcagacattttagttaagaacacttaatttaatgtttttagatttcctttttattaaaacagctcagtaatctgttctcaggtttaaagcacagattttaaatactataaggaataattgaccattaactttcttatacataccctaggtttaaagcttttggtaattgaagcaattcttgaattttgttattgtcctcatccctgatgcgaagtgaaacctggcttcatttggattcttcctccttattgacttgataatatggtgggaggctagagggtgttctaggcaaagacacaggactggtccagcaggcacagaatgttagtttcattcctaaatcatgtgtaatactgtattatcctcaattttatgttgatgccgtttccattacagtgaaggtttaacaagacttaactacaaattatttgtgggataaagctctgtgcgaccatggaggtaaattactcttatttatagtgtttggggctagacacattgcactaagtgctgtacaaatggcagtgttactggttgtttccatcgtaattagagtaggtaaacagtttactattgtgataactgtttgcatgtgtaaagtcatgccagcagtgaaacagtaaatctacttttttagaatatcatgacacagaaggtattctgtgtgcttcatcactatctcatctggtaggatgcaaaggatttagcatcagaaaaatgcaaaagcaccaaaaatgtgaaatattaacagataaataaatctgtggtgtgttagagtttctgaacagctattggagccacgctgtaaattggcatcataactcacaagtggagcccagacataagctgcacattatgttgctatgtatagacagcaagacatccatccgaactccaccaaattcctggaacaaagttttatttcttttctttcattttccagttaatgagttgcatgctggagacacatcagcaaattaacagcacgtaatgtttcttaaagtttttttggttcatggttttctaataaaaatacagaatttctcttcagaaaagtccacatatacccatatacaagatgttacatttacgtttagagtgtttaggactccattgaaaccagctcatggactacaatccttttctaagccaagcatttaattaatactctaagccacgttatttcagtttcttttggggctttgtattgaataagacaaaatagcttcttcttgagctttaagtgaaaatataattctgatttttttttgtttgtttttgtttttgagacgaagtttcgcccttgttgcccaggcttgaatgcaatggcacgatcttaggtcactgcaacctccgtctcccaggttcgagcgattctcctgcctcagcctcccaagttgctgtagctgggattacaggtgcccgccaccatgcccagctaattttttgtatttttagtacagatggagtttcaccatgttggccaggctggtctcgaactcctgacctcaggtgatccacctgcctctgcctcccaaagtgctgggattgtaggtgtgagccaccacgcccagccttctgatgttttttgggtttttttgttcttgttttttgagatggagttttgctcttgttccccaggctggagcgcagtgcaatggcacaatctcagctcaccacaacctccacctcctgggttcaagcaattctcctgcctcagcctcccaagtagctgggattacaggcacacgccaccatacctggctaattttgtatttttagtacagacggggtttctccatgttggtcaggctggtctcgaactcccaacctcaggtgatccacccacctcggcctcccaaagtgctgggattacaggcatgagccaccatgcccagcttttaaagactttttaaaaaacctatcttaagttctagttactgagagaaaatccatattgaggcaagggctttgcatgtaggtagtttattttgggaagtggccccagggcacaagagtgggatactgggaaaagtgaaattagaggaaaagaatacagtgaagtatgactactgacctagtcactgctgtgggcaaagtgggcttaagtcttttggggtcttttgaggacctgtatagaatgcctctcagtgttcactacctgagtatcttggttatagaagtggataacatttattcaccatttaccatctctcattgcttaagactcttttttttttttttgagacagagtctcgctctgtcgcccaggctggagtgcagtggtgcgatctcggcccactgcaagctctgcctcctgggcctaacactcttgtacttctggatttgcacatgtgtggtgccaggatgcagatgtcttgtctcttggtgtcagagaagttgtagggcagaaaactctggtttggttgatacaaagtgctgtcaaatcacacctatgtgcagctggatgctgtagcaatagctagaataaatagtgaacttaacagagtgtgaggtgggggcacaagaagtgtctaaccaagaggttacttcaaagcaagattctcttaacataagatttgtctgcttatgccttaccatagaggatgagatccttcaactctgtagaggaaatttgaaggaactccatctattatggtactaatcctttttttttttttctctccccgcgccccgcgagacagagttttgctcttattgcccaggctggagtgcaatggcgtgatcttggctcactgcaacctctgcctccagggcttgtgattctcttgcctcagcctcccgagtagctggggttacaggctcccaccaccatgtctggctaatttttgtgtttttagtagagatggggtttcagcatgttggccaggctgttcttgagctcctgacctcaggtgatccacccatgttcgcctcccaaagtgctgggattacaggcgtgagccactgcacctagccaggtgctaattcttgagctgcattgttagaaactatagagatagccacagatgttagttttggaattttccacccaaacgtttttttctttagttagttttagtagtttttatgtttctagaaatttgttcatttcatctaggttatataatttgtttgcctacagttcttagtattcccttataaaccttttttattcctgtaagattcatagtgatatctccttttcatttctggttttagtagtttgaatcctctctccttttttcttcataaatgtagttaaaagtttgtcaatttttttcatcttttgaaagaaccaactttcagttttggtgagttttctctattttctctcctctgtttcctttatttccactttaatcttttttatttccttccttctgcctcatttgagtttagtttgctatttttctagtttcttttggtagaaggttatgttagtgattggtgatttttattttattttattcttttaatataggtgtttatggctataaatttccctcttaccactgttttagctgtacctcttaagatttgatatgttgtgttttcattttcattcatctgaaagtattttctaatttcttttgggatttctttgacgtgttgattatttaggagtgtgttaatttctgcatatttgtgcattccccaatcttctgtttactttctaatttcatcccattgtggttggagaacataattggtattctttcaatccctttcaatatatggaggcttgttttctggcctaacatatggtctgtcctgaagaagaatgtatattcggctcttgatgcgggtggaatgttctgtaagatgtccattagatgtagttggtgtatagtgttatataggtcttctctttcctcgttggtattctgtcttgttgttctatccattagtgaaagtgaggtattgcagtatccaacaattattattgagtagtctattgtttgctcaagttctgttagctttaaattttacatgctttttacatttctcaaggataaattccttgtgaaaaatgctacggttgtggataagaaagatacacacaaatgatcgctacaactatgagcctcagaagcagcagttgaaatgtcggtcgctggtaggacgatttaaagtgtttttttgttttgaggcagggtcttactctgtcacccaggctggagtgcagtggtgtgatcatagcagcctggaactctgggttcaagtaatcctcccgcctcagtttcccaagtagctaggactacaggtgcacaccaccatgcctggctaatttttaaaatcttttgtagagacagggtcttgcttttttgcacaggatgggcttgaactctttgcttcaagtgttcttcccacctcggcctcccaaagtactgggattacaggtgtgagtcactgtgcccggccctaaatgtgtattttattttattatttttgagaaggagtcttgctttgttgcacaggctggaatgcagtggcatgatcttggctcactgcagcctccaccttccaggttcaggtgattctcttgcctcaccctgccgagtagccgagattacaggcgcctgccgccatgcccagctaatttttgtattttcagtagaaacagcattttaccatgttggccaggctggtctcaaactcctgacctcagtgatctgcccatctcagcctcccaaagtgttgggattacaggcgtaagccactgcacccagcctaaatgtgttttttgttttgttttgttttgttttttgtgacggagtctcgctctgtcgcccaggctggagtgcagtgacccgttcatggctcactgcaacctccgcctccgggttcaagcaattctcctgcctcagccttccaagtagatgggattacaggcatgtgccaccacgcccagctaattttgtatttttagtagagatggggtttctccatgttggtcaggctggtctccaactcctgacctcaggtcatctgcccgcctcggcctcccaaagtgctgggattacaggcatgagccactgcacccggccctaaatgtgtttttaaaagatgatattttttcctcaaaatctgaacaatgttttttgcagaaatagaaaaatccattcggaatctcaaggagccctcctgaatagacaaaacaatcttgaaaaagaacaaagttggaagtctcatttgttgattttcaaaacttactgaaatgctataataatcaaaactgtgtggtattgacttaaagggagacatatagatcaaggaacggaatggaaagcccagaaataaactcttttatacatggtaagatgattttagacaacggtaccaggaccattcaatgggaaaggatggtgttttcaataaatgatgaggggaaaactggatatccacataaaaaagttggatcctgctgggaacagtggtttatgccaataatcccagcgctttgggaggccaagtgagaggattgcttgaggcaaggagttcaagaccagcctaggcactataggaagacctcatctcttaaaagaaaaaaaaattggccaggtgcggtggctcacacctgtaatcccaacactttgggagtcccaggagggcagatcatgaggtcaggagatcgagaccatcctggctaacatggtgaaaccccgtctctactaaaaaatacaaaaaattagccgggcatggtggcaggcgcctgtagtcccagctactcaggaggctgaggcaggagaatggcatgaacctaggaggcagagcttacataagccaagattgcgcccctgcacttcagcctgggcaacagagcaagactctgtctccaaaaaaaaaaaaaaaaaaaaaaaaaaaaaaaaaaaaggtagtgtgggcctgtagtcccagctactcaggaaactgaggcaggaggatcctttgagctgaggagttcaaggctgcagtgagctatggtaaagtacaccgctgcattcaccctgggagacagagagaaatcctgtctctccctctcttttttttaagttgggaccattatcttatattcaaaaattaacttaaaatggatcaaagacctaaacaaagcaccaaggctatacatttcttagaagaaaacatagagggaaatcttcatgacattggatttggcagtgttttcttggatatacaccaaaaacacagacgacaaaagaaaaaacagataaattaggctatatgaaaattgaaaatttttgtctatctctgtagagtgaaaaggcaacccatggaggcaaaatatttgcaaatcttatatcttctcaggagttaatatccagaatatgtaaataacttctagagctcaacaaaaaaaaattaaaaatatgggcaaaggacttgaagaaacatttcttcataaaagatacaaaaattgccaagaaatacatgaaaagatgctcagcatcattaatcattagagaaatgcaaatcaaaaccacaatgaaatatcacttcatactcattaggatggctagtatgaaaacaagaacagaaattaacaagtgtttacgaggatgtggaaaaattagaacccttgtgtactgctgataggaatgtaaaatgaaagtgctatggaaaatagtatggtggctcctcaaaaaattaaaaacagaattattgtaagatccagcaacccaacttctggatatatgcccaaaggaattggaatcagggacttgaacagatatttgtacactcatgtttgtagcagcattattcacagtggccaaaagatggaagcaacccagatgtcccatcaacacatggaatgaataaacaaaaatgtggtacattcatataatggaacgttatttagccttaaaaaggaaggaaattctgatatggtacaacatgaataaaccttgaagacactatgctaagtgaaaaaagccagtcacaaaaatacaaatttatatgcggtacctaaagtagtcaaatttacagaaacaaatataaatatactccatttatataaattaccttaagtagtcaaatttacagaaacaaagtagaatggtggttcccaggggctgggagaggcggggaatggatgtgtttggtgttgcttaatgggtacaaagtttctgatttgcaagatgaaaaagttctggagatggatggtggtgatgattgcacaacagtgtgaatgtacttaataccactgaactgtacacttaaaaatcgttaaaatcgtagaaataaacaaatgcagctcatatttaaagggaaaaaaatttcaaattaaccatcatatcacagatctcttcagaattaaagggatgctttatatgttaggtattttgtacgtttgttctggtttgtccagttgcagagagaaatacacaaatatgtcaacattgcttaaatgctaagcagttatggggaacattttgtaagaacagatacaatattggttaaattccatgagggggttgagtgagaactaaggaaatttgaaattcgagcttgaaatctccatttggatgtagaattgatatctcaaatttgaaatgttctaaactgaattcatgattgccccaccccaaaatcaaaacagagaagaaaaagaagaaaaaaaccacctgcctccccatctccttaaatggaaattctgtcctggttgttaaggctaaacatttggtttccctatcctcttctgctcctctcacaccccacacccagtttgtcagaaaaagatatttggaacctgaccacatctcaccacctccactgctctctccctgattggaccaccatcattaaccttggctactgtaataacttcccaaattagtctctctgcttccatttgcttgctccctgcagcatattcttaaaaacatctacagtggtcctgtacattgatcatgctgttcgtttgcacagaaccctccagtggttgcccatctcaaagtaaaagccaaagtccttatgaaataccacaaggccctatgatgtcgttgtcatctttctgaccagatcttttcttagttacccctttacttactttgcttcatggtgttcttgctactgttccttgaacaagccaggtgggcatctgccttgagctctgagcactagcagttttctctgcctggaatgttcttccctttgatatattcatgattgactcttcactttctcaatgagtacttctcgactatctttttaaaaattgcaccccttctattttttcgtcccactgttctacttgaattttcttcgtggcttttgtcatgtcactttctaataatttgtatagtttacttatctcatctgcctttccccaccagaagaagatattatagaaacaaattttatgagagggacagggcttttgttttggtcactgctgtggcccagcacctagaacactgtctggtggatagtagatcctctgtagctattgaatgaataatctttaatatctatttgtttctggcctcacatgggaaaagaaacttaaaaacaagaccagatacaatcgtaataattcttgccaggttattggtacgcatctttctggaaatatgttatctgtcatgaatttgtttaaattttgaggaagctgtggatagagcacctactagctttgatttcttaggcaagttgtttgccctctttgaggctaagattcctgctgtgtaaaaggagagctctataaaaatagttgtttgcctgaagtgacagaaattattttcagtgctttgaaacctcgttgaaggggttaatatttaaatgtaagatgatattagaatgatgattaatgtccacatagaaagttcttacagttcaacccattatatacttttgttaaatcattctgtttgaccatcagccccttttcctacttaattggttgtgtaacagtattttaatcggatgtaactggagcatattggtccattgtgaagcagaaatgctctgtttctagaggacaaaactggaggtgaaacttcaaaagtgagctccaggcagactgaaagaagagtttttttgttttgtttcttgtgaaaaaattaacttaggactctcactgcaaaaaactggcaagcctggccctccagtgggttttcagcaatttaaaatgaaatgagaagatgcaaaactatgtcaactgtaaacttaagtattaacattagactccttagaggtcttcattgaaggattttgctttctatttaacaaattaatatttctggtcttcagtttttctgtgtaaaacgaacaggcattctgctgtttctgctgctgctgttagtgctgagcaacagagatacagtatgttctgcggtaggtgatagctttttagacatttagagattaacatttgccttctgatttattttctttgggttaaacatctttcattttttcttccactctttcctattatgtagatttatgctgtttttaatggccaatatttggatcagagtctattcaggagacagaagctacaccataaattgaacagagaatttactataggggtaaagagaactctaaagaatacaggaatgacagatatagggaatagtcactacccttagggctggggcagagtacacaaagaaataacaaatttggaaaagtatgcgcccctcccccaccctgcccccaaagctgattgcatatcttggaggaagtctccatttggtagtaaagatgtttgctgagttgctgcaggtcagggtgatgtggggcaaacaagcccccagactggggcttaacccaggagggttcttggctttgccaggaaagaatttaagggtgagccagtagtgagagaaagaaacttttattgaaccagtgctgcttcttgctgagcagggctaacccataggcagtgtgcccagaatcggtgtctgtgagctgctagctagctgtttatatctgttattaattacatgctaattaagaggcaggttatttagaactttctggaaaaggggctggaagtttctgggaatcagataaggtaacttctaggctgttgccatggcatttgtaaactgccatggcactggtaggagtgtctttatgctaataaaccctgagggcaactcgaggttacttttgtcagcatctgctggtttcagccagatcttgttccaatcagcagggtgcgacaggaaattaagtcctgctggtcttctacctcaaaggtagttaagcaggaagctgtacttgggggtgctgcggcatcaccagcaagcctgtttgaggcactggtggaacttgcctgggaagatgtccatgagaatgcccactaaagcttgttgggatgagcaccatggggtgttctgcacaccagcagagcaccatggaagtaagaagatgcaaaagcacactagaaccaggaagagaaaccctttccttccatgccctctactaagcttagtgtcatcatgcccgctctctaggaagaaatgtttacattattacaggcagggcaatgaaaggtagatttggaattgagaggcaatatattgattacttgcatagcctattattttggctacttagcttccatatgcactttacacacatttgagctcccatataacaatgaaactcttatgtttctacctaacaagatacagctatgtcagagggtgaaactctcacccttgttctaaaatgaggaatgaggacatgctcagccccatagtcattgtatccattgctggctatatttttgtttgtttgtttgttttaatagaatcagggttttgctgtgttgcccaggctagtctcaaactcctgagctcaagcaatcctccggcctcagcctcccaatgtcctgggattataggtgtgagccactgtgcttggcctgctggctgtttatcagtcctcaaatagaagttccagcttcagagggccaaggtcatgtgatgggagccgggggcttggagttctgagggaagaggagtgaagtattgggggatgtggcagtatcactgacagtgaggttttttggaggcttttttggtctgatttgtgagattgatattgtccttaatgataaggaaacaaagaaaatggcagaagtgaaaactgaaaatggcgaagtagaaaaacaccatctcctctatgatggagaatctgtttcaggaaaggtgaaagagtctagaaagagctagagcaccacaacattagaattgaatttgtacgtcaaattgaacttttctatgataagagtaatattcaagagtttgtaaacctagtgaaagaactagccttacctggagagctgactcagaagttgtcatttggaatttatacatgttgaaaagtcatgagaatcttacattggtgctaatgtcctcttgatgtattgaagtgttagtagtaagaagactgacagacttggtaaaaagaatgtgatcttactgttcaccaacttgccagctatcctgatggaagtgggcattgaagattgtctacatatagaatttgaatataatgaagtatcatttaaaggatgtgactgttacaaaaatttacctcttataagtaagaataaaaacacaacatatggggttacaactgatcaataagactgttgttagcaggatatgacctaactccaacaatgaaagttatgaacaaaaaagtttcagtaaggtactttttgaatttagcgcctgttgatgaggaagacagagggtactttaggcagcagatcatttaatggagaaaagctcctgaaaaactgaggaaacagaataaacttttaccagtgatttgaacctccagaatcacaagcatctgctgaatagcctgaaatatactgaataagatgaaaaaagaaaaacaaaactataatcattaagttaaacaggttaaagatggctgcagcatgtggaggggcaaaatgggcataactctgcccgggcatggtggctcacacctgtaatcccagcactttgggaggcgaggcaggcggatcacttgagatcccaagttcaagaccagcccggccaacatgatgaaaccctgtctctactaaaaatacaaaaagttagctgggcatggtggtgagtgcctgtaatcccagttacttgggaggctgaggcaggagaattgcttgaacccaggaggcagaggtttcattgaaccaagattgcaccactgcactccagcctgggcaacagaacaagacttcatctcaaaaaaaaataaaaatggccaaaactccatttatattcatcttcctttatcttacagcgctacatttatttcatgatatagcaaaatgttcttcatgtatatacatttttttttttttttttgagatggagtctcgctctgtcgcccagggtggagtgcagcggcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctgcccacctgggcctcccaaagtgctgggattacagacgtgagccactgcgcccagccacatttttttttttttcccttgaaaatcgctcttttgcccaggctggagtgcagtggcacaatcttggctcactgcaaccaccgcctcccagattcaagcgattctcctgcctctcagcctcccaagtagctgggaccacaggtgtgtgctaccacgctcggctgatttttatatttttagtagagacgggggttctccaggctagtctcgaactcctgacctcaggtgatccacccgcttggcctccaaaagtgctgggattacaggtgtgtgagttaccacacccggccaccttcatgtatatacatttttaaaagtgctttctttgaaatgctcaaattttcttaaactgccttttttttttttactgcacactttgatgacaagcattcagatatgcgtcagcataagctttaaagattttcatgtggcagaaaacaaagttccactgactagtttgttaccaaaagttgtattataaatctaatttcaaggcgggtgcggtggctcatgcctgtaatttcagcactttgggaggccgagttgggtggatcacgaggtcaagagatcaagaccatcctggccaacatggtgaaaccccgtctctactaaaaatacaaaaattagccaggtgtggtggtgcacgcctatagacccagctacttgggaggctgaggcaggagaattgcttgaacctgggaggcggaggttgcagtgagccgagatcttgccgctgcactccatcctgatgacagagtgagacttggtctcaaaaaaaaaaaaaaaaaaaattagccgggtgtggtgcacacccctggaatcccagctactcaggaggctgaggcaagagaatcacttgaagctgggaggcggaggttgcagtgagtcaagatcgcaccactgcactccagcctgggcaacagagtgagactcggtctcaaaaaaacaaaactaaactgaactaattccaacttataataatgggaagaaggaaagaagaaaatggttagaatatacaaacaaataccaaatataacaaagagaaagttcatcctcatttctgtgattagtaatgaggccacagttgatatctaggcttctttcttcagttacctatttcatgtttcccttgccttcagcacgaacctcagctggttgaggttctttacctggtgaaatgactcaaacatttattccctcattagtccagtccttttttggttgctgtagttttccattaatctttatttttggcatggaagtattaagaggtgccttagataatcccttgggtttcagacatagtcctccttgctttcactgtgtagcagcaaccgtttccccttgacaattgggctcaatctttcccaaccagtaggttcagcctgttggttcagtggtgtaaggagtcccaagtagccaagtggcagtctcatcttctaatgcaattgaaccattgttgtgtatgctagtagatatatttcctgcttagggactagcacttccaagccagcagaactcagttgttaggagtgaaagcaaaaattcagtgattgctagatataatagtgagtggagccgcacatacttctaccctttgattcccagacctgtatattctgattgtgggaggagacagcaccatgtaaggtgtctctgattgaaatcattaccccatcctttcagggtgttgtctccctgaaactgtaacttagtcttcagtaatcaattccctattttaattaggccaaccattctgtgtgataggatgtgacaacaccagttaagtccatggacatgagcccatttctgcatttctttactatgaaatgactttcttggtcaggagcaatgctgtgtgggcttggcatggtggcatatgcctgtaaccccagcattttgggaggccaaggcaggaggatcacttgagccaaggagtttgagaccagcctgggtaacatagtgagaccttgtctctattttaaaaatacatctttctttttggccaagcatggtggctcacacctgtaatcccagcactttgggaggctgaggcgggcagattgcctgaggttaggagttcgagaccagcctggctaacatggtgaaaccccatctctactaaaaattcaaaaaaaattagccgggcatggtggcacatgcctgtagtcccagctacttgggaggctgaggcgggagaatcacttgaacccagaaggcagaggtttcagtgagacaagatcgtgccactgcactccagactgggcgacagagggagacctcatctcaaaaaaagaagcagccgcaacactgtgtggaatgtcatggtggtagattgggcacttatatataagttcatgggtggtggaactgccaaaaacattataggcagagaaggcaaatctgtatccagaatacatgtctattctagtgaggacaaatctcttccctcacccctgcccttattccccataatagaagtccagcgtaatcaacttgccaccaggtggttagctagtttttgggaaatggtgcatattcagggctcagagttagtctgtgccattaacagattagacatttagcagtagctttagtcaggtcagccctgtttaggggaagatcatgttgttgagtccatgcacagccttcatgatgattttttccatgggttttattgagcaagcactcttgtagctatggaaagtgtctaacatttatattcatgaagtacgtcattttgtcaacttgcttattaagagcctcctctacagtgaatgcaaatgattattcacatgggacacaaatatcttcacagtctgtgcctgttctgagagtttcatctgcatatctttcccccagatttccttgtcaccatttccttccaagttcctaactagccaacaaaatccttaataattgttcataaatgagtataaatctctgcttctggccatgtcttacctcaggcaaaagggaaaaccaaatgtacccctcaacgttctgccctctgaaggaaagatttttcttcatcactgcccttcagtcctacctctttaaatggggctgtagtgctgcagctccccacttttgggtgatactggcatgttgtgcagagctatgtgtaaaccagacttgagttttttctttccccagtcagctggtcatatggagctctcaggaggccattgacttggattgagggagaggaagcaatgcaacagaactcaatgctgaagtctgagctacctcctatgtaacttactcatatttctggacctgcttgaatttttttttttacgtgtttttcacttgatgatagatcgtgctgcacatgccaagctagactacataggttggataacatctagttcctgatgagaagctcaggacacgtggttgcattatgtcccatggttaggcatttggtctctgccaagacccaatagcaagcctgaaactattttttgaaaggtgaataattttctgcaaaagagggcatagattttctcaaaattctagaagtctgggcagtgattctcttattcttgcttgctaaaggctccattcagcatccctatttgccatggacacttcaagtatcattggatctgccagatcataaggcccaaatggcagagcagcttgaaccacagcttgaacttgctatagaatcttttcttgctctgaaacccactctaaactgtcaaccttgtaggtaactttgtagctgggttgaagcctaccaaacattgtaccctctttttcattgttggtgatgttaattagagcaacttaatcaccttggaagggaaattttgacatgttttgagcaattgaatcctgacatttcattgctgcagtgggtctctgaatttttgtagggtttatctcgcatcaactactttgtatatgtcttactaaagcatctaacgtatttgctacttgctatttatcagacccaattagcataatgtcagtatagttgactagtgtgtgtgtgtgtgtgtgtgtgtgtgtgtgtgtgtgtgtgtgtgtacgtgcttatttatttatttttttggaatgtcacgcgatcaagatctctgtgggctacattatggtaggagaatggcatagccctgaggctagattcataggcacgtaaaaggcaggtaaaagcaatgtgcttctggtggttcttgcagatttgtatgaagaaaaaggcattattcaggttaatagcagtataccaagtgccgtgacccatgttgatttgctccagtaaagatgctatatctggggcatcagctgcaattggaatcatcaccagattaagtttatgatagtccacgagtttatgatagtcactaagatccatctgacttctgcacaggacaaactggcgagttaaatcaagatataataggtatcactaccctgtttctttcaagtcttttgatggtgacattaagctctttaattcttgagatgtggtattgcttctggcttaatatcttagtagggagggtaagttgctaggggcttccatttagcccttactattaaaatgactcttatcagttgggtcagaaagccaatatgggagctctgccaatagtcaagtatgtctgttccaagtatttattcaggaactgaggagataacaacaaagtaggcccattgtactatggggtccactgtgaggtggacttgagctaagcatttcatctattacctgaccactgtcagcactcactttgactgataggccacagtagcattttgagtccccaggaattagtaatccctgaaaggtctgggtatttccttttctctaatccgtagtcactctagtaaatggcctttggggaagcttggatgaggatttacagtatgtacttgtacttgtgggaacactacaggtttttcctcaggggacctgggcttgttaattgacttgggtctagaaattagatgagaggtcaaaacttttctagtcaggtttttactaccagagctggagtttttttcagttgtacagatgaatctgttttggtaggctgcttgtggaatactgtgtgatcaattactgccaaagatcctggtgggccaaggtgttctgattaccagtacaactttactgtatttatagtagatttcccaccttgtctttggtgattacatgctgctacttggcctctgttattttaggatcccgttacccctttaaatcagggaacccacttagtggtggcatttcccatggccatacctaggggttgtgacagagaccttagggactgtaaaacctaaaatgtttatctgtggccctttataaataaagtttgccaacccatgtctaggggaacagggacacactgcaaaggggagcaaccacagagcttttcaaggatgaaggtgatcccctcactaatgcatttctttttttgttgttgtttgtttttttttttgtttttttgagacagagtctcactctgtcacccaggctggagtacagtggcacgatcttggctaactgcaacctctgcctcctgggttcaagcaattctcatgcctcagcctcccaagtagctgggattacagttgtgcaccaccacacctggctaatttttgtatttttagtacagtcggggtttcaccatgttggccaggctggtcttgaactcctggcctcaagtgatccacctggctcggcctcccaaagtactgggattacaggtgtgaaccaccatgcccacctcactaatggatttctcaatgcctgagtgaaaggattatcttccgagcttttttttgcaacataggttacacatgaaaaatccattccaacatttctatctccctaagtttttgaattgcctcttctacatcttgctagggaaactttggcatctccacctcattaaacatagtggactcttttttaaagaaagttttatttatttatttagagacaggctctcactcggtcactcaggctggagtgcagtggcgtgatcatagctcactgtaatttcgaactcctaggctcaagtagtcctccttcctcagcctcctgagtagctgggattacaggcatgtgacactgtgcctggttaattttttattttttgtggagatggggtctctgtgtgttgctcattctaggcttgaactcctgggctcaagcctcctaccttggcccccctgctgagattacaggtgtgaactgcacccagtccttttgttgttgttttgtgtttttttttgtaagtttttaaagtcctgtttattgaagcatgaatttacattcagtaaagttcaccctaagatttgacaaatgcatagtcataccatactcaagatgcagaaccattgtaaaatcactctatcaattccctcctgcccctttgcaatcaacccctttttgatcccaaggaactaattgacctgtttttctgtcaaaagtgtcaaatttaatcactaaaatgacctacagtaccatggaaaaatatgtaagcatataaaatacacaaaccaattttttttttgtattttatttattttttgagatggagtcttgctctgtcactcaggctagagtgtaatggtgcgatctcggctcactacaacctctgcctccaaagttcaagcaatttttctgcctcagcctcccgagtagttgggactacaggctcatgccaccacacccgaccaatttttgtattttttagtagagacagagtttcaccatattggccaggctggtctcgaactcctgatctcgcgatctgaccaattttttatttttatttttatttttattttttttttaatttatttatttattttttccatttaaccctgagtggacacagcacatgtttcagagagcacagggttgggggtaaggtcatagatcaacaggatcccaaggcagaagaatttttcttagtacagaacaaaatgaagtctcccatgtctacttctttctacacagacacagcaaccatccgatttctcaatcttttccccacctttcccccttttctattccacaaaaccgccattgtcatcatggcccgttctcaatgagctgttgggtacacctcccagactgggtggtggccgggcagaggggctcctcacttcccagtaggggcggccgggcagaggcgcccctcacctccctcccggatggggcggctggccgggcgggggggctgacccccccacctccctcccggacggggcggctgccgggcggagatgctcctcacttcccagacggggtggctgctgggcggaggggctcctcacttcccagacggggtggctgccgggcggaggggctcctcacttctcagacggggcagctgccgggcggagggtctcctcacttctcagacggggcggccgggcagagacgctcctcacctcccagacggggtcgcggccgggcagaggcgctcctcacatcccagacggggtggcggggcagaggcgctccccacatctcagacagtgggcggccgggcagagacgctcctcacttcctagttgggatggcggccgggaagaggcgctcctcacttcctagatgggatggcgggcgggcagagacgctcctcactttccagactgggcagccaggcagaggggctcctcacatcccagacgatgggcggccaggcagagacgctcctcacttcccagacggggtggctgccgggcagaggctgcaatctcggcactttgggaggccaaggcaggtggctgggaggtggaggttgtagcgagccgagatcacgccactgcactccagcctgggcaccattgagcactgagtgaacgagactccgtctgcaatcccggcacctcgggaggccaaggctggcggatcactcgcggttaggagctggagaccagcccggccaacacagcgaaaccctgtctccaccaaaaaaatacgaaaaccagtcaggcgtggcggcgcgcgtctgcaatcgcaggcactaggcaggctgagacaggagaatcaggcagggaggttgcagtgagccgagatggcagcagtacagcccagcttcggctcggcatcagagggagaccgtggaaagagagggagagggagaccgtggggagagggagaggagggagaggagggagagggagagggtctgaccaattttttaaaaagtgagatactttaaaaagtttcttcagcataccaacaaaaaaatgaaggtagcattgcattttactacagatgtgcagatattcattaaagttcaccattgtcatatatatggctcaacagtagtatttaagaatatgctgtaaaacaacaatctttagagtcaaaagaatgtaattttaaaacctttataaattaaagcagtttataaagttgtcttaattgtaaaatagctaatctagttacaattaatgtgttccaaaactgacctacttgaaaaactagtcttatatatttgttgagtatgtgaaccatgattaggtcttgctatttggtattaacactgtcaagttacagaccacagctggttcatagaaaagctactttaaataatggaattgaattccgtagaaattttctacaagaccaactcagctatggggagaaacacgaaactgtcaggtgaatattcctacagatgattggggccacctcagaattcacccctgctacccctatgaaagggaccaaaaaaacaaaaaaagcaacctctattctgtagttactaaaggttacatattcaaatatatctcatctacttgaaaagcttcactgattctttcaagcgccagaccttaaattcatcagcatcttgaaactccaccaagcccagtcatgtgccacagctgaaatttgtttttggtttttttttttaaacataatttactcgagtctaaaatttcagtcaaccaatgaggtgaactgttagagccacctccagctatatgatctactcctacacatgttctgaaggtttttgccagtatattattgccacgatcttgcatgtcctggattactagcatcccctttcccattggcaaggtgcttagcactgcacttaaacccaagagtgccaccaaaccaatttctaaatcccatgtttttaagtccgtcctctgagatcaccctactttttgtaccagttctggatcagggttcagtctggaaacagaaatattgcaatttgaacaagggaaagttaacataaagaattattaactagtaatagattaaccattaaagggtaaagagaactctgaaagatgtaggtgtatcagctataggagcagctactccctctgtgcctgaggcagagtatgaaagaaagagacagattggagagagagcctacccaaggcggagattcagaccttttgaggaggtaaagctgtagtctgttgcagttttaagttcctgaggatggcaccagccgagggttaaaagcaagagtattgtttgctggagtgccaacaaaactgtctaggaagctgctctgggtggtgctgtcgaaaatcactgggaagttagctggggtgactggaactcacctgaagccactcattgtggtatccctaaaactggtgggtgagcaccgctgggtgtcccacgcatcacatgaggccacgggagaaagaagaggaaaacacagtggaaccaggaggaaatcctcttcctcctgtagtattcctccagtgcttgctattggcataagaaaaacatttgaagagtccagcttcattattgcaaagcagagcagtaaagtatagatttggaactgaaaggcaataaattgataactaatatatcatacctcttaacctatgcctagaatggaatacaatttccagatgtagtttagccagcataagtagagcaggatacctaccccactccgcatcattcctggtactatgttgttgatgttgcttgccaagaatgtaagctctctatgggtggtgattcttttttttttttttttttttttttgggacggagtttcacctttgtcacccagacaggagtgcaatggcacaatcttggctcactgcaacctctgcctcctgggttcaagcgattctcctgcctcagcctcccaagtagctggaattacaggtttgtgccacaacacccggctatttttttatatttttagtagagatggggtttcaccatgttggccaggctggtcttgaactcctgacctcaggtgatctgcccacctcagcctcccaaagtgctgggattacaggcgtgagccaccacgcccggccaattcagtggaattaagttactctattttatttattttattttattgagacagggtctggctctgtcacccaagctggagttcagtgggacagtctcggctcactgcaacctctgcctcccgggctcaaacgatcctccaacctcagcctcccaagtagctggcattacaggcgcccgccaccatgcccggctgatttttttatttttagtagagacgaggtttcaccatgttggctgggctggcctcgaactcctgacctcaggtgatccgcctgcctcggcctcccaaagtgctgggattacaagtgtgagccaccacgcctggcctaagttactccatttatctactctatctactctacctatctgtctgtctgtctgtctacacatctatcagggacagggtcttgctgtattgcccacgctagagtacagaagcacgatcctaggtaactgcagctttgaagtggcagactcaagtgattcccccaccccagcctcccgagtagctaggactacaggcatgtgctgccacaaccagctaacttttaaaatgttttgtagagacagaatcccattatgttgttcaggctggtctcaaactcttggcctcaagtgatcatcccacctatgcctcacaaagagctgggattacaggcacaagtcactgaatctgggtgaactctataaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccctttggagttactcactaaattagttgtatagtcctgcacatttaagttatggggccgggtgtggtggctcacacctgtaatcccagcactttgggaggcagaggtgggcagatgacaaggtcagtagatcgagaccatcctggctaacatggtgaaaccccatctctactaaaactacaaaaaaaaaaaaaaattagccaagcatggtggcgggcgcctgtagtcccagctactcaggaggctgaggcaggagaatggcatgaacctgggaggcagagcttgcagtgagccgaaattgtgccactgcactccagcctgggcgacagagcaagactccatctcaaaaaaaataaaataaaataaaaccagtcttggcaacacggcgaagccctgtctctacagaaaaatacaaaaaattagctgggtgtggtgatgtgtgcctgtagtcccagatacttgggagactgaggtcacttgagcccaggaggttgaggctgcagtgagccaagatcgctccactgcactccagcctgggtgacagagtgagaccctgcctccaaaaaaataaaaaatattaaattataatattttaatattcagcaaaaaaagtaaataaaattcagtagaacaaaggtgttgcaaaaagaagaatcttaatttgtagattgcatcttttaagaaaaactcataagaataccagccagtatttttatctccagatgaattttttcccctccaaattacaatcatttctccattcaacatcctttattaggcaccacctaggtatcaggccagatacatggtgctgggaatagtgaagagaaagacacagtccttgttctcaaaggactaaacagagaatggaggaaccgtatcttgtattcagatgtttaaatgtatgcataggttgcttatgcatacattatgagaacctatgctacatgttttaaatgtatgcataggttctcatgacatacatttatgagatctcagctcactgcaacctctgcttcctggattcaagcaattctcctgtctcagcctcccgagtagctgggactgcagtcgcatgccaccatgcctggctaatttttgtatttttagtagagaggggtttcaccctgtgggtcaggctggtctcgaactcctgacctcaggtgattcacccgcctcagcctcccaaagtgctaggattacaggtgtgagccaccgcgcctggccagcaatctgatttcatctgttcccaatcactccctccatttaaccctaggtgttttttggaagcaaaccccagatcatttgatctttatattagcatgtatctcaaaaaaaaaaaaaaaaaggttcctttttagagcataattgcaataccattaacaaacacacaccggttccctagtaccaaatatccagtcagtattcaattcaccagttatctcataattaaaaaaaaaaaactagctcgttagaattagaatctaaatttattttaatccatagattcttctataggggatatatatataaacagtttggattttacttgtgttttaaagatgccagagatttaactgtgctcatagccagagggggagaaatgaggagagaaggaatgaaaaattaagtctagaaggttggaggactgggtggcaagaaggtgataaagggcatatttgctgtccttggaaaggagaatcacgtgtattttgcatattctctggtttagcattttccccaaattaaaaagaaataaaaatgggggattatatttttctcataaataggaaggaaagaagtaatgatggactctgatgtagataaatttatggtagaggaaacagcagtcatataatatcattttctataaagtaaaatactatattttggatggagtgagctggaaaagaaagtatgtataacagactgtggagaatgagaaaggaagttgcatggggacacattttgtttttgtttttgtttttgagacagagttttgctctctcgcccaggctggagtgcagtgacgtgatcttggctcactgcaacctccgcctcccaggttcaagccattcttctgcctcagcctcctgattagctgggattacaggcgtgtgccaccacacccagctaatttttgtatttttagtagagacagggtttcaccatgttgatcaggctgttcttgatctcctgaccttgtgatccacctgcctcagcctcccaaagtgctgagattacaggcgtgagccaccacgccttgccagggacacatgtttttataggaagttgtgtagagaggtgtgtttataggaacaagtacattcagtatgataataaatcaagtgttgtaggaggtagaatactgaaactattcagtattctgagttgacagctcagctactgccaacttagcctgtattgtggtctcagggtagcatccttcacctgtggccactctgagacacatccagcagaatttctggttgaagcaaaacaagtgtgctatgtgatcttaaagttatctccttcctgctggagatttccttcaaatgccttggtgttttcaaatattgctagagggctaaactcagagtcttccaaccattgtagggatgtcaaatatcattaatttatttttgtttttttaattgagatgggtttgaagccttttttggggagagtgggggaaagagtcctgttttgtcacctaggctggaatgcagtacgggatctgggctcactgcaccctctgcctcccgagttcaagcaattcttctgcctcagtctcagtggctgtgattacagacatgcaccatcacgcctggctaatttttgtatttttagtagagatggggtttcaccacatgggtcagactggtcttgaactcttgacctcatgtcatctgtgggcctcagcctcccaaagtgctgggattacaggcatgagccaccgcatctggcctaaaatattattttaaatcaagaaaggttagtgggctttttgctagtttaatacagtggagaaggacgctaatatagttggatatgaacatttggatctatttaattataaaaaatggagtcggctgaaaatctgagaaaggagtaggctttctcctgtcactttttttattgaaatacttttatttttattttgaaagttttttttcttttgtgtttttggagacagggtcttggtctgttgcccaggaatacagtggttctatcatagctcactgcaatcttgaaatcctggctcaagcaatcctcccacctcagcctccaaagtaactgggacgacaggtgtgcactaccgtgcctggctaattttttaaattttttttgtagaggttggggtcttgctacattgcccaagctggtctccaatgcctgggctcaggcgatcctcctgcctccacctcccaaattgcgatgattacaggtgtgagccgccatgcccagcttattttgaaataatttcaaatttatagaaaagttgaaagaactttatacatttttccagattcaacaatcaatacgattttaccacaactattttagcattctgtaagatatgtatgtatatgaatatacacgtattttccttgtcacctttgtttgatctaataatctaagatgttctcacatgtgttacttacaatgtcaacagtaactggtatccctgtgtgcatgaaaaaagcaaaaaacaaaaaacaaaaacagtggtgattgtcagggcacagtggcatgtacctgtagtccctgctacatgggaagctgatgtgggagaatcacttggggccaggagctcagtcaaggctgcagtgagctataattatgcctgtgaatagctactgcactccagcctaggcaacaaagtgagaccccatctctaaaaataaatagaaaaaaaagtttttaatttaaaaaaaactgtcagtagtaaatgaaaataccacattcagacattttcccctttcttttctgtgaagcacctttgccagcattaatttttcttaatttttattgttatgccattttaacgtctttatgattaagtttagctcttaatgagatactgtgttgtgtattttttcatttctcacatggctaagcttctatcccaaaagcataatgaagcctgaactttgtcttggatttcttgactttctgcagggaatggggagagggaagaacggggctgtaggaggctagaagtgtgagcttgcactggagtatatagggatttggactaacagacttctaaaactgtaaaggagtttagagaccaaatactagcacagcccttagtaaagacccccaaagagcttgtgtttgtgagggttatatctatttatcaaactaaaactggagaaacctgaaaaatacttatctcattttaaaaagtaataataaacaatatttttattgagaagtatagtttcaaaaatgaaggagattagtaagaacagtggtagcgttttcgcctttttttttttttttttgagacggagtcttgccctgttgcccaggctggagtgcaatggcacgatctcagctcattgcaacctctgcctcccgggttcaaacagtcctcctgcctcaacctcctgagtagctgggattacaggcacacgccaccatgcccagttttttttttttttgtttttgtttttttagtagagactgtgttttactatgttagccaggctggtctcgaactcctgacctcttgatccgcccacctcggcctcccaaagtgctgggattacaggcgtgagccaccgagcccagccatggtttcgcttttaaaaatctttttaatgtctgtcttaatagaacacagctgtatttttatatctgcctctgcattcagtctgtcacaatatgttgtttgggttgcagtatatgaagaaaatccatttcacacaaatatgtagttaggaggaggaatattttgacagttttttttccaggtaactatgggtatttgatttgacatcaaaacttcacaaatggtagtttcttttcttcttcttcctccctttttttttttttttttttttttttttggtnnnnnnnnnnnnnnnnnnnntgggcttttatgcggctgtctctgacaattgaagtgtcttaagggagtgatgtgttagtgtcactcaggaaactagttggaaatgcagtattctcaggaaccagcaatctttatttttaacaagtcttcaggtatgattaagataataaaataaattccaagaaggcctcttcagaaagtggaactcttgtttagcctgaacagctttgcttttttttcttttttttttgagacagtctcactctatcacccaggctggagtgcagtggcgccatctcggctcactgccacctctgcctcccgtgttcaagcgattttcctgcctcagcctcccgggtagctgggactacaggcacgtgccaccacgcctgactaatttttttatatttttagtagagacggggtttcactctattagccaggatggtctcaatctccagacctcgtgatccgcccgccttggcctcccaaagtgctgggattacaggcatgaaccaccatgcccggccctgcttttttttcatgtacaaaagcacaaagagtttacctgatgttttgagtgcttttattcatgccagctcctgagtcaagagtttatttcttctgttaggataacaattgtttatcttgtcccattcagacagttttgaaatgcagttttcttcatcatgtccacatgaggtgaaaaattacttgttggtttttttttttaagcttgttaatggctctgtctttttaaaaagtaacttaaaatgaatgttatataaatatatattgaaaatttagtttatactttcacctctcagagtgtttgttatacagctgagcattagtggccctttttgttttatgcattggggggctatctgatgtacataaccaaatcttagagaagggattatttattattaactcataacaaatgaattagggaatattgattctctaccatgggcagccacatatgatttcggtttacttactattgacaactcatctatattcatcataggataataaaaaatattggccaggcatgggggctcacgcctgtaatcccaggactttgggaggccgaggtgggtggatcacctgagatcaggagtttgagaccagcttggccagcatggtaaaaccccgtctctactaaaaatacaaaaaattagccaagtgtggtggtggctgcctgtaatcccagctacctgggaggctgaggcaggagagttgcttgaacccgggaggtagaggttacagtgagccgagattgcaccattgcactccagcctgggcagcaagagcaaaactctgtctccaaaaatgaaaaaaatattcctggtctcaagcagttctcccacctcagcctcccaaagtgctgtggtttacaggggtgaactactgcacctagccaagtggtagtttcttaaaggttgtttgcaatggggaatctgaaaccatatcaatgaactttttgtactgttatttaaaatccattagtctatcttgcacttggaatggatcatatgtgacagaattagtctagttttgatatgtagatatgctacttgtttaattagtactttaagtgtttagccatatgccttttctgttaaatgccttcaatttcacagagatagaaaactgtcccctgtccttccccattctacttttataggagaatcaaagtctctagggatggccagtggtagtggtaagtattttttctactgcattatgtaaattgcttcttgtttagaatttcattttccatagttttactgaaatagactctctgagtagattgcaagtatgctaaaaaatttattctgaaggctgttgtttctacaggggagtttgcctgcttctgctgtgtagttttaagaacaaaatctaggtcagcagtattgaataaagatgtgggagtgagcctctggtcaaacatgctccttaataataatggtggcgggggactggtgattctgaactttgctgttgagatagctgctccaggctgtgctgcaccctgtggaagggaataaccagcaaaattctgcatcttaaaaccagatttgggccaggtgtggtggctcacacctataattgcagcattttgggaggccaaggcgggtggctcacctgaggtcaggagtttgagaccagcctgaccaacatggtgaaacctcgtctccactaaaagtacaaaaattagccaggcatggtggtgcacatctgtaatcccagctactcgagaggctgaggcaggagaattgcttgaacctgggaggttgcagtgagtggagatcatgccactgcactccagcctaggcaacagagtgagactccacctcaaaaaaatttttaaaaaaatgaaaaaaacaacaacaacaaaaaacagactttcatgctccttctccaggaggggtgaggaaaatgtacccatttctctgattaaaaacttattttttgatcaagaggtggttgtttaaaaaaaaaaaaaaaactatttctttacagtttcttaccatgagtaagaaatataagcagaatcagagtttttaatgtctatcttagaaatgataggctattgtttaaattattttggaattccttatgcttttttaaaaaaaaacattatgtcaccaaccttatgctctttataataaatgcaaatcactttccaagaagtttggtgtataatgtgaatttaacttacatcatttagcccaaataatgatcttgtgataatttgatagcaacttatttattgaatactattctgtctcatgcagttagctaggcattgtgaggaaataaaagtagtaaaagcacagtattttctttttaaacattaatgagttcacttactaacatgtaaaataatgaaaattttaatgataaatagaatacttaaaggctttttaattttttaaaaaaagactaacaggaaaacatgtgcttaaggactaaattctttcctagtaacagtgaatggtaaaagagctaagtagtggaaaatgagcattaaagtcatcagagaggttctgtggaagctatgaggcccaagtggtggctttggaattggatcagggaggagacatttcaagcaggggatcagtgatctcatgagcaaaggcacaggggcagagtggagcacaggctctagcaggagccatgaggggacagcatacttactgcatgactttcctgttggagtagtagggaacaagcctgggatgggttcatttgatgggtaaggaaggctttagattagcatctaacatttgccgtaataatgttttgtgttgttgaagccctaaacacatcgtctttataagctttgaaatagatggataggtgcaccttctctaaataggatgtgacttgaagaatgttttttacttaaccataattttagaactgaacaagtatccttagaggtcattactgtgactaagagagatgaaagggctgtcccaaatttacatggttagcctgtggcaaagccagggttaagaactcaaatatgggcctggtatagaggctcatgcatgtaatcctagcactttgggaggtcaaatccggaggattgcttgagcccagttgttcaacgccagcctgggcaatgtatggagaccctgtctctacccccaaaataataacaataataaattagaagggcatagtggcacacatctgtgtccttagctactggagaagctgagaggggaggattgcttgagcccaggaagttgaggccgcagtgagctgtgattgcgccactatacctgggagacagtcagaccttgtctcaattaacaattcccttttttctttttttcctttgagacagaatctcgctctgtcgcccaggctgggtgcagtggcacagtctcggttcactgcaacctccacctcccaggttcaaacaattctcctgtctcagcctcccgagtaggattacaggtgtgcgccaccatgcgtggctaatttttgtatttttagtagagacagcgtttcatcatgttggccaggctggtctctaactcctgacctcaagtgatctgcctgcctctgccttcccaaagtgctgggattacaggcatgagccaccacacccagcagagatcttgtctcaataaaataaaagtaagaactcaaatatgtctgctggtgcccagctgttctctccctcctttccctctatagattttttagaatatttaataataataataaaagaagaaaaatggctgggtgcagtggttcatgcctgtaatcccagcactttgggagactgaggcgggcggatcacctgaggtcaggagttcgagaccatcctggccaacatggtgaaacctcgtctctactaaaaatacaaaaattagccgggcatggtggcaggcgcctgtaatcccagctactcaggaggctgaggcaggagaatcgcttgaacccgggaggcagaggttgcagtgagctgagattgtgctatcgcgctccagcctgggggacaagagtgagacttcgtctcaaaaaaaaaaaaaaaaaaaaaaagaagaagaaaaaggaaaagctgttcttgaaggtagccaaaggttctgagattgattcctaccttcaacctgagaacatcagaaacatctttctcctataattttctgattaatttcactgcagtaatccagaatggggttgttttattacatttgtgttttgtgattcaagaactaagacaaatatattaatcctatgaaaaaacatattgcttttaatatttttactaatttaaaaaggcgtttatccaagtttcatcaccttttcttcccctctgctcagtgtatatgccacttgtgaaccttcccgaggatgctgtggtttgttctttaattcatcgtcatttttactggcttagacaagtaatgagtactttcatctacttaaannnnnnnnnnnnnnnnnnnnctatgtctataattgctgagtcttatttgtaagttatgttttaccagatttttgagaattataaagatgaatggataagtcaaaagtctcagaattaattttaaaattaaaatgggcttcagaaattatgtagcacaatttttttttttaattctggatgagtagtgtagctctaacagtcttaaggtcacacccaaagttaagtggcagagtcaagattagaacctgggtctcctgattctgttttctttcttttctttttttttttttttttgagacggagtttcgctcttgtcacccaagccggagtgcagtggcgcgatcttggctcactgcaacctccacctcccgggttcaagcagttctcttgcctcagcctcccgagtagctgggattacaggagcccgctaccatgcctggctaattttatatttttagttgagacggggtttctccatgttggccaggctggtcttgaactcttgacctcaggtgatctgcctaccttggcttcccaaagtgttgggattacaggcgccagccaccgtgcctgggctcctgattctgttttctagttctgttttccttctttagcatatctctttttggtttagattgcttttctgtcctgtgaagaagctttgtttttagagatttcctcaatgttacgtgtgccattataagaactaggcattgtatatttgtatattttgttgcgtgcttgtagctagattttttttttttaacatataagggttttagaataatacctgatccataagtctctcctttctcctcccccttttttcttttctttttttttaagacagagttttgctctgttgcccaggctagagtacagtgatgtgatctcgggtcactgcaacctctgcctcccaggttcaagcaattctgcctcagcctcccgagtagctgggattacaggtgcctaccaccacacccggctaattttttgttttcttagtagagacgggttttcaccacgttggtcgggctggtgccaaacttctggcctcaagtgatccaccacctcagcctctcaaagtgctaggattacaggtgtgagccaccatgcctggcctctttctctccttcttctccttctttgtctctctcccaccctcctctttctccccttctttcctccctacaccttctttggcttcattcttaggcagtgtctttcagggttgagaaagatggccactggcagctatattcttaattttatattcttatataaaattcttaatttttttgaggtatattcctaatattttttttttttttttttggagactaagtctcactacgtcactgcagctggagtgcagttgtgtgatctcggctcactgcagcctctgcctcccgggttcaagcaattctcctgtctcagcctcctgagtagctgggactacagacatacgtcaccacacccccggctaatttttgtatttttagtagagatggggtttcaccatattgatcaggctggtctcgaactcctgaccttaggtgatccacccgtctcagcctctcaaagtgctgggattacaggtgtgagccaccacgcctggccagctcaggtatattattatggttcaatatcttaaaatgtctgtatatcaggtttctccaaaagggctttgggcctgcttgaatcacaagtctacttcttcggtggggaaagcaaaacaccaggaccaaatagaggaatgggatggttcctaggggtgggtttccctttagaaggcattcaggcagacaaatcttaagtttctatttggcctttgaaactctagctgccgtttatgaagaactgctgtccttcataaatgtgtttcatccaaagtgatatgctcttggttttcccattcttgcccatggccctaacttctattttgcttgctgtgtgtcttccccactttgtctctttctctgtttcccagcttcatttaattacatccttctatcttcctagattcaattaagttctagtctcctacaggaagatcctagatcatcccacgactgtgttatgtgactgttctttaaactcctataagtagcacttactgcattgtagacacttgtcctacataaaccataatggttattataggattagcaataatttagcatgtttctcataattttctaagcacttcacatatcttagccttatgaagtaggtattagttatgaaaactaaagcttgcagaggtttgcatcattgggcatgtcttaaactctcaactaggctaatacttgcttctgtgttttcgtagtgcctaagcatagggtggtgatggtggtgatctaagttccatgagagcaggacatttcaccatttggtttactgctgaatcactaatgcctggagtagcgattgacagtatgtgcttaaattggtaaatgaattatctggacaaatgtggcatggtttaaacttcagaggtttggattaggtgatcctctaggttcctttcactttaaagttctgaggttaccactgggggaaaaaaacaaaaaaacaaggaaagagctgagggtgtgaaatagaaggagtcactgattcgtttgttagtaatatgtaaattatgagccgcactaatattgtttataagaaagcagactgggccaggcacggtggcctgtaatcccagcactttgggaggccaagatgggtggactccttgagcccagaagttcaagaccagcctaggtaacatggtgaaatcctgtctctaccaaaaatacaataattagccgagcgtgatggcacgtgcttgtagtcccagtactcaagaagctgaggtgagaggataatttgagcctgggagacggagtttagggtgagctgagatcaagtcactggattccagcctgggagacaaaaggagacgctgtctcaaaactatgccatcagtatacagcagatactaaaaggtattgaaagggtagaaatttgactggggaaaagtagggttcaaaaccctaatcacttttttaaaaaaattatttaatatgttgtggtgctgttgattcagtgctgcctggtcaccaccagtagattagctcttgatgtcctgtccctctctttacccagtgcctgagtctgttgcttcggtcagccttgagatttcttctccagcagtgtttaaaaacaagtatgtgtgacctatgtaaaattggccttacatatctactgaaatggtgatgaatacatacatagagtacagaaaattaaactacataattaacccaatttcaccacattcagctctggggaacctacttgtgttgaaatgccatttaaagttggcttttggggccaggtgcagtgacacatgcctgtcatcccagcactttgggaggctgaggcaggcagatcacttgggttgaggagtttgagaccagcctggccaacatggtgaaaccctgtctctactaaaaatacaaaaaattagccgggcgtggtggcaggcgcctgtagtcccagctgcttgggaggctgaggcaggagaatggcgtgaatctgggaggcggatcttgcagtgagcccagatcgcgccactgcactccagcctgggtgacagagcaagactctgtctcaaaaaaaaaaaaaaaaagctgggcaggatggcatatgccagtagtcccagctacttggcaggctgaggtgagaggattgcttgagtcagggaggtcgaggctgcagtgagctatgatcgtactaccgcactccagcttgggtgacagagtgagaccctgtctcaaaaaaaagaaagaaaaaaactttattgaggtgtaatttacatacccaaaaatttacctgttgtaagtgtggaagtaaatgattcttagtaaaattacggagtcgaaatgattcttagtaatattatggagttgtgcaaccatcagtgtaatccatcgttagaacatttttttattaccctaaaagttcccttgagcccatttacaaagccagtcccttttctgacctacagtttcaggtgaccattgatctgcttcctgttatagttctgtatgttctagaaatttcatataaatggaatcatacaatatatattctttggtatcttgatttcctcacttagcataatgcttttgagattcttctctacaaaaattaaaaaaaaattagccaggtgtggtggcatgcacctgtagtcccagctactcttgaggctgaggcaggaagatctcttgagcccaggagtttaaggttgcagtgagctgtgatcgtgccactgcactccagcctgagcaacagagcaggactgtctcaaaaataaaaacaaaaaaagatagccaagcatggtggtgtacacctgtggtctcagctgtaggtgtctcttgcagaggcaagaggattacttgagcccaggagtttgaggctgcaaggcagtatgattgcacctgtgaacagccgctgcacccgaatagtctgggcaacataatgagaccccactcatttcacgtctccaaagaaaacatacaaatgccagatgaacacatgaaaaaatgctcaacatcattagtcattagagcagtccaaatcaaaaccacaataagatgctacttcttaccacatctagggtgactacgataaaaaaagataacaacatgttggtgaagatgtgaagaaactggagtcctcatgtattgttattgggattgtaaaatgacgcagccattttggaaacagtttggcagtgtctcaaaatattaaacataaagttgctttatgacccagcagttctactcctagggatatatcaaagataattgaaacacgttcccacaaaaacctgtacgtgaatgttcatagcagcattattcacaatatccaaaaagtagaaacaaccaaatgtcagctgattaatggataaacaaagtgtggtggatctacacagtggaatgttatttggctataaaaaggaataaagttcagttaccatactacagcatggatgaaccttgaaaacattgtgctaaatgaaagaggtcagtcacaaaagatgacatattgtgtgacttcatttatatgaaatatctagattaggcaaatccttaggaacaaaaagtagacgagtggttaccgaggggtaggggaaagtgggaaaggagaaaagatatgggatttcttttttggagtgaagaaaatgttctgaagttagatagtggtgatggttgtataactgtgtatatgctaaaaaacctttgaactcgactttaaaagagtgaattttgtgaattatactcgataaaactgttatttaaaaaataaaaagaggctggtccaaaggtagtgagttatctcaattgttcagtcagttacagattgaactccacgttccactctttccctgcttctcactgttgtacttgactagtctttaaaaatacagatggagccaggcacagtggctcaaacctgtaatcctaggacttgaggaggttgagatcagagaactgcttgagcccagaagttggagaccagcttgggcaacataatgagaccctgtctctacaaaaaaaaaaaaaaaaaaattttgtttaaattaggcaggtgtggtggcaagtgcctatatttgtagctacttgggaggccgaggtgagaggattgcttgagcttgggaagttgaggctgcagtcagccatgatccacaccgctgcattccagcctggatgacagagcaagaccctgtctcaacaacaaaaaaagagcaactttgagaaaaacaaaaataagtaaataaaaggaaaccaccaaactaccattttacacattctcaaaattgctcctgtcagtctttttgtacagccttttttaaaaaatagggcctttttctgtcaccaaggcagtagtgtgatcacaggtgactgcagcctcgacttcccaggctcaagcaatcttcctgctttagcatcctgagtagctgaaactaaaggcactcgtccccatgcttggctaattttttttttgtatgtccttgtagagacaggtctcactatgttgcccaggctggtctcgaactcctgggctcaagcaatctttctgcctcagcctcccaaagtcttgggattacaagcgttgagtcaccacgcccaacccataattgtgacctattctatagaaaggggtgttaacagtgtgtacaaacacataccaagtcatcagaagaggggtcaatccatgctctggcaggtgatcaattttcttttttttgagacagagtctcgctctgttgcccaggctagaatgnnnnnnnnnnnnnnnnnnnntacctttgttgttgtcttttgttttttttgtttgtttgtttgtttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgtcttttgtttttttgtttggttttgttttttgagacgcagtctcactctgttgccccaggctgcagtacagtggcacaatgtcagctcactgcaaccttcgcctcccaggctcaggtgattatcctgcctcagcctcctgagtagctgggactgcaggcacaggccaccaggcccagctaatttttgtattttttagtagagatggggtgtcacccagttggccaggctggtcttgaattcctaacttcaggtgatccgcctgcctcggcctcccaaagtgcagggattacaggcatgagccaccatgcctggccgtttaatagcatctttgaaaagcaaaagttttaaattttcatggtgtcccatttatatattttgtctcttacagatagtgcttttggtgacatgtctaagaaatctttgcctaatccaaagtcacaaagattttttcctgtttataagtttttttagttttaactcttacattaggtctttgtcttgtctttttttttttttttttttttttttttttgcataataagttagcaagtgagctacgttaggtctttgatctgtttggagttaacttttgcatatggtatgtggtcagtgtccaattgtttctgtatcatttgttgaaaaaaaatttgtttctgggttgaatataattatgttgaattatattatgtttgtagatagccagttgaccctaactttgtatgtttctttctgaacctgttctgttccagtaccacgttctgaacctgttctgttccaataccacgttgtcaataccatgctgagttggtacagtcttgctctgtcacccaggctgtagtgcagtggcgcaatcttggctcactgcaaccttcccactcccaggttcaagtgattctcgtgcctcagcctcctgagtagccagaattacaggcatgcatcaccatgcccagctaatttttgtatttttgctagagacagggtttcaccatgttggtcaggctggtctcgaactcctgacctcaaagtgagctgcctgcctcagcctcccaaagtgttgggattacaggtggtgagccacttctcccagcctgagttggtacatttataataacttttgaaatcaggttatgtaagcccttcaactgtttttcttcaaaattgttttggcttttctaggttttttgcatttttatataaattatggaatgagcttattttgtactttcttcaatatattggtcattttcaggattgccatcttaacagtattgaatctttcattcctgagcatgttatacctttccacttatttaggctggctttttttttttttaattccagctccctgaaattgttgcttttgacagttttatccttgttctttcatgtggagaaatcactaccctcttcgtgcctgcataacctagaagtcactctgtagtgtttttttaaccttaatgacctactttatttccttctatctaaaattttttttagtgacagagtcttgctatgttgcccaggttggagtgcagtagctgttcacaggtgtgatcatagtgcactacagcctcaaactcctgggttcaggtaatcctctctcagtctcccaagtaaatggggctacagacgcaccattgcacccagctccttttatctttcaattaaaagaaaaaagttttcttgtaagacactagctagataggattttttatattgtactagctgtaatactttgtagaaattccactgtagtggaggagaaaactgtaatatcttgtaacttttgttttgtgtctctattttaagggtctccaactgaattccttgaagagaaaatggcctaccaggaatacccaaatagccagaactggccagaagataccaacttttgtttccaacctgagcaagtggtcgatcctatccagactggtaagtgttggcttgctcgtgactactaaatgtgtgctatgacataaatgtgaaaaagctacaaccaccattcagatgaaaatgctttagcttaagtatagatcacaaagtacaaccttagcattggtttgtccctttctcttcttcatttatcctttcctttgagacacttaatgccctctagttccctgctcttcaaaacctattttaaatacattatgtgaaattcatatacactgaagattagaggatccatagtaccttagaaccttaattcttccagaaggaattattatggtaatgttaaaccagtgctgttctgtgccaggcacagtgctagagcctttatatacacattatcggtatttcttacctaactctgccaaatatatgtatcctcttttgacagaagagaaagctgattcatacccactttctataaaattaaaaacagaccaggtgcggtgggttatgcctgtaatcccagcactttgggaggccaaagtgggcggatcacctgagttcgagagttcgagacaagcctgaccaacatggagaaacgctgtctctactaaaaatacaaaattaggcaggtgtagtggcatatgtctgtaatcccagctactcgggaggctgaggcaggagaattgcttgaacctgcgaggcggaggttgcagtgagccgagtatcgcgccactgcaccccagcctgggcaacaagagcgaaactccatctcaaaaacaaacaaacaaacaaacaaacaaacaaaagcctatctgtagtagcccagagctagagttggtaggaagaatgagttccaaaagagccttaaaggaatagctttggtacttccctgttagccagattgagagctcaagttatgtttccacttaaatatggcttcttttttgacatctaacttataagatgctcatcgtttgtttcaaataacctagtatgtgatgttctgtaccatttgtcagttattggctttcctaggtacaaagtaattatggggggagggtgaagaaaaagctgtattgagatacaattcttttttttttttttttgagacagagtcttgctctgtcaccctggctggagtgcagtggcgcaatctcagcttactgcaacctctgcctcctgagttcaagcgattctcctgcctcagcctcccatatagctggaattacaggcgcccactacacccaactaattgtattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtgccttagcactgtaagtttcctttcatgtggcttctgagtaggaagacagattcagcctcactaagaaaaagcagagaaccagacgcttttacagagggggaagggacagagtagcttctagtttcattacactaggctgggcatggtggctcacccctgtaatcccagcactttgggaggcagaggcaggtggatcatgaggtcaagagatcgagaccatcctggccaacgtgatgaaaccctgtctctacaaaaaaatacaaaaattagccaggcatggtggcgggcatctgtaatcccagctacccgggaggctgaggcaggagaattgcttgaacctgggaggtagaggttgcagtgaaccaagatggcaccactgcactccagccttggcaacagagcaagactccacctcaaaaaaaaaaaagaaagaaagaaagaaatattaatctttctagttgcattcaccaggaatgagttttggatttcttctatattccagatccctttaagatgtaccatgatgatgacctggcagatttggtctttccctccagtgcgacagctgatacttcaatatttgcaggacaaaatgatcccttgaaagacagttacggtatggcttcttcaaatggatttattctgtagggaaggaaaaaaattttttctttactcatctttggttcactgactagggctctgtgacaaaagattaacaagaaaaaagagaccaaagtttaaaatgtgaatttaatatgtacatgagaggtacctagggaatgagtaactccgcaagaggtggctttagaattccaccttatatagcttcttcaataaagaatgacaaattttttttttgagaggtgagaagatgaaggaaaagacttttgagtctctaggggccgcaaattgtgggagacaggtaaatggtaggtaaaagctagttagtaaaggttgctgtgtagattcctatggtgccatctccaggctaataatagccttcagcttaaaaaagtccttatgccaaagtagcgtattttggggtggcatattctggtgtcctttagttgtttaatgccaaacaatcaacatggcctttcacacatcacctttgaagctaaccactaagaaaagtcagatttaggggctgtgggtgtgacaaggctctctttggattaatcaaaggagacaattcacagattcacagttgggctgtcatctccccttttttttgagacagggtctcactctgtcacccaggttggagtgcagtgatgcgatcacggcccactgcagccttggcctcctggtcaggtgatcctcccacctcaatctcctgagcagctgggattacaggtgtgtaccactatgcctggctaattttttgtagagatggggttttgtcacgttgcccaggctggtcttgaactcctgggctcaagtgatccacccgcttcagcctcccaaagtgctgagattacaggcgtgagcctttgcacccagccacatttttctacttcttcatttacaggcagacacagtggctcatgcctgtaaccctagcactttgggaagctgaggtgacaggattgcttgagcccagcaatttgaaaccaatctgggcaacatagggagatcctgtcctacaaaaaattttaaaattcatccatttttggtggcacatgcctgtagtctcagctactcaagaggctgaggtggaaggattgcttgagcccagaaggtcgaggctgcattgagccatgatcatgccactgtactccagcctggacaacagagttgagaccctgtcttaaaaaaaaaaaaaaaaaaaaaaaccatctgggtgcagtggcacacgcccgtaatcccagcactttgggaggccaaggcggatggatcacttgaggccaggagttcaagaccagcctggccaaaatggtgaaatcccgtctctactaaaaatacaaaaattaggctgggcctaatggctcatgcctgtaatcccagcactttgggaggcagaggcgggcagatcacctgaggtcaggagtttgagaccagcctggccaacatggtgaaaccccatctctactaaaaatagaaaaattaggccgagtgtggtggctcatgcctgtaatcccagcactttgggagacggaggtgggcagatcacctgaggtcaggagttcgagaccagcctggccaacatggtgaaacactgtctcgactaaaaatacaaaaattagctgggagtggtggcagacacctataatcccagctactcaggaggctgagtcagaagaatcacttgaacctgggaggtggaggttgcagtgagctgagattgtgccattgcactccagcctgggcaacgagcaagaatccatctcaaaaattaataaataaatataataaaaataagaaaattagctgggcaaacaacaacaacaacaacaacaaaactgctacaaagtattttaataaaattgtcttctaatgttggaaagggaggtgttaatctcattttgcagatgaagaaattaagactcgcagttttttactatagtatattatgttggttgtggtgttggaactagagttcaatcattaatattttgaatctttatattaccctttatatattatatagaaagtagccagtgaatgttgattaatggcactactgggatatactataccacctactaacaactagctaaaacctgaagaatgtcagcagtgtttcctttaaaacttgtttgcgttgtcggccgggcgcggtgtctcacacctgtaatcccagcacgttgggaggccaaggcgggtggatcatgaggtcaggagttcgagaccaatctggccaacatagtgacaccccatctctattaaaaatacaaaaaaattagccaggtgtggtggtgtgtgcttgtagtcccagctacttgagaggctgaggcaggagaatggcgtgaacctgggaggcagagattgcagcgagccgagatcgtgccattgcactccagcccaggcgacagtgcgagactctgtctcaaaaaaagaaaaaaaactttttttgcattgttttttattagtctgtgtcttcctggcaatatatgcagctgattttaaatatcaaatacctcttaggccgggcgcggtggttcacgcctgtaatcccagcactttgggaggccgaggcggttggatcaagaggtcaggagatcgagactatccgggctaacatggtgaaaccccgcctctactaaaaatacaaaaaattagccgggagctgtggcaggcgcctgtagtcccagctactcgggagactgaggcaggagaatggcgtgaacccgggaagcggagcttgcagtgagccgagatcacgccacttcactctgtctgcgtgggcaacagagcgaaactctgtctcaaaaaaaaaacaaacaaaacaaaacaaaacaaaaatatatcaaataccttttgtttccaatgtttactaagtttcaaaatgtatttgtttgtgtttcaatattaggtatgtctccctgcaacacagctgttgtacctcaggggtggtctgtggaagccttaaactctccacactcagagtcctttgtttccccagaggctgttgcagaacctcctcagccaacggcaggtaaactattagagactccctttatcagttaatggttgcagtattggtaatcaatataaatcatcaggtgtattttttagcagcttacagcaggtataaaaatttcagaacaatcacaaatgttttgcttatattagtgatatcaccactggaggaattaaattgttgaactataacacttagggttaacgggcacataaatactttttttaaattttttaacatatatatatttttttcatcacattttcattgtattaggtatcagaatttttttttttaattcagtacagatttacggcctggtgtggtggctcacacttataatcccagcactttgggaagctgaggcaggcagatcacttgaggtcaggagttccagaccagcccagccaacatggtgaaaccccatttctacaaaaaatacaaaaattggtctaggcacggtggctcacgcctgtaatcccaacactttgggaggccaaggcgggcagatcacctgaggtcaggagttcgagaccagcctggccaacatggtgaaaccccgtctctactaaaaatacaaaaaattagctgggcgtggtggcaggtgcctgtaatcccagctactagggaggctgaggcaggagaatcacttgaaaccggaaggcagaggttgctgtcagccgagattgcgccactgcactccagcctgggtgaaagagctaaataaataaataaataagctcagcgtggtggcgtgtacctataatcccagctactagggaggctgagacaggagaattgcttgaacccgggagccgagatcatgctactgcactccagcttgggcaacagcgtgagaccgtgtctcaaaaaacaaaaacaaaaattcagtacagatttagaactctggagtttttcttgataggaagcatgactgacctgctgtcccacagattatctttctaatactaattctgtgcccgtgttatttttgaagcctatgttttctctcttctttgccatttctcctccactacttgtcctcccagtattttacatcttattcttccaagtgttgagactgtcaaagagtaggcagaatatgttacttgacattagcttcttcttctttttttttttttttttttgagacggactcttgccctgtcccccaggctggagtgcaatgccgtgatctcggttcattgcaaactccgcctcctgggttctagcaattctcctgcttcagcctcccaagtagctgggattacaggcgcctgccactgcatggctaatttctgtatttttagtagagacagggtttcaccatgtttgtcaggctggtctcgaactcctgacctcagatgatccatccgcctcggcctcccaaagttctgggattacaggcgtgagccactgtgcccggcctaacattaattcttagttatgtgtacagtcttatggtcacaaaagccaaatactctcatgcctgaagaaagtaagcatttttaatgcaaaggtatgagtagacaatgatgtgtcctaaatttccaatttagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatgggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccaggtacgtgcttgtgcttattctcagtatttctctctaccaggttgtagtctcgagaagactaaggacaaacatcatgccaggtaaagtacagacagtcacactgtactttgcaagtttattcatactcctgctctcctagacaactctttcccgcctttaccctcctcccacctccaacacttttctatgttcatctctgctgattgtcctgtttttcttgcagataagtcaagcaataaaatagaacatcgacaaactcctaaaagcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccttcccaacttcagcttccaactaccacttcactcctttgctgccccttgtaggagaactcctcagaaactaatcccatatccaatttctggcagatggaaaatagctgaaatcatgcttctctgaaacgtgtgtggcttttgttattacctttagaaaccgtcacaggaacggggaaaaagtgcagcttgccggccgaggaggattctgtgttagaaaaactaggggaaaggaaaccatgcaacagtcaaccttctgagctttcttcagagacctcaggtaagttaggaaaacaaaatgaactctttgaaacaaattaggggcgatagagtagtgatggtagacattgtctctagttccctgttgtatggtggtaatcagcagtatagtttatgaagtcaattctcttagacagattttatctggtttagacagaatgtcagcttgttatatctttaaaaattactactacagcaaatcaggatacctaattttttttttctccactgttttttttgttgttgttgtcgttgtttttttttttttgagacagagtctcactctgtcgcccaggctggcgtgcaatggcgtgatcttggctcactgcatcctccacctactgggttcaagcgattctcctgcctcagcctcctgagtagctgggattacaggcgcctgccaccatgcccggctaatttttagtagagatgaggtttcaccatgttggccaggctggtctcaaactcctgacctctggtgatctgcccacctcagcctcccaaagtgttgggattacaggcgtgagcgaccgtgcctggccttctccactgttttcatagtgaagaaaggacacccaaattttgatctggttcagctattcactattctatcctgtgtggtcttaagcaagttacataacttgcctatatctcagtttacttagctataatataaattaattggtcaaatgttctctaaagtcttactagttacagtgttccatggcccaacagcatctacattacctgagaggctggtagaaatgcagaatcttgggctctaccttaggcctttgtaattattatctgcattttaattagatccccagataattctaattttcattaaactttgagaggtactgctctaagatactttccaatttaaagtttgattattcagtgaatttgaagattacctgtttttaataacccagaagcatatgtatatgattatcaacttgattttctgtttacttttctgtgactatgattggaatgtggacatcctgacatatgggacataagggcccatgacttatttcacttagaatctctaatgctttgcacactacctagcacaagactagagcttaaataaatgtgtgattttttttttaaatgttgttttactgactcaacaaatcagtaaagatttatcaagtgcttatggtatacaaaatacaccatgttaaggcatatagatatttaagtccccgtccttgccccctgaattattatattataacctgaatgaagagataagttctcaggcatgaactctgaaacccaagatttacataataattgaataaaatagtataaaagatggcactgaatagctgctgattaattgctgaattaaatgttataaatactgggggatactatagcctagcaattttttgagcgatgcaataattaacctgagatattaaacaaaggctaggatttagaggatattggaggggtaaggacaagaatgaaatccactatttacatattataatattcttggaaatcaatttattgggtcagacttgacaggagctggcatatacctgctcttaatgagactcttgccaggatcttggatccatattatattaactgggaggaaggttagaccagatcacctgctgaaactcttccaaaggtactcatcttaattgttaaaattaattatcctacttaacattatatatatttctctgtcttttgggaagtacatttaggagcagaatgttgaaatttaacatatttgtctttcaaagtaggatgctctggttctggaatcatgagaatttttctctgaccaaaatgtggattcagtatattttgtgtgtgtgcgtgaagtgacttaagtctggccttctgatctagttcccagaatctgtctggtttgtttgacaagtattagtttaatattggtgacctagtcttagaattataaattttgtccaaaatcatgtatatttaactgaagcaattaataaatttcaccaaaaagaggcaagcactaagaatgaccaatataaatcagatgagatttacaggcagtaagtgcttatttttagaggttaaaagatgtgaaatgtttcatttttaaaagttcaatcctgctacttctgaaatttcaaatattttataaatgtttgaaaacaatctttacctgagatgatgatctgttaaatatttttgctagcgccagttaaaagtgagaaatgttttagaaaagactgttttcctgagcaaattacagtaagtactatatgtattagtgaaaatagcctccttaaattagtcatttatatggtctggtttttttgtttgtttgtttgttttttgttgtttttaagaaacaataacgaggagttttttgtttggaattttagccaacttcatgtattgcggtacccctcccacacaagccaaacaagtttgcagacccagtgaccgcaggtcaacccggcccaagcctgccagggtccctcctgagctgctgggaggctctcctccatggaagactcttgatcacaggctgggccactgctctttgtctgagtcaggttgggtctctggttcatcctcctgtggtgggcctgggaaccaaagaaaaagtattcatgttgactcacttgaaccccagagggatcttggcagggaggcctgggatatagaaagcacaccaataatgatgaagaaaaagaagaagaaaccaaagcaaaagagatattctcaaccacgggctggaggaccttcggatgatgacaatgcagataagcctaaaggtcatccatttgcagctgacacacaaaaatcaggtgttctccccagccagcctaccactatgggtacagaatatggacttgtatctggagaaaacttgaaaagggaatgtttagttaactccagtgcagccagactggtagctgagaactttgtctcagagagtctcagaattcctttatatccttctgaagaagcccccaaaactgcaataagttctcagtctaagctgagagtagaggaagagagcaaaagtaacaagtcagtactacaaaaccaagacaagaaattgctgaagcaacatgaatacaaaccacagcctgcaccccacctgaagactcctgtagataaaagccagtcagtaggccctctcaatctgaaaggacccctagcagaagtttctgcatacaatgtagaaacccctttggatatcagacttaaagagggttgctctcctttcttggaccaagaggttatgggtgtagtttcaaaacccacagcagcaaaagaaataccaaatttggtacccactttgatagcaagtaatccattagaatgtaatctaaaagaagggaataatgaaagtaaaatgactaaactgcagaatgtcaaactgaaggagtttcctgaaggagctgaagaggataaagaactaaaaaaggaagcttttcccaacgaaagacaagagatcagcatctttacttctgagcagctgcagggccaagtgttggtacaggtccctggggtagagaatgaaccatttaagagaatggcaggtgatggcaaaagcaggaagggaaggggaagttctgggaaaatgagaacagattctgggaaggtaaaagcaaaatctgagctgccatttcttctggacagccagaaggacggaagggctgttctcataccgagtgagccagtctctaaaactgaaggaatgactactcaggataagagtgaggagctggggctgaattcttcaaagcaaccaggcactaaggctgatctcacggaggcagtggtgatgggggagcctaaagagatgactcagcctaaggtggcaggcaccatgcaggcattgattcctttggaaagtggatcaggcatgactcagacttctggtgttagcacagaaacaggagatgtagtcaaagatatgggtgtcaataaccagagcaaggaaggaaggtgtccatggaaggatcatgaggcagctccctggatttctgaaaagcctaaaaagagaggcaatgaaggcaaaagcaaaaagtttaaaaataattattccacacagcctgctagaatggagaggaaggaagaaatccttaacccaccttttgaagggaaggatggagatactggtagtattccccataaaagcaaggaaataggatttactttccccaaaatgcatgattcttcgttctcacatacaccagatacacccacagtggaagcagttgacaggaagggtggaaattttcaggttaattttgttgagcttgggactcttggggaaaacaagataagcacagtcaaggcttctactgttactgaaccacctgccaaggtgacagatgtgagctgccaagagcaaatccagggggcaggatttgttccttcagtagtatctgaggagaataagacagatgcagccaatagatacactgcagtggctgacaaaccaagtaaaaggagtaatgatggaaaaagtaaaaaggttaaaaatagttctcctgagaagcacattctggagaataagatagatgcaacaaaaatacatgttcccatggaaaccacaggggaccagggaattgaaggaatggcctatatggacgaaaatagaaatattacatttacctgtcccagaacaccatcagagctgataaataaatcatctcctctagaggttctggaatcagcagcctgtgaaaaactgcccactcctactcctcaagtagtaaaggaaggtgattcctttccagataccttggcaaaaaatgggcaagagatagccccagcccagatttccaaatcattaatggtagataactacaccaaagatggagtcccaggtcaagaaagacccaagggtccctctgctgttgtgccctctacaagcacaggaggagttgctctacctattacaacagccatagaaacagttaacattcatggagatcactctcttaagaataaagctgagcttgctgattccatgaaaaatgaagcagggatcgatgaagggcatgtgataggagaatctgagtcagtgcacagtggtgcgtctaagcattcagtagagaaagtcacagagctagcaaaaggtcacctccttcctggagtgccagtagaagaccagagcctaccaggagaggccagagccctagaaggatatgcagatagaggtaatttcccagcacatccagtgaatgaagagaaagagactaaagaagggtctgttgcagttcagattcctgacttactggaagacaaagcacaaaagctcagtttttgtgaggaccaaaatgctcaagatagaaattccaaaggttcagatagtttgaataagaaggtagatctgactcttttgtctccaaaaagtgaaaatgataaattgaaagaaattagtctggcttgtaaaatcacggaattggaaagcgtttccttgccaacaccagaaatccagtcagatttcttacatagcaaagtcgaagctcctccttcagaggtggcggatacgttagtaataatgactgcttccaagggtgttcgactcccagaacccaaagataagattttggagacacctcagaaaatgacagaaaaatctgaatcaaagacaccaggagaagggaaaaaggaagataaaagcagaatggcagaaccaatgaaaggctacatgagacccaccaagtcccgaggacttactccacttttgccaaagtctacaatccaggaacaagagagacataagcaactgaagtccgctggtatgaacctgccatggggaaatgtgtgtgcttgtggcttttgagtcagcatcagaaaggcaaagagcttgtgtcttggctccatccagactctaatcatccttgttaatcattggtttgttggcatgaaacctataactgctacggtgtgttttctgcagccaatgtgttccttgtgtcctgcttgaggaggctggtaacttggttgcatgccttttttacccagcactgaacgttgaattttaggggaagttgaattttcaatgaattgtctaacaaaagacctatcatcatccatttcttaatttttttaaaattgtgcctcctatgtatcaagtttacagctaaattttaatcattacttggtataaggattcacaggaggaaagaaaatatttcatgtctagctatgtgcatgagatttttttcaatttatatgtagcttgtgctggtgggactaaatatccaaactgcttttaggttaaatgaaatcagtccacctccttatgaggaaatggtggcctcaaaccagcattggtaggcaccgatttatttgtgtttctagtaatgggaaatgatctctcaatgatacagatacattttttgaccagtttgttgcttatatccattgccccacagttccatgtgggtttgagttttgggcatagtctgtgtccatcaaacatagtccataaaacttgcccatgttgtgttcctcataattttactcttttttggctctattcagtcaagtaattggaatgagattaagaagatgattcctttaagatttagaaatggtagccccgtttccccccacccccaattccccaaaaaagtatacatttaatcgtggcttccctgaatctagctttcaaaaaatgttcccttgtctttgagatttttcacagcctacaagtgacactatttcttaatcactgtttcccagcttgcatgatgtagctactaactccagaatttaaaaaaaacaccaattggttttagtagccagtcaggcttttagagaggtttcatcatgggattgtgttctgcatggtatggacttgttcttttgggtaaagcttgtctatgcatgagtatgtacccactaaggaatactgctgtgtgagtaaagaatgctaaaggttgttatttgcataagacattctcatcttctctgtttttatcttctattagctaccctattaccaaggcagaaaatgaaatagtatgtagagggctttccagcattcattgagatttccagtgttctatccagttctttcgttttggtttctagacccattctttagtttcagcagtgatctaaaagttaacatgtaatttctgtgaaatcccagccatctctttttgctcagtatttccaaagaaatgcagaaagaggatttgtttttcttgaggaagcaagaccagtactgcagaacttttggggccctgcctgggtcaggtcaggctcagagactgtgttagcagtggccttacagagtgggtatgggaaggataatgggtttgggacaaaatttattgtttcttctataaattctaccacacctttcccctaaggacaatgtatacctttttaatagttaaaaaaaaatttttaaactaattgtcgaataggttaatacattcacatggtacaaaggagtatacagtaaaacgtaagttggcctccctccattaaccgccttccagctttccctctccagagcaaccagtgttcacaatagcttatatatccttccagacaatttatgtataataagtaataacatatatatttcctgatttcatataaatgagacgtatacatacatactgatgtgtgctattctttttaaacttaatttttaaagagatcttttaagactcagtataaagaagccaggcgcagtggctcacacctataatcccagcactttgggaggccgaggcaggcggatcacctgaggtcaggagttcgagaccagcctcaccaacgtggagaaaccccatctctactaaaaatacaaaactagctgggtgtggtggcgcatgcctgtaatcccagctacttgggaggatgaggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaagaaagaggcctcttttttttgtttttttttttaatcttttttcctggtacatgtctctagatatgactcattcttttttgatagctgtatactatttcattacataggtatatactaatgtattatagtactttttttttttttgagacagagttttgctctcattgcccacgaaggagtgcaatggcatgatctcagttcaccgcaacctctgcctcctgggttcaagtgattctcctgcctcagcctcccgagtagctgggattacaggcatgcaccaccacgcccagctaattttgtatttttaatagagacggggtttctccatgttggtcaggctgatctcaaactcccaacctcaggtgatctgtctgcctcagcctccccaaagtgttggaattacaggtgttgagccaccgtgcctggccagtacttctttactgatgcacatttaggtgtttcccaactttttttcattagaaatatggtacataaactatctttgtatctataggatgtcatcttcatgtgtgtgcgtctgtgtaataaaaaggggctccggagtaagaatctctggtttgaagaatatgtattcataattttgatgggtgttccatattgctctctgtaggcctacagagatgtcccttgtagagaaaggtacatctctactcccaccctcaacatagacaaatacctgtttccctgcctttctctactagtgtgattttttttttttttttggttatgtgtactgatctaatcggtgaaaaattatttcatggcatagattttgtgtgtgtgctgttttttgtttgttttttttgttttttgagatggagtttcactcttgttgcccaggctggagtgcaatggcacgatcttggctcactgcaacctccacctcccaggttcaagcgattctcctacctcagcctccctagtagctaggattataggtgcctaccaccacgctcagctaattttttgtatttttagtagagctgggtttcactatgttggccaggctggtcttgaactcctgaccttaggcgatccacttgcctcagcctcccaaagtgctgggattacaggcatgagctaccatgcctggctgtgttttatttttttttaatgacttcttcatgtattaacaagtttataaaagccaatccatgctctgaaattatgaaaatattttcttttctcttctattaatatttttcattttaaattgttggccaatctagaatttgcttgtttgtggggttttttttttttgttgttgttgttgttttggtatgttttgtttataaggttgtgaggcagggttacttggtcatcccaccatcatgtttataatcgatctcccactgaactgccacctttgtcataccctaaatttctgcatgtatttggtctatttctggactttctttcctgatccattgatctttccaccaggcttcctaatatattttaatatctaatagggctagcccaaccccttgccctattattctttttcagagttgtcctattcttattttttagttttgtagaagaaaaattaatccactcaatatttttcttgaagtcactgtttctggcttatcgtagggagagtttatgtcttgcatatcgagtttttctgtcgaacagcataatgtgttcacatgttttgttagtccatcactggtgtttatctttgttcctcactttgaatcattcatgttaactgccctgcccccatattgctaccaattctcacatatcttgttctcattcgtcttgtggtcaaatggtgtcacccatggtttccattgtttggacagtaaagatattacaaatggtgttggctgggcacagtggctcacacctgtagtcccagcactttgggaggctgaggtaggcaaatcacttgaggccaggagttcaagaccagcctggccaacatggtgaaaccccatctctactaaaaatacaaaaagtagccacgcatgatgttgcatgcctgtaattccacctactcaggagactgaggcaggagaatcgctctcttgaacccaagaggcagaggttccagtaagccaagatcacaacactgccctccagcctgggcgatagagtgagtgagactccatcccccgccccgcccctctctagcccccccgcccaaaaaaaaaaaagatattattagtggtgttagtaaaaataatagtacctctaactaatccgggtgttaataataatagcactggccaggcgcagcagatcacctgaggtcaggagttcgagaccagcctggccaacatggtgaaaccccatctctactaaaaatacaaaaattagctgggtatgacagcgcacgcctgtaatcccagctactcaggaggctcaggagaatttcttgaacctaggaggcagaggttgcagtgagccaagatcgcaccactgcactccagcctgggagacagagtgagactccatctcaaaaaaaaataataataataatagcacctaccacctattgagttgattttatttgcctggttatctggaaataggtaaatagatcatacacacacacataaaataacactattaaagattatctccatttttcaggtgagaaaatggaggctgtcaaggtcacatagctggtgaagtgccagggttagaatttgaatccaagtctttatgtttctaagatccatgcttttcttagacttgcttcagaagcttccggaagtttcaggtacttaaaaagaaaaagatgaaggttgacaattagtaaacataaaatagactttttttagtatctaggcactaattaaacacttttctacttggagaaataaagatacatcatgaaaatataaactgtgaattagaggttaatttaggattagaatctaggtcttttgactctgtctagcattttattgtccagagagtctgtgtttgatttatttacatgtactttttaacacccagcctagagctttatatatacatgatgcctaatgacattttttgaattataagtgaattatctttttgctgatcttaccctgtttagaagtagggaaagtgaatatattgccaaagtctcttccagcttactgtttgctctactgttattttttcatgctgctgtcaaatttagggaaactttaacagaaggtttctttgcatactatgcatgttcttccaggcagggaagattaatgcaatacgtcaggaagtctaagctcaacttttcagaaaaggactttttttttttttttttttgagacggagtctcgctctttcgccaaggcgagagtgcagtggcgcgatctcggctcactgcacgctctgcctcccaggttcacgccgttctcctgcctcagcctcccgagtagctgggactacaggcgcccaccactatgcctggctaattttttgtatttttagtagagacggggtttcaccgtgttagccaggatggtctcgatctcctgacctcgtgatccgcccgccttggcctcccaaagtgctgggattacaagggtgagccaccgcacctggccagaaaaggacttcttatgggattgtgttttttgtgaagggaagcacaaacttgaaaggatgatccacattagattccaatacccgctccatgttagttgttccctggaaaccaagtagaactgtgagtgacagtgtacttgctatgctgctactgtgaatgggacagtttgggatccctgtaaataggccctccctttgccatagtgaagcctggtcttcttataatctggctttcatttctttcttcagtttgcttgagctcatcaactgtctaccagcagctgggaatgtcagtttatggtgagaaactctcttggtgtgaaacttgaagtaatttataaacccagaattctaacagtttcaaggcccttgtacataaataaaatatgctcagcagatgaaaaaaccatttgttatcttagaacttgctactattttacaactggagaagtacccatttggtaatgtcttttcttaactgtagtgccatttgtgaagttcctttcctcattactctcaccccacttgccctctgattcaactggcttcttttttttttttttttttttttttttttttgagacagagtctccctctgtcgcccaggcaggagtgcagtggcacaatctcggctcactgcaacctctggctcctgggttcaagcagttctcctgcctcagcctcctgagtagttgggattataggcatgtgtcaccacgcccggctaatttttgtatttttagtagagatggggtttaaccatgttagccaggctggtcttgaactcctgacctcgtgatccacccacctcggtctcccaaagtgctgggactacaggcatgagccactgcgcctgactccactggcttttttttactaccgtgctgatgaaatttattgggactagtcacacaactaaaaatagctaccatttattgaaccttactatatactcattgccatcctaaactcttaacctccaaaaaatactgtgtggtcattaccttgtttgagccagaacatttaaatattctttgaaatgaatcaagcaacaattgattatcctactttgttttgttaaatttgtatttatttttttgagacaaggtatcactttgtcacccaggctgaagtgcagtggcatgatcacggcttactacagcctcgacctcccaggctcaagtaatcctcctgcctcagcctcccaagtagttgagactacaggtgtgcaccaccatacctggtgaatattttttgtagagatggggtctcactctgttgcccaggctagtctcaaacttctggcctcaagcaatccttcctccttggcctcccaaagtgctgagattctaggtgtgaggcaccatgcctggcttgaatatcctactttaaaagaagcttcttcccctcatattccctcacccttcacttgtaccctctggttgacaaatagcattgggggattctgaacacactgttaaaataaaaacttagttttgatttacagtattgcagatatagttatttctttaagatatggaggtgacagtaagggggcttccattcttttttttttttttaaatagggtcttgctcagttgcccaggctggggtgcagtggtacagtctcagctgactacagcctccgcctcctgggctcaggtgatactcccacctcagttgcaagtagctggaactacaggtgcgtgcctccgtgcccggctaatttttgtattttttgtagaggctgggtttggccatgttgcacaacctagtcttgaactcctgagctcaagtgatccgtccacctcggcctcctgaagtgtataaacattgcctattgctctgcaaatagcggacacacagcatgatttgtactttttagtatttagtttattcattcattcagtagataccaagtgacattactcctactctaaaaatagactaataaaacacattctatactcttcagagattccagggtggaaaacagacagttttcctctagtaagagaagtttactcctctgaaaaaggatagaagtgtgagctagatcctatggaaatacagagcagaaagggactaagttttcctacaagacctagagaaatcttcacacaggagactctgaaagtatggctaagagtttgctgagcaaattaaggtaaagaattctaggggacagctgtgtaaaggcatgcatagtgaagtgcaggtgcatggaataaagtcaagtttggggaaacagggacatctgttaaacattttgagatgaaattggggaaaagaaagtaagctcctaaaggatcctaggggtattgtgtgcctctaaaagcagaagatcttagatttttgcttgaagaaatgggttatctttctacctagtttagttggatgattctcttttcttttggggagggctatgggagggtccatactagacttaaaagaacaaagacttgatatttccaagttgtagtttttagagttgttgttgttgttgttgttgttgttttgagacagtctccctctgtagcccaggctggagtgcagtggcgccatctcggctcactgtaatctccacctcccaggttcaagcgattctcctgcctcagcctcccaagtagctgggactacaggtgcacaccaccgcacccagctagtttttgtatttttagtagagacagggtttcaccatgttggccaggctagtctcaaactccagcaggtgatgcgcctgcctcagcctcccaaagtgctgggattacaggccttagctaccatgcccggcctttagaggatttcttatccataagcattttcatgtctttggttcacatatatcagattattcgcctcagcttattcattctgtctgtttgcttctcatcctttttttaatcagggagaatcatgatttattttcttgagttaaaacatgagaaatgtttctaaaatgtagaatatggtttctgaaatagttttacctttatgtatgtatgtctaaacacttggaacgtttacttccagggaagaaactagattataacttgacaactttatcttttattaacaaggagtgagtgtcatcaatcattgttaatagtagaattattgactttcattgtaatgataattgtttcctggaggcaataactgggaacagttggtcaatctggaaagtagtgttgccttggtaactgataagaaagaatgcagagaaactagttgtctgtcatgtataaaaaccaaggccctgaacaggttaaatactaactccaagcacaaggctaaaacagaaatatctgccagtacatgtactgggattagagacctgcaggctttgccaagagtcctggaaaccaccttctgcccagacacacaggaatccatgcgctttcttcaaactcagacagaatggaatagaacttcacaatatttagctcaaaggacattccagatcaccaccgcttgggttgggttgaagacagctttaatgatggaacggatcaggtcaaatgatgcagatgcagtgtaaaaggaaactacccatcctttcactgagcagatcttttttgaaagcttatttactgtgagtcaagcactgtgcagtgcacccacatggcacaaatgcacagttcacattcctaccttctagaagctcctgggaaagtcatataaataaaagattacagtgtggtttctaaattctaaaaagagatagagtattatgataatataaagaactcaggaggggttcaaagagactttgcagaggtgagtgagtaggaataggacctagaggcaaggggccgggtgcggtggttcacacttgtaatcccagcactttgggaggctgaggcaggaggatcacctgaggttaggagttccagattagcctggccaacatagtgaaaccctgtgtatactaaaaatacaaaaattagctgggtgtggtgattagctgggacacctgtaatcccagctcctggggaggaagaacctagagacaaggaatcccagtggcagctgaatctaggacttagtccttctggttcttaagtgtgtttctttttacctaggcaggctcacccttttcaaacttcatgtatttacctcatccaccaacttgatataattttacagtggctgggagattggagtttcttgctgtggctatttcctgtggataaatctgcatccctgattgagattatgtctgtaattcttatttggactggagtactgaactggccattctcagggtgttctgtgggttgttttgttttgtttttaaacaaggtctctgtcgctcaggctggagtgcagtggcgtgatcatagttcactcactgcagcctcagactcttaggtttaagtgatcctccttcttcagcctcccaagtagctagtactatgggcatgcaccaccacacctggctaaaaaacatttttttcttattttttttgtatagatgtgggtcctgctatgttgcccaggctcttgaactcttggcctcaagtggtcctcccacctaacccttctaaagtgctggtgttacaggcgtgggctactatgcccagtctttcttgagttttactaattattctatactagggtttccccatcatttgtcatccaggtggcattcacctcatttggggtgcaacaaagccattaattattcttccatttaatatctttgtatgccttgcaaaagcaatagtgtaatcttttttttttttttttgaggcggagtctcgccctgttggcaggctggagtgcagtggcgcgatctcagctcactgcaacctctgcctcccggattcaagcaattctcctgcctcagcctcccgggtagctgggactacaggtgcgtgccaccacgcccagctaatttttgtattttcactagagacagggtttcatcacgttggccaggatggtctcgatctcttgacctcatgatccacctgcctctgcctcccaaagtgctgggattacaggggtgagccaccatgcccagcctagtgtaatgaaactagaagctactctgtcccttccccctctgtaaaagcgtctggttctctgctttttcttagtgaggctgaatttgtcttcctactcagaagccacatgaaaggaaacttacagtgctaaggcaccatagaaagatattaacataaatctaagttctcttaagactggaaattagaaacagaagtttgctaaggaataagtcacccacatcttactctttgcataattaaagcaggaccattctttcttttttttttttcccccccccgatatggagtctcactctgttgcctggcctggagtgcagtggtgggatctcggctcactgcagcctccacctcccaggttcaagcgattctcctgcctcagactcccgagtagctgggattacaggtacctgccaccacacccagctaattttttgtatctttttttagtggagacagggtttcaccatgttggccaggctggtctcgaactcctgaccttgtgatccgcccgcctcgacctcccaaagtactgagattacaggcatgagccactactcccggcctcaaacaagaccgttcttaagatataaagtaaacaccgaaaccaagtgcattgcctctttttctcccttacttcaaacacgcgtttgctcccctaaacacacatacatacacacacatgtgtatgcatactgtgtattaatttgggagttttggagtgatcacaaaagaattaaattataattccaaattaaagtttgaagtacttcaatgatcacaaaaaagatacattgggccgagcgcaatgcccacagctgtaatcccagcacttggggaggccgagttgggcagatcacctgaggtcagaagttcaagaccagcctggccaacatcgtgaaaccctgtctctactaaaaatacaaaaattagtcaggtgtggtggtgtgggcctgtaatcccagctactccggaagctgaggcaggagaatcgcttgagcctgggaggcagaggttgtagttagccgagatcatgccactgcactccagcctgggcaacaaagcgagaccccctctcaaaaaaataaagatacatcgaaaaggagagtcatctagtgactaagattaatttttgctcagcggtttgggaagactggcagtcagaaacctagcatcttctttgtggcttttccattaagttttcaccatgtgatcatgggcaaaccactttttttctctggacaccattttgttcctctataaaatgaggggtctgttagggaagcctcagcattctgactctgtactgtcacacatactttagtgtctttgcagtactgttgatggatataatggacgcttgtcctaaaagggattcagggaataggttatttactttccttaggcagtgccccagattttgaaatttagcttttctttttctcttatctgttagtgattgcaattacgatttatatgttgtttcttgtgagtagtagtggttgttttgttttgtttttgtctgtctttaccagagtgcagcagttctccagtccagggacttaggctttctcacttttgttgttgttgttgttattattactacacatcagattccctatagggagtaggaaaacctacttcatatatatatatgtacagtttcttggttgtttttttgtttgtttgtttggagatggagtttcgctcttgttgcccaggctggagtgcaatggcatgatctccactcactgcaacctctgcctcccgggttcaagcgattctcctgcctcagcctcccgagtagctgggattacaggcatgtgccaccacgcccggctaattttgtatttttagtagacacggggtttctccatgttgttcaggctggtctcgaactcccaacctcaggtgatcctcccgcctcggcctcccaaagagctgggattacaggcgtgagccaccgcgcccggccttcttggttgtttttttaaagctagcatcagtagatacattatgtatttgtgtgttttaactactttgtcaaatgctttttatatatattccctcaatcctcacggctatgtgttttgttgtactcagacccctgggtgaccaccaaacttatctgtatgcctgagcacctggctgacatgatgtcttgggtactcgccccttctatgggcttgaacttcttgttctgaccgcccccccaccccagattgcttctttcaactctctgtctcctgagccttgtaactatgaagccagtgcttggcccagttgctagatgttgacctcataattatattttttcagtttgaccacatttctgatctacacagtatgaactgtagtctggaatatgcacttctttgtgcctgactagcttcattcttctggtttctgctcttggtcttttggctggttcacattttgcagtctgctgtttatggatagaattactgaggcagaatatgtgatatctgaaggtagcagagacctgtaattttagttattgccttagctgttgggtagggatgaactagtgaagtgggtctgggtaggctggccagaactaaaaataatttggctataaggaacaagtttctatgcttgttctttgccttggtattttccgcttcttcagaatataagggccaactaccactttcttcagacatgctgcaacgtccgccatgcccagtcatgcctctgccaataggcagcactcccgcatgagacagaaaggttactgaagatactgcctagtggagtcccaggttgaagtcatactttgagctggacatagcagtgggcctgtgattacttgaatggctgtttcaacttcagaagtgaaagtggtaaaactgaatccaagagcaccttaaagattcccctccttttatagaggaagaaactgaagctaagagcagttaaatgagtttctaagactcttaactattaagtgacacagattttaaaatctggccttctgactcaaagtcaaattaattttttccccaccatgtcagtaaattgagggtgtatatgtgtgtgtcgtttgtggggggtgactagtttacacagaatggggttgttgaggcttacctgatttctaaggtattttccagagttttcctctggtatattcagactgtattacaacaatatcttcctcacccccttttttttttttttggacagggtttcctctcacccaggctggagtgcagtgatgtgatcacggcccactgcagccttgacttactgggctcaggcaattctcccacctcagccttctgagtagctgggaccacaattgtgatcaccatgcccacctaaatttttgtactctttgtagagacagggttttgccatgttgcccaggctggtctcaaactcctgggctcaagcaatctgcccacctcagcctcccaaagtgctgggattacaggtgtgagccatggcacccagccatctccagactttcataattttcctcacatattgtacatacttaattatattattcaattatatgtataaaaaaagaaagcaagaattcaactatgttgtattaccaaggcctttctgtacccaatctcgcctcatattttttcttttttttttattttttgagacggagtcttgccctgtcgcccaggctggagtgcagtggcgtgatctcagctcactgcaagctccgcctcgtgggttcacgccattctcctgcctcagcctcctgagtagctgggactacaggcacccaccaccatgcccagctaattttttgtattttttagtagagacagggtttcaccatgttagccaggatggtctcgatctcctgacctcgtgatccacctgccttgggctcccaaagtgctgggattacaggcgtgagccaccacacccggccaatcatattttttcttgttactaattagaatcatgattctcctggcattcttcattttgttatacctcacttccttttccttagcaagatctttgccatagagtatggaaaccaggttccttgccagttaatctgtattgtgctttgtcatgtattgttactaaacagctcaagatcaaggggaagaaatgtatatgaggctcagttcatgttcagtttttttttttcagcattgcaacattgccactcatcatcatgagtgtagccctgtgtcaggtactgaaggtaatggaaaaggtatataaggttgatccctgtactcttgttgggaacttgagtggtatgaatagagaaggtgagttcttggggacagaggctacagtttagcaagctttcctatgcggaccttggtaatttctttacattttatagaccaaagaacaatcttaacttgcccttttttctaaaggcattgtttaaaaactgtaatcaaatcattgcagtttatggcaaatggcctttttttaaaaaaaaaaaaaaagcaatctaaatcttttcttcatcttggaaaaagacttctcttggatttctgatagaatatttccagtatgctatgttattgcaagacagtaacttacagctagacaagaaaaatcagctttgttcaaagtaagagtatagcctgtccttatagtgtaatttttttctcacagttttgttttatggttccttcagtttgaatatacaatatttgagctcaaagcccagggcagcaaaggaccatgctgagttaaatgggggcagtaagctctggtgagtggggaaaactccaagctacaattgttagagtccctaagtctggaggtcagagaaagatgcactgcccccagtgtgttcacatgacacctaacagattattaggctggaaagagcagggcttggtagtggagggagcaacccagctcatccaaggaaccaagtgggggcagggacaggcgtaaatgcataaggggtatgttgtcacacaaatgtcttataattagaatatctatccccaaagccctgatcactgaagtctttaaatgaaccctttattaaactcttccattatgcagagctacagatggagctcttacgggttttggggaccccactcaagtcagttttcaagttagtttgataagttgctatgacagcaaacccactcttcctctgagaatgaatgcctgcaatcttaatactacgttaaggtgtggttttttttttttttttttagtccaattttgaacaatttcctggattcattgttcttcagggttatagctggggattggcaaatgagtctcggttatttttaaaacagttttctgagtggttgaatgtggaagggtgggcatggtatcagataaatgagtgtgtgggtatgcacgtatctatatcagtgaaagccaaaataattactatccttagtgcttggattggcaccatactgtgttttaaattgcagatctaaacagagtgctagttcacgggaaattacattctcagattaaagtagcattttgttgtgcagaaagcagcaggttccttcctttctttcgctttcattcattcttcctttctttctttctttcacatttgtaagtgcatttaatactcaactgcttgaggagagaggggcattgagggagagatgaattttgtcatgaatactggggaattggtgtgatgtcactgcaagctctgtgtgatcgtaggtggtattagagctccaggagcgaaagcagggagagcagtggaggagagacgatgtcgctctcagacaagcagacagcctctctcactgccgcgtacggtcagctcagtaagggcaagcctgcagagtgccgaatggactccccaaaagaaatcagtcaagccggattcgaatggcagaggacagagggcaaactgaatgaaattgggctgaatgtcagcatggacgggcaaccaaaagatgggcttgtgaagaatgccagcttcctggagcagaacaagctctgcttttttgaggggaagctagacaaagagctgagcattgaaatgcaggacaaggactgtcaagaagcctcaggtcaccttgagagcaggtatgtgatttcagagacctgccatcccttggaggggaactcggtacaccagaagacctccgagttccatctgggactcatagaggggccagacaaaaacaaaaccattccagttcaggggaaggtggcagggaagaatggactagagaccaagagccagtcagatctggatttccctggggctgctgacatccctaccagatatgttaaggagcaggaaaccagtgtttggaaccccagctttcatccagtggctcaaggctctctgggctcaagggaagcaactccgggagagatggagaatagcatcacccctggctgcccagtgattggggtggtaaatgataactctgagcagctgaagtgtgagtccccactcctggtgtctctagcccacccagcccccattattgagcattcacccaccaccattccgccaatcactatggtgttcacccaggaacatttgaatgcaagctgtcacatcagagaccatgataaggagttggagaaattgagttctaccgaggaggctgtgctcaaccaagccccccagcagaaaaaggcagtgcgcagggccctgtctgaatgttctcacctctcagttcccccagctgtcaaccttgcagataagtaccctgaactccctgcccgagaagagccttcttctggcctgctgcctccccctagtagcccaatgcctagtcctacacctgggaaactgggagctcctgctatgaagcgctccatgactgtgggtgaggaacagacagctagctacaaattgagccctgggaaactgcccatcttgtctactaaagagatacctcctttcatctgtgaggaaccagtggccaagaagagagaagaattggctcacttcagcaacagcagcagcaactctgggaagaaggaactcggcactgctggattatatctccatagtaagctggagcagattcctgaaggaagcagcaaggaaaaagggcaggaagattttagtgaaactagaattgattcatgctcgcaggtttgccagcgaggagagaaacagccaggacagacggctctggcagggaagaaagaaattgaggtcactgcaacccagagcactccatcgttcctgtttgaaaagcccccacgtgatggtatgtttctaaattttgcctccattgggaacaagcagacagcaaggaaggaaccaaagtgacagattaccggcagagcactaagcagctttttacagctgggttctgtgactgcctggggaaagcttaattcccttgtgttggaagcttgctgggagtgaggcaaggaagagaacaaagtgaatcttgcagggtcaagctgaatgtcttgctagcatgacagataatgtgaattgagtatgcaagtttggggtggaatggggtcagagaatggtgggtataaaaactagaccccctttcttgacctcatgtcaccctgtccaacccatcccccatccacccagccctcagctccctgttggtttgaaccagatgattcctgagctctaaatccttcaatcccaactgattgatttccttgcttgaaaatctgtcactttatatagattcacaatgggtttatcagcactaacctcctctcattaagttgcacaatctgggtggaagctctgttttctgtttttgcttttgagaacgttttacttttgttcaaactgaaaaagagccctttaaagctagctatttaatattctttctgtgttcttcatgtttgacccaatcttgcttctagttttctctttttgtatgtgttttgagaggatttgtggggagaaaaagaagaaagagaaagcagggagagaaggagagacttgcaacctaataaacagctaaattttgcggtctttgtgacagccttttgtgtctttcttcctggccctttcttttcttccccatctcccatccccccacagctcttattgtggtggtctaaaaaagcttgtgtttctccgagtccagtttgagcacaaagggccataattcacaaacttgtaaatggggatttaaaacatgtgttttgcttgtttaaaaaaaaatagtcttgtttcctgggacctgttttctctaatatttattactctcagtatatttttatgaaattgtactttttttctttgaaagtaagaaatggtattttctaggggagtggtaagtagaagacatacagatgttttgggttttttttttttatggagataaaaaacattttttgttttttatggagataaaaaacacgtttttttatggaggcaaagaagcttaatagttcctctttgatttcttatgactccagaattacaagcattcaggtgtcccatgctgttgcttccttctagctgggacagaactgtaagctcttcctggacaggactttgtcatctttttcttgatccccaggtgctttgttcagtaccacataacttctaggtgatcatgagtgaagactttgtttcagaacaagttctttctaattcagactaacagaagtttgtgctaatagaaaaaaatttcagatgactgacaaatccaccgatccattcacccgataaatgtttaaatgctgactctgctaaccactctgtagataaaacttttataggaagattgtttcatttaacatgcctaccatttgcattcactatctaggcactggaaattatccttatcctcaagcaacttttgatccagttggaggactgggaggcagtgggagggttgtgaattgtggaaacattttggaggaagtcacatttgaggtgggccttggaaccctgggatgccaaataatgcggagggaaagccttccaggcaagggaactcatattaaacaaagatatgaagcctagacagctcatgttaggtaaaagaacaatggaggaatctcagggcatccagtcacaggaaatgtggccaggctgctgccattgtgtatatctctcttgggacctctgcttctccctgcacatgtactccattctcttccctttaaaaatctgtatttcctctgtcatctctttttgcttcccttgtaactctgcccaggacagaatagcattgagttgccatggtttgagctctgtggccagctttgttaccaccatatatgtcagggttccgatgttgcatgactgtcatttccatgtctttgtctatactgacaatgagtgagtaattatatcttattggctcagcttggtccagtcaactctataccaggtcccatagccttcttaaccaatctgagccatttagacccacccgcttcattcaccttgaggcttctctaaaggagagagtataggttaaggaaatattccaaagccgtctttacatatgtgacaagaaataatgggagaaaattctagaaagttgtttggaatccaatcttgctaagcttcaaatgtcccactgaaaagtttaaagcttactactgtgtctggaattggtgggttcttggtctcactgacttcaagaatgaagccacggaccctcgcggtgagtgttacagctcttaaggtggtgcgtctggagtctgtcccttctgatgttcagatgtgttcggagtttcttccttctggtgggttcgtggtcttgctggctcaggagtgaagctgcagaccttggcagtgagtgttacagctcttaaggcagcgcgtctggagttgttcgttcctcccggtgggtttgtggtctcactgggctcaggagtgaagctgcagatcttcgcggtgagtgttacagctcataaaagcagagtggacccaaagagtgagcagtagcaagatttattgcaaagaacgaaagaacaaagcttccacagtgtggaaggggacccgagcgggttaccagtgctggctcgggcagcctgcttttattctcttatctgggcccacccacatcctgctgattggtagagccgagtggcctgttttgtcagggcactgattggtgcgtttacaatccctgagctagatacaaaggttctccgtgtccccatcagattagttagatacagagtttcgacacacagattctccaaggccccaccagagcagctagatacagagtgtcgattggtgcactcacaaaccttgagctaaacacagggtgctgattggtgtgtttacaaaccttgagctagatgcagaggttctccaaggccccaccagagcagctagatacagagtgtcgattggtgcattcacaaaccttgagctaaacacagggtgctgattggtgtgtttacaaaccttgagctagatacagagtgccgattggtgtatttacaatccctgagctagacataaaggttttccaaggccccaccagagcagctagatacagagtgtcgattggtggattcacaaaccttgagctaaacacagggtgctgattggtgtatttacaatccctgaggtagatataaagactctccacgtccccaccagactcaggagcccagctgggttcacctagtggatctcgcactggggctgcaggtggagctgcctgccagtcctgcgccgtggtgcgttcgcattcctcagcctttgggtggttgatgggactgggcgccgtggagcagggggtggtgcttgtcagggaggctcgggcggcacaggagcccatggaggggtgggaggctgaggcatggcgggctgcaggtcccgagccctgccccgcgggaaagcagctaaggctcagtgagaaatcgagcgcagcacttatgggccggcactgctgggggactcagtacaccctctgcagccactggcccgggtgctaagtcccccattgcccggggccagcagggctggctggctgctccaagtgcggggcccaccaagcccacgcccacccggaactccagctgacccgcaagtgctgcgcgcagccccggttcctgctcgcgcctctccttccacacctccctgcaagctgagggagctggctctggccttggccagcccagaaagggggtcccacagtgcagcggcgggccaaagggcccctcaagtgccgccaaagtgggaacccaggcagaggaggcgccgagagcaagcgagggctctgaggactgccagcacgctgtcacctctcactaccatgttctgaaactgtggtgactgcctatgatagcagataaagtagctccaggtcagctttaggaagatttacttgttctcagtaagtgtgatgaactggaagacaaagagttgaaagcaaacaatcctgttagaaatttgattcaggtagtggcagatgaaacgctgaggatatgagaggggaaatataacaggtgaagataaagtgaaactggaatttggaaggtgtgtgagaaaaaggaattgaaggtcatgctgtgatgtgaggctggttttcccagccagtggtagtataggtaatggaaagacccaacagaagagcacagttcattgaaggagttagtaagttccacatcagacattgcttttgtgaaactctggggatatgtgggtggtggtctctagaaattgcctgatagctgggcttggtggctcatgcctgtaatctcagcactttgggaggccttggcaggcagattacttgaggccaggagtttgagaccagcctgagcaacatggcaaaaaacccatctctatggaaaaatacaaaaattaggtgggcatagtggcatgtacctatagtcccaactgtttgggaggctgaggtgggaggattgctcgagcccaaaaggacaaggctgcagtgagccaagatcatgccactgtgctccagcctgggagatagatcaagatcaggtctcaaaacaaacaacaaaaaagaagttgccttatatatccatgagacaagggaaagggcttggtgagaactaccttctgggagagagaaagcagtttctgcttatgcacagttacatttatttgtataggtcgagttactgcatgcctgtatcatagacaatgcgactttatgaaatatgttgtttactgaaaaatgctgaacttattgaaaaatatttatagtggtctggggccagtggcagctagttacacaagtaagatcttctttgagcttgctgtagaacaaaggcattagccgggcgcggtggctcacgcccgtaatcccagcactttgggaggccgaggcgggcggatcatgaggtcaggagatcgagaccatcctggctaacacagcgaaaccccaactctactaaaaatgcaaagaattagttgggcgtggtggcaggcgcctgtagtcccggctactcgggaggctgaggcaggagaatggcatgaacccaggaggcggagcttgcagtgagccgagatagcgccactgcactccagcctgggtgacagagcgagattccgtctcaaaaaaaaaaaaaaaagaacaaaggcgttaacaaatttgcacagttgttggctatggtttttccccattacattttaaaactagaaaaatactcagtttttgactaaaagtacatatggttcaaacatcaaaaagtacaaagtgctctccattacaaaaacctcctaccaagacaagatggtatcatctcattgttttctgctcctcccctgtaaatacaactaaatagtctggaaataattgaagataattccataaaagaatatgaggtagaaagaaggcaaacctggtagggatctcaggacttgaggaatggcaatacagtgaattccctgggactgatgaattgattgattgattgattgattgattgattgatggtagagatgggatcttgctatgttgcccaggctagccttgacctcttgacctcaagtgatcctccttgcttgacctcccaaagtgctggtattacaggcatgagccactgcgtccatcccctgggttttctttttgtctcctacatatccctggctgggcactggagaggcctgtaacctggaattaccaacaggcatagactgaaaagaaaaggaaaggaaaaaagaaaacaaatagagaaaatctgttctctattgccaaaaaaacaagaaagaaaaaaacccagcaaagacctaatggtgagccctgtttcactacccatccccagcagtgggctcagtctgcctgcaggtacagtgtcaatgcagcccataagggccttcctgttgtccactccatactcagcagaagctataggcctggtccgcccacatcaccagcaactgcagggaggcctgtcccctaccaggtaacagcaccagtggcttctatagccctggtgtcttgtaatcctctacccaggggcaggagactttcgtaggtttcagaacctctacttccttccccttagcaagagaaagcccccgaggtaggtgtttcctgctcccagcaaccccagcagagatcaaacaggaggtctgcctgggtcccaggcagccagagagcagtccagaggaagctctctattctatgtttccagcatcactcagcccctatgtgctgacactgggtgacacaggtaagtccctacagccctttcaggcagtaccaaaagggattagttagaaccttagcagaatcagaacacaacaggccataaatgcattgcaagggctctaggaaccaaattgtcatcagaactacagtcataacctgtagactaaatataaacagggtgattgcatgctaaagtacaaaatcagaattttaaagcagccatcataaaagtgctttaacaagcaattatgaattctcttgaaacaaatgaaaactaaaaacctcagtaaagaaatagaagttacataaaaagaaccaaatgttaattgtcaatatgaaaaatataataattaaaattaaaaacttcaatgggctcagcagcagactgcagataacagaggacagaatcagtgacgttgaggacagatcaataggatttattcaatctgaacaacagacgaaaaaatggtctacaaggaaaaaacatatcttcagacccatgggacaataacaaaagatctaacatttgtatcatcagaatctcaggagaggagcaaggatgcaaggctgaacaactgttcaaagaaataatgacaacaaacatcccaaatttgacaaaagacaaaacttacagattcaagcaactgaacaaataccaaataggataaatgtggagaaatcatgccatgacttttcataattaaacttttataaactaaagacaaaaatctgtaaaaaaagcaaagagatatgatgcattagggaaacagcaatttttttttttaaccttccttatggtgctgaggaaacagcatttaaatgacagcctgtttcttatcagaaactggggaatgcaaaaagaagtggcacaacatttttcaagtgccaaaagaaaagaactgtcaactgcaaattatttggtaaaacaatccatcaggaatgaaggggaaataaataaaaaagacatttttagataaaggaaaactaagaatttgttgctagtagacatacccttagagaatggctaaaggaggctctccaaaaaaataagatttggtaacagaaggaggcttggaatttcagaaataaaagaacaacaatggaatgggtaaaaatatggaaatagccaggtatggtggctcatgcctgtaatcccagcactttgggaggccaaggcgggtggatcatctgaggtcgggagttcgagaccagcctgaccaacatggagaaacccccgtctctactaaaaatacaaaattagccgggcgtggtgacgcatacctgtaatcccagctactcaggaaggctgaggcaggagaatcgcttgaactcgggaggtggaggtcgtggtgagccatgccactgcactccagcctgagcaacaagagcaaaacttggtctccaaaaaaaaaggaatataatagacttatctcctcatgaattttttaaagtcataaatcatatttgaagcacaaattgtaatgccatctgatgtagtgcttaatctatgaagaggaaacacttaagacatattttagggctgggcgcagtggctcacacctgtaatcccaccacttttggagaccaaggtgggtggatcacctgaggccaggagtttgagaccagcctgggcaacatgacgaaaccccatctctactaaagataaaaagaaaaattagccaagcatggtagcgcacacgtgtaatcccagctgctcggttggctgaggcatgagaatcacttgaacctgggaggcagaggttgcagtgagccgagattgtgccactacactccaacctggacgacagagtgagactctgtgtttaaaaaaaaaaattaaagtagggagaaaataaaggatcctaaatggaagtaaggttccagtaggtcactcaaagtagtaaaacatagctgggtgtggcggtgtgcatctgtagtcccagctactcaggaggctgaagacggcaggatcacttgagcccagagtttgagaccagcctgagcaacacagtgagaccccatctctagaggaaaaaacagtagtagaacattgataccagtttgttgtatgtatattgtaatacctagagcaaccactaagaaaactatacagagcaatatactcaaaagcttttttttaataaaaatagaattctaagaaatgttcaggtaaccttgggtgagatgtaatttgaaaaaatgaaaaaaggaaattaaaaagattaaaaatgttcaggtaaccaacaggaaggcaggaaagtgaaacagaaatgagaaaaagagagaacaaataaaaaataaaatatcagacttaagccttaacatagcagtaattattttactttatttcatttatttttttatttactgagatggagtttcactcttgtcacccaggctggagtgcagtggtacaatctcagatcactgcaaccttcacttcccaggttcaagcgattctcctgcctcagcctcccaagtagctgggattacaggcgcccaccacaacgcccggctaatttatgtatttttagtagagatggggtttcaccctgttggccaggctgatctccaactcctgacttcaggtgataagcccacctcggcctcccaaagtgctgaatggattacaggcgtgagccactgtacctggccatcaggaattattttagaagcaaatggtctgagtactacaattaaaagacaaagattggaagagtatattatttttaaaaaatgactcaagtaggccaggtacagcggctcctgcttgtaatccctttaggaggctgaggcagaaggatcacttgagcctaggagttcgagaccagcctgagcaacccagggagaccccatctctacaaataatttaaaaattagccaggcatggtggcacatgcctgtggtcctagctattcaggagctgaggtaggaggatcacttgaaccgaggaggtagaagctacagtgagtacagtcagccatgatcacacctgtcttaaaaagaaaaaaaaattgcccaagtatatgctatctacaagaaatgcataacaaacataaggacataggtaggttgaaagttaaaagatggaaagaaatatatcatgttaacaattttttaaagtagcagtagctatatataatgattatgcatatatatatatatatatatatatatatatatatagttgttttttcttgttgcccaggctggagtgcagtggcctgatcatagctcacagcaggcttgactcgctgggctcaagcaatcttcccacctcagcctcccaagtatctgagtcttataggcatacaccaccatgccccactaattttctttcgatttttgtagagaggaagtctcactttgttgcccaggctagtctcaaactgctggcctcaagtgatcctctgcctcagcctcccaaagtgctgggattaaagattacgtgtcctggagtgactatactaacatcagacaaagtagatgtcggagaaaagaataaaggatcaatcccactaagattgatccttacatttagaaaacttagcaattctaaatgtatacacaccaaaaaacagagcatcaagatatatgaaacaaaaactgacagagctaaaaggagaagtacacaaagtcacaattacagctggggacttctgtaacccactatgaacagttgatagaactactagacagaatgttagtaaagatgtaacagtgccatcaaacaacaaaatctcataaacattgatagaaattccactcagtgacagaatgtacattcttctcaggtgtccattaaacactcaccaagatggatcttgggtcataaaaccaacttgaatcaatttaaaagattgaaattatgatggggcatggtggtttgtgcctataatcccagcactttgggaagctgatgtgggaggactgcttgagaccggtcagtttgggccacatggcaagacctccatctcttcaaaaaaattttttttgtaaattattcaggtatggtggcacgtaccagtagtcccagctacttggaaggctgaggcattagggtctcttgagcccaggagttccaggtggcagtgagctgtgatcatgccactgtactgcagcctaggcaacagacttcatctcttaaaaaaaaaaaaaaaaaaaaaactgaaattggaattatttcaggtatacaaggttagtgcaataatcaaaagtaattgtcagccaggtgtggtggctcacacctgtaatcccaacattttgggaggccgaggcaggtggatcacgaggtcaggagatggagaccatcctggctaacatggtgaaaccccatctctactaaaaatgcaaaaaaaaaaaaaaaaaaaaaattagccaggtgtggtggcgggtactgtagtcccagctacttgggaggctgaggcaggagaatggcaggaggcggagcttgcagtgagctgagatcacaccactgcactccagcctgggcgacaaagtgagactccatctcaaaaaaaaaaagtaatctgttatagtctgaagaaaataaattgtaaacacagaaaaatcgtttaacagaatcaaatagccattcatgttaaaactctcagcaaagtaggaatagagaggaacttatttaacttgacaaagagcgtctacagaaagcctacagctaacatcatatttaatggtgaataagtgaatactttctatctaagattgggaacaaggcaaggatatctacttgcaccactcttttaaatatagtgtactggaagttactatagagatggagaacatagtagttgccatatatttagggattggaaaggggatggggtagatatggctatagaggggtaacatgaagaagccctattgattgtaaccagccactccaggccaggtaatctgtaatcccagcactttgggaggctaaggtggtggtggtggttacacaaagctacacttgataaagttgcatagcactacacacacaaacacacacacacacaaatgagtgcatgtaaagtgaaaaatctgagtaggctctgtgggttgtctctgtttcttggttttgatagtatactgtatttacgtaggatatcaacacttggggagactgggtaaaagggtacacagggaccttccctatgtatttctttgcaacttcctatgaatctgtaattatttctcaaagttttaagcctcctaacctccccagttttgtgtcccatcctttccctcaaaaacgttgttctgtttaattacaatcctttcaaaaattcttttaaaatgcatatataagtgtatttgcaatatcttttccctcatcccttttcaagacaaatagtttcacattatacttatgctttgttgttttttttttcacttaatagagaccattgcatagtaatcataaaagaatttctccatgctttattttttcacattcagagattacattgatatttctaccataataaccagttttctattaacggacttctgggttgttcttttgcttttagaaacaatgatctggtggaaaccttgcacatttactatttggctggtgtgtaaatacacttctaggataaattactagaaattggttttctagattagaatttatctgtccttgtaattttcagaaaatgacactgccaggcagccctgcctatgggtcatacagttcacatacctaccaagtatatttccctatattattctcagtagttattttaaaattttaggacttttgacaatatgttaatattaatggcatttcaggccaggcatggtggttcatgcctgtaatcccagcactttgggaggctgaggtgggtggatcacttgaagtcaggagtttgagaccagcctggccaacatggtgaaaccctgtctctactaaaaatacagaaattagctgggtgtggtggtgcatgcttgtaatctagctacttgggaggctgaggcaggagaattgtttgaatggggagacagaggttgcagtgagccgagatcgcagcattgcactccagcctgggtgacagatcaagactttgtctcaaaaaataaaatggcatttcagtggggtttttttatttttcttatacttaacattgtacatcttttcatagtttcaaaaaactttgtatctcttttctataaagtctgttcatattgttttgcattttcccagtggattattggcctttgtagcagttactgatttgtgggagtaatttatagaataagctctttgtctttggtatgagggtcaagtattttttctgtttgtcatttgccttttgacttttattatagtgttttgtcttattttgttttttgccacattgaagttttttatttttctttagtcaaacttatctcttgtggcctcttgactttgtgccagttagaaatgccttcccccacagcaaggttatacatttcacagtattttaatgctctcaggtatagtcctattgaaatccagagtaacctctccacagagaggaggctatgttgccttaggcaggagactttatttctggccctgagtctggttccatgggtctccttggccttgttgaaaatctgggtcactgttagaactggatcaggttaatctcacatcctccataaagtggttctttatagggaaaggaaggaaagggagtcattgaatgatcttctggctcttatcccatctcacagcaacctttattccaaagatagactggtagaagaggtttttgtcctattgcttggagagctagtggttggaagacagagtccctttggtctctagggaagggaaaccaaacttaaaggaccatttttttccactgatcatttgtgcatgtgtcccttagactgcttctccacagggtcaggctctctgaatctgaggaatctaaaactgtcctccatcacaatgagaacttgggaggcttgtccacatttcagcagcacaaccctgtggacttttttcagaatgaagtgctagttagtggtctgtctttgctaaaccttgtattttcaaaatgggcatgtaaaatgtttgcttagcataattcccactcaccctctccccttaggaatagccaggccagaagaaggaaggcctgtggtgagtgggacaggaaatgacatcaccaccccaccgaacaaggagctcccaccaagcccagagaagaaaacaaaggtaggtgccagaatggtggttatcttctactgccataatttttaaacggagtatcttctgctgttattgcttgaatcacgaatgaaatttcttttttctgagctgttattgtccttcctcatgtttggacatgcttagaaaatatcttgtattctcatttaccacagtggcctaaaccaactttaaaatctcagcctttgaccctattatcttatatatctgtaaaaaatgttctgtagaggccgggcatggtggctcatgcctgtaatctcagcactttgggaggccaaggcgggcggatcacatcaggagatggagaccatcctgaccaacatggtgaaatcccatctctactaaaaatactaaaattaactgggcgtggtgatgcatgcctgtaatcccagctactcaggaggctgaggcaggaggattgcttgaaccaaggagttggaggttgcggtgagccgagatcatgccactgcactgggctccatctcaaaaaaaaaaaaaaaagttctgtagagattgtttcaacttcccttaacaacaacaaaaaggacaattgcaaaaatattctgaaataaattctgaattatttactattatctcagcgttagatgaaagaaaaaaaaagattctgaaatatccattcatgaaaagagaatgcagattttgaaggtggatcatatagcttcagatgcataactagtacttattgcaaagttcaaaagccacactgtaggctgtggctgctattgtcccatcaagatacaggtagtttcagcatgttgtccagggtcttcaaaaaattaaaaagttattaaaaaaaatacaggtaataatggctgaatcacctcctgatgcttttcttttagaatagccaccaaaagttagttaattattaagagttaattgttttactgaattaaatcttcaggtgccaaactgccagaatttgtgccactatcattaagaaactattcccaggccaggcgcggtggctcacgcctgtaatcccagcaccttgggaggccgaggcgggcagatcacaaggtcaggagatcgaggccatcctggctaaaacggtgaaaccccgtctttattaaaaatacaaaaaattagctgggtgtggtggcacacgctggtagtcccagctacttgggaggctgaggcaggagaatcgcttgaacctgggaggcagagcttgcagtgagccgagatcgccactgcactccagcctgggcgacagagagagactccatctcaaaaaaaaaaaaagaaaaagaaaaagaaactattccccattttctttctctatcctggtttcattccattatttattgagctcagaagaaagaaatgctaattttaagttgcatctatcctcattgcttataattttactttgaattgtgcaatttatactttttttaatttgtttttattcttgtctgtttgatgttgccctttaaaaaataaaaataaaaaataaacaacaatcaacctaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaaggtaagtggtcacctaactactgtgccgaggaaaattgttcccctctgagtgtcagatagacagatccttgttgctaacagacaacagaatcaggctggtggaattgggaaaaggcaagggaaatgggggagagggtgatttgaaaattggcatggctactctggacgcgctgcctatgggttagccctgctccacgaggagcagccaaaaaaagaaaaaagaaaaggaaatcaatttggggcccattgatgcagacattaacattttgaagcccttttatgctcttacctttcccttccctgtttggaggtaatactctatctacttaggttcttcctcctttctctcagctacctactctttacctatttaagcacttattaaccagtttcctctactccacataccagttagatattcttttttggtataattcccacatcaaatgtaattctttgtctttccctgttatcatcctgcagaagttttatccattactattgtgatataactagttcttccagcttatctcagcatgttccagcatgatgtgataacttactttgctttgggcattaggccacctctcactgagctacttctgaagtcatccagttttccaggtcacccacggtttctgtattgcccagaaactggtcacatttggagcagcattagtgttacagaattgctccaggaggagaggatagtggaggctgtggctgcattccttaacatcttgtgttatttgagaagggcctttaggtcagcctgatagtactctttaaattcatggtacgaaatagtttcccatgttaaaatgtcagtttttaatttaatatggtgaagaaaactgtggaacctaggagttgaagtctaggctgaagccctggccaagaaactgaaaaatcctctcataaactagtaatgataaaatcttgtaaagctttctctctgatcctcatttatccagttggttgcttttcttgatctttagaaaacaataggtttgaataagagggcagaggggaggtgcctggagccctggcagcaggtcctccctgttgcttattcagcagcggcttctggggggtgacagaggagagtaggaaggagaggtgtctagtgaaatttcactctataataatcatataaatgaagtgtagtgtactagttgctgtatatacatgaacttttttttaatttttatttttttgagatggagcctcgctctgtcacccaggctggagtgcagtggcacaatctgggctcattgcaacctccacctcccaggttcaagcatctcttgtgcctcagcctcccgagtagctgggattacaggcacccgccaccacgcctggctaattttttgtatttttagtagagctggggattcaccacattggccaggctggtctcgaactcctgacctcaggtgatccgcctgcctcggcctcccaaagtgctgggattacaggcatgagccaccgcgccagtcctgttctaatctcttttatccagatgaggaaataaagctcagagaggcccagcgatttgccaaatagcacacttagaattaaggggccaaaccaggactgcagctcaggcttctgacccagatttggccagtggcctcttcatctgcagcttattttggtagaaagatttgtagagacagagagagaaaaacctattcagaaaaaataagtagattacgattctggcagagaagaaaatgtaaattgggaaacagcagaatagctccagttaacttctgcaggtttttgaagccaagagcctgacatctaaaagatgcaacatccttttgagatttctatcccacataacttttttctaacttattttatcattattaccctcatggcaaaataataagactatgctagattattctgaataatagtcatagtcttaaaaatttgatgcacatcccagagagcatctggtttagtcctcaaattttagagcaatagaaaagggaatcctctggccaaaatcctacatgtttccagcagagctggtagcagaaccacttcccctgattccagccttagcgttcttcacaccatacttaaggcctttatttgtggaaattgtcattaccctacatttgcagagttagactttggatgccagcccttaatttctagtacctccttagctgatttttccatttaacgatatcctgcttgtcgctacctacatactgccctctttatagccacttctcttggaggaagagagctgagcccactgtgtctgtgatttggcatactctcttttgtaatgtggtaatttgtttatcaaaatagtgtcttcatcccctatccccgtagaaaccaggctaaactgattctttcccttattcactagagacgtcattctcagcctccatgtaaaaggaactagagtgacccagatgccaagcatctatacttgagagactttttcccttttgctttcagactgtagctgtgatatcagtgctttttatcccttctgttgatcaggcctgcctcttctcatcgtctctgtgctgagacctttcatcctttatttcctgacatcacatattatcaaagctggtccttcatcaccctccattctaatctctttatcccgatgaggaaataaagctcagaggctcagtgatttgctggagtagggctacagctcacgcttctgtcccagatttggccagtggcctctccatctgcagctcagtcctgttcagcattctctaggtgcgtgttagccaaaagaatggctcgatttgaacataatttttagtttttgtttgtgtatgtttaatctttggtcaagtataatacattagattttattacattaaatacattagtatttttggcatttctacagaggttacattaaaatatatgcgtgtgtgtgtgtgtatgatatatatagcagtagatttggaggcaaacgtaggttgtggtgatgtacccatcagggctgttcattctcactggctcaagttggattgaagtagttttactctctgttgtgtgccctcagatcacatagcaccctgcatggccagtttgttgctttatgtggaggactttgctcttagaaccatatgtattttcctgtcagtagctgctgaacccacagtacctcctgttctccaatacatggttgtatagacacatcttgtgtccaggtgcagtggctcatgcctgtaatcccagcactttgggaggctgaggcaggcggatcatgaggtcaggagatcgagatcatcctggctaacacggtgaaaccctgtctctactaaaaatacaaaaaattagctgggcgtggtggcacgtgcctgtagtcccagctactctggaggctgagtcaggagaattgcttgaacctgggaggcggaggctgcagtgagccgagatcatgccactgcactccagcctgggcaacagagtgagacttcgtctccaaaaacaaaacaaaacaaacaaaaaaagaagcatcttgtagcgtgactccttggggctattgctgacctgcaggcctcattcccactttcctatttccagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactggtgagtattgcctttctctcccatgggaactagggaggggaaaatgggatcttggctttgccccagccatagctctagctagtatcacaaacagctgtgcaggcctgcttacgcaccggtccttagtggactacctggaacagtggtagccctgtgggcctggtacttaacaagccttgatctctgtgtgagcttagcagttgtatgtattcagaaaaatcttgagtgaaggcagaaaaatgtactgctcatgaatttccaggtagaatttactcttgccttagtaacccacagcacctagcacgtggtgctcatgggcttacatgatgataagaagagggcgtggtgctcatgggcttacatgatgataagaagagggctattcaagtccataggcatgtattgacagcctacttttaaggccacatagaaggcttatcagggcagtagagaagaataagactcagtgcctgaccatctaatttaccactccattcccagggactaacacagtccctggctcaaagtagatattcagtaattgttaaataatgaggaatctcactattggatgaactatccaacaggtcagtttgttaaatgttatattaataagtatattttgtacagccattaagactgagggaaaacctgcagaagtcaagaagatgactgcaaagtctgtaccaggtaatagcccatccgccattttgtagagccctaacttgaacccccacctcctctgtggcttaagtctccctttttctctctctccctgaacccgtgttatctctcactcccttctttgcagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggtgggtccagggagcttggggtcctggcatgctggcccctgcatcttcccctccatttccacccactgttcccaggcccaccaaagaagcaggcagtcaggacactggactcagcatcagggtatttcagccggggctctgtagtgggttttgtgccccagcagcagggaggcggggtaggctgagctctgggctttctcttcctgtctcagtaagaaaggctcctgttctagatgttggggtctgagtttacatttttgcttggatgtaaaaggattcttttgtagaagaaacagaggaggcctcagagactctgcaagtgagagagacacttgacatgagcctagtttttcatggttcttagcctgcacagagaatgtcaggataggcagaaggtagaacacctcttacttccacaacccatgacttgagtggaatatatctgaaagaggactagggtgtcctcttatggccaggatgagtcgtgctgtgagcctctggccttcctaaacagcaggactgcactgcatatagtgatggagaaagatcacagtgcttcacttttaggattttccggtggttaagattttctggttgcatcagtcccagaattatttaactgttggtaaccatgggaactctgcgtgaaaaggtggtgatgaaagtccgtctgagaatgttcgggtccctggagtagtgaccatctcatctcctaggtcattcactagctctacaccaccaccaccatccagggcagcatacttaaattgcttaatctggagctgttaagaaattcaggagggacaaaaatgaggtggaatcctggtgctgttggaagacactgatggcaagctgagatcagtctagagaagagcctgagagttgcttgtggtagcgacagtggctctggtgtgcccagcaggcctctgggctgtgctgctgatggcctatctccccgtctttgctcttatggtttcatggtgcaaaagttacaggagttcttgggtggggagttgagtgacttgatctagtgaattgttttctgcttcaacatacctaaagagtctgacactttctatcagtattgacttcctgtgaccgtggcagctgcttggggcatatcaggacatttggcatggggtggggggtattgtaattggaaaatcatgccccagcacactctcagaatcactaatttggttgtcttagccttcctttgtgccttttcttcattagctagtgtcttgatctgttcctcatgtcttaagactatggcctgcagctccttcttttgtggtcctctactcaaggatctttgacttggtctaccctgggaaatgtatggttttgcctaggatcaaaggccacctgcttttgcctggtggcctgacctggatttgagtcccctacagccttcttcccttcttggcttttgagctcttatcctcttggtttgaaatttgccctccctttatctccatccaggccaaagtagagaaaaaaacagaggcagctgctacaacccgaaagcctgaatctaatgcagtcactaaaacagccggcccaattgcaagtgcacagaaacaacctgcggggaaagtgagttttatttagacccacctctgcaaggtgaagatggtaaaatacttcttccagcctgagccacatgccctctcttgcactttttccctttccctaactagtttctacttcttctcccctatattcccttctctgtgcttgatgactcggccatcagaaaattttttgtattaaccttgaaagttaatagagttgggagcccattagccctttggagaatacatatgtgtataatttttggctggataaaatggatccaaagactttcattcatttccttcacactgaccttgatgtgaaacctacctggtatggatgcaaatacagtgcacccacattcgttatcaagaagacatggcaggggtaatttccaccacctggaaccctggagcccctgtgctttaccttgaagtagaagatccctctcataacgctgctgggtatggagataacttcatttgtcctggttccccgggtcacctcttaactgaaagttaggatgctcattcccaatggaaacccacttagtataggtatgcagcatcaactggagggcagaggtaagctgaaaccacaggttctttccccttgcctctgtaaacctggaaaccaggcccctcctgagtgcttgcaacacctaccttccttagctgtagcaggtaggtgtgcctctgccagagaagcccgcactccagcccttagggaccagcatgggaagtctcagcctagggcattcctacagtgaagaaagctgcaccgtggcttctgggtgactactagaggtcctaggttcagaccaaggctcattaagtagtttgctaaccacttggttaccatcaaagttgtgaaaaaggctagaaatgagtaggtacaatgaggtatatgggttggagtttctcaggatttctgtactctgtggagaactcttcagcctgggacctgcatcatttgcaaagaaaggaagttggcaactattccttcttgagaaggtcctaggattctttgttccagactcttagagccagggccttggtgtttctcagttccaggggaagccattcccgtactatacagtgtggttgtgcccccaggattgggcgtccttgctgccctgcttagagcctgttctttccgcatgggcatctcacagggcagaggattaggcatatggaggattcaagaaggtattttacccttgagtcaaaaatactatgccttctcgagccctgagacaaatgggctaagtgtggaggctgtagccgctcccctggtgttggagattctgtatccatttgtatgcacatctgagcactggcccctccttcctgttagtatcatccgtgcccttgttgccagctgcccagtgcttctcagagcagcctttgcttctgagagtgggtctggctgcagccattccagggcccagatttaagggaagcaccctctttgggtgagaacaggtccacatgataagacttgcagagaagagccaaggacactgtgcccagctcttgaggagggagcagagcaaggaggtagggctgtgcctggttgggcatcaggttaggctgctgcctgggccttgtgaaccacaaccccgcccccaaaggagcggtgatgaccaacatgcagtgcctgcgcagctctgctcctgtcgttgtgttgtctgttcacgtttttcactccccttcttgctctttcacatttcttttcctgtgcttttccacatctgttctgtagaaggtgggggtggaggtttaacaacactttttgttggtcattgtgatcacgtgtggactcactgccttccctgtgtcggttctaaccagtcctctccctttgtgttgttttttctattttctaacactccaggtccagatagtctccaaaaaagtgagctacagccatattcagtccaagtgtggttccaaggacaatattaagcatgtccctggaggtggtaatgtaagtataagctctggttagctggcatctgagatatagcccactgtggggtatactagggagagagccaggtgcccatgtagatagaatcccagtgacctgagctgtagcgttctgtaagaagcagactagcaaagtgaggggaccttgatgctcccatgttagacagggtgtttctggtgagcccctaaacaccagcatggtgatatccactcagtatctttttacccatatgggtgggaggctttggatttttctccagctatgtcagagcctgggtctgagcacagtggtcagcagcagacctgttgcctgtctggagtccgttcctgggatgtgtatgtcggtctgcatgcccttgaattaccgtggaagtaacttctctgagacagatgtctggatggatctttccagagctcatctttgaatccttgttattataaaataagaattaatcaacattttcttcctatcccttccccacgtttttttgagatgaagtctcactttgttgcccaagctagagtgcagtggtgtgatctcagctcactgcaaccaccacctcccaggttcaagctattctcctgcctcagcctcccgagtagccgggactgcaggtactcgccaccatgcccggctaatttttgtatttttagtagagacgggatttcactatgttggccaggctggtcttgaactcctgacctcatgatccacccactttggcctgccaaagtgctgggattacaggcatgaaacactgcgcccggccctcccatttccctttctgctctccttttttttgtccattttctaatcccttcctcctttttcttcccctccttttttagtcccttttcctgtttttttgtttgtttgtttgtttgtttgtttgttttgtttttgttttgatacagagttcactctgttgcccaggctggcgtgcagtggtgtgatctcagctcactgcaacctccacctaccagggtcagtcaattctcctgcctcagcctcccgagtagctggggctacaggcatgcgccaccacgcccagctaatttttgtatttttagtagagacggggtttcatcatgctggccaggctggccttgaactcctgaccttgtgatctgcccgccttggcctcccaaagtgctgggattacaggtgtgagccactgcgcccagactttccctccttatctttttgtcctctttcctcttccacccaaacatccttctttttgtcttgctgccattgtgtgccagctctatgatgtgtattagggacacaggtgatcccagctcacagggaggttctggtctagggagagacagggcgaagtcttactatcgtcgagtgtgtgaagaacaccctgtgtgctttccgcttgtcactgtgacagtgcctagaaaagtggtactctgtggagttgtgccagaggcaccagaagccgccatgtacagcccctgccctcaccgctcccttccaggccaagtgagacagcctgtcttgcctccgtttcttttgagttcattcggttctttctccttactgtcctgaaccggactaggtcctgctccacttacccttatcatttttagactctgttaacactcctgcctcctccttggtgatcatgacatcctgcccatggcctacagatacccccagcagttgtatcatgaggaatgcggccatgagctttcattcttgccccacacaactccttcctgcccctccttcctggtcatcttctcaccactgcctcttcctggcctgggtagaaatggcatcctttacactcgggtggaattgcttgaccagactaattagtcagcctggaataggatcagctgaagtgaggtgacaaagatccagcccacgaggggcccaggcagctgctgagcctggctttgtcctggatgaaaacagaaggtgaacaggggttctgagggaactgggtcacttgtgtaggtgagacatagagatatatttgtgtgtgttgtgtggtgcatataagagctctgaaaatagtcatcattaatgtatcacctgctgtgatctttccacactgcctacacatgacctcacatgtgtagggttttttgttttgttttgttgttttgagggtgaatgtatttttaaagccttttcactttaggaggcttccttaaacagagaattagggagactactgtgagccatctttcctggtgggaagatgaggataaacaacagctgaccacagctggacccaggtgctttgtttccttccataatctctgtcagtccctccctaaagccaccacaaggaaatgtgcagtttaaaatgatgagccccccagctgggcaccatagtaagacccccgtctctacaaaaaaaagtcttgctctgtcgcccagcctggagtgcagtggcgtaatctcggctcactgcaacctctgcctcccaggttcaagcgattctccttcgtcagcttcccgagtagctgggattacaggcacctgccaccatgcctagctaatttttgtattttatgttatgttatgttattattttatttttgagacggagtctcgatctgtcaccaaggctggagtgcagtggtgcgatctcggctcactgcaagctccgcctcccggattgatgctattctcctgcttcagcctcccgagtagctgggactacaggcgcccgccacaatgcccagctaattttttatattttttagtagagacggggtttcaccatgttagccagaatggtctccatctcctgacctcatgatccgcccgcctcggcctcccaaagtgctgggattacaggcatgagccaccgcacctgggctaatttttgtacttttagtagagacggggttttgctatattgggcaggctggtctcgaactcctgacctcaggtgatccacccaccttggcctcccaaagtgctgggattatagcaagagctactgcgcccagtcccaaaaaaaatatcttttaaaataaggccaggtacagtggccctgggaggcccaggcaggaggattgcttcgaaaccagcctgggtttcaaagcaattttaaattagacatgtgcctggcagcattaggtggcatgtgcctgtggttccagcttctcaggaggctgagaggggaggattccttgagcctgggtagttgagactgcaatgagccgtgatggcaccaccacacttcagcctgggtgacagagagagacactgaaaaaaaagggaggaggacctgctgtgcagacagaacagcattacaccccccaccactccccacacacacacacacacacccacacccacacacacacacacagaaataacgcagttaccacagggatgagaggctccaaacaggatcctagttagtgctccaaaaatgcccccgacagacagacagacataccccttgatgagagccaggaggacaccagcggaggggagggaggggagtgatgagccagtgccaatgtagtggcttcttctgtggctggtcccagttaagattttgtgtccgttttggttccatttcacccttgcaaggggctgtgcatgtgtagtgggcactgagacctgctgacagcatgttttggtacctggagtgtgcctgcaggctctcatagagtggcaggcagcctgtgtaagcacaagcagagcaaggtgtgtgatgccgtgattgctcctaggaccacagagagccagcgtggcttctgcagtccccgaggaggggacacttgggccagcccatgaaggaggcgccgcacatggttccctgaggctggagcatagagtggaggcagggtggtgtgggggaatcgtttggaagcagattgtagactcctccacatagccacctaaggagggagagctgtagcctagaggtggtggactttattaaagtgagtgaggctcagttaagctttttaaaactttttactgggctgggcacagcggctcatgcctgtaatcccagcactgtgggaagccaaggcaggcagatcacctgaggtcgggagttcaagaccagcctgaccaacatggagaaaccccgtctctattaaaagtacaaaattagccaggcctagtggtgcatgcctataatcccagctactctggaggctgaagcaagagaatcgcttgatcctgggaggcggaggttatggtgagccgagattgtgccattgcactccagcctgggcaacaagagcgaaactccgtctcaaaaaacaaaaaccaaaaaaaaaaaaaacaactttttattgtgggaattttcaaacacagacaagtagaaaaaaacagtaaaatgaacctgatgtaccttttaccctgcctcatttactatctacatgagcagtcttggtttatctgtatatgcctatcccaagtattttgaagccagtcctagatatattatttatttgttaatacttcagcatatagctgggcgcggtggctcacacctgtaatcccagcaatttgggaggctgaggcaggcggatcatgaggtcaggagatcgagaccatcctggccaacacggtgaaaccccatctctactaaaaatacaaaaaatcagctgggcgtggtggcacgtgcctgtagtaccagctactcaggaggctgacgcaggagaatcccttgaacccgggaggcagaggttgcagtgaggcaagatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccgccacgcccggctaattttttgtatttttagcaggacaggggtttcaccgtgttagccaggatggtctcgatctcctgaccttgtgatccacccacctcggcctcccaaagtgctaggattacaggtgtgagccagcagctttttttgttttgttttgttttgtttttgagacaaagtctcactctgtggcccaggctggagtgcagtggcgtgattttggctcactgcaacctccgccttctgggctcaatcaattctcctgcctcagcctcctgagtagccaggattacaggcgtgcaccaccatgccctgctaacttttgggttcttgttcttgttgttgttgttgttgttgttgttttaaagacagagtcttggctgggcgtggtggctcacacctgtaatcccaacactttgggaggctgaggcaggtgggtcacaaggtcaggagttctagaccatcctggccaacacagtgaaaccccggctctactaaaaatacaaaaatcagctgggcgtggtggtgcgtgcctataatcccagctacttggaaagctgaggcaggagaatcgcttgaaccaggcagtcggaggttgcagtgagttgaaatcatgccattggactccagcctggcgacaaagtgagatttggtctcaaaaaaaaaaaaaaaaaagacggagtctcgttttgtcacccagggtggagtgcaatggcacgatctcggctcattgcagcctctgcctcctgggttcaagaattctgtctcagcctcccgagtaactgggactacagtgcccaccaccacacccagctaatttttgtattttttgtagagatggggttttaccatattggtcaggctggtcttgaactcctgacctcaggtgatccacccacctcagcctcccaaagtgctgggattacaggcatgagccactgcgcccagcctaacttttgtattttttagtagagacagggtctcactgtgttggccaggctgttctcgaactcctgacctcaaatgatccacccgcgtcagccctcccaaagtgctgggattacaggtgtgagccactgtgcctggctcattcttttttttactggtaatttccttgatgggtaagctcagtggtttgtcctagaatctggattcttctaattacatcctcatggttttaattaacatattctgttgtccctcaattttctttaaatttatttggttttggttttttccccacatgctagcatgacatgtaagtaggtaatgaggtttattctgtgagaaattacattcatgtctcattcttcggttgtctctttttttgtgatgttggcaattcctggacctgtgggttcagtaggcatatgccgtggtaagactaattctagcattacttcttcatttaccagctggaatacatccataatgtgaaactgactgcccctcaactattctttaattgcatactagacaaaaggtcaagagatagaggcttcaaatatggaacactgtctagaaatctgtggccctggccgatgcagtggctcacacttgtaatccaagcactttgggaggccaaggcaagtgggttgcttcagcccagaaattcgagaccagcctgggccacttggcgaaaccccttctctacaaaaaaatgcaaaaattagctgggcatggtggtgtgcgcctgtagtctcagccacttgaggggcttgagcctgggaggttgaggctacagtgagctaaggtcatgcctctgcacttcatcctgggtggcagagtgagaccctgtctcaaaagaaaacaagaaagaaatctgtggctctacatcttggtgagggccctgggcttggagagtgactgttaacttcttgcaggtgctgttgtggttacagctaagatgagcttgtcaccattgcttgaagacccatgttgggttggtttaagcagctaccagatctttggctggtaaaagtacccttccctatgccctctcttatgggggataaggatagggagatgtttggatgaggtcttcatgtctccctcttcttgaattggccatttcttcccctaacaaataacaagataccttgttttaaacccagataaagcacttacagtggtgtcatcagcacatacttaggaggaggtatctgtgctgtatcctaaacttccattttggagatgcctataaatatctgtataatgaactatagattgaggagaaaagaaaaaaatttctatctagggaaaattgcagactttttggaaagatgagacaaagtagaggctgtgtgttttcacagtagtaactactctgtatgtaattatcaaacacgtgaagccattatggtatagttcctggtggtgtcccttcaagagatgatatgagaaagagacggattgaagcgagagctatgtgaggccgtatggaaggcaccttttgagctgggcattgaaggatggggaagaaaacataatgggtttgctgggttaggcatgagccaagttttagaggaaagattgagaatggctctggcaagctggggattgtgggtagttattctgtgccaggccttgggctgtgggtgcaaatacaaaaatactggtggcattatatctgtcctctggaaacatggtgaagactatatttcctgacaccaaagaagggaaaacagggctcaagaaggtagctcaccatttaacagcttgtggtgaaacccaccagaatggtgcaacactgcatggagttgatgtgttggaaagtcaggctctcccacagtacctaccagaggacagcggggccgctcacaggaatgctggaatccccatccagcaacccagagggcatgcatggctatagacttaaagatgcaccaccttttttttttgaggcggagtctctttctgttgcccaggctggagtgcagtggcacgatctcggctcactgcaagctctgcctcccgagttcatgccattctcctgcctcagcctcccgagtactgggactacaggcacctgccaccacgcccggctaattttttttgtatttttagtagagacggggtttcaccatgttagccaggatggtctcgatctcctgacctcgtgatccgcccgccttagcctcccaaagtgctgggattacaggcgtgagccaccgtgcccagccaaggtgcaccacctttaaatgcaaatttttgcatttttagtagagatagagtttcactgtgctggccaggctggtctcaaactcctagccacaggtgatctgcctgcctcagcctcccaaagtgctgggattacaggcatgacccactgcacctggctgggaaaattgttataacatggattaagcaggaatactatgattacacacacacacacacacacacaacgcgcacacacacacacacacacacacacacacaccaccccctcacctctcccaaggggaaaatgcattgaaaaggactagaagtaaatatgttattccaggttctctgggcaaggagttgataggtaaggatttgagatggaataaaggggatatttcatgggagccttggtgctggtgtttggacctggtgaaatgacagaagagctgtctggagcatgcatggacagggtctgcacagaaagacctgtggggtgtggaaatggtggtttggtctggctggaggtggggttagaagtgaaggctggtggccgggcgtggtggctcacacctgtaattccagcactttgggatcctgaggcaggcggatcacctgaggtcaggagttcgagaccagcctgaccaatatggagaaaccctgtctctactaaaaatacaaaattagctgggcgtggtggcgcatgcctgtaatcctagctactccagaggctgaggcagaagaatcacttgaacccgggagatggaggctggggtgagccaagatcgtgccagcctgggcaacaagagtgaaactctgtcttaaaaaaaaaaaaaaaaaaaagtgaaggccaggcgtggtggctcacgcctgtaatcccaacactctgggctctggaaatctgaggtgggtggatctcctgaggtcaggagttcgagaccagcctggccaacatggtgaaaccttgtctctactaaaaatacaaaaaattagccagatgtggtggtacacgcctgtaatcccagctactcgggaggctgaggcaggagaattgcttgaccccaggaggcggaggttatagcgagctgagatcgtaccactgtactccagcctgggcaacagagcgagactccatctttaaaaaaaaaaaaggaagtgaagagcagggccagggtgggtcgagggctcttttaagtacttagggagatgaccttgtctttgaccagactgagatagcagcttacagagggagcgagaaaccctgaacatggagaagatttaaaaggtagcatggggttggctctgacagtataccttctctctgaatgagtcttttgtgtccttctcttcaggttcagattcagaacaagaaagtggacatctctaaggtctcctccaagtgtgggtctaaggctaacatcaagcacaagcctggtgagtggtgcctcccttgcccactgggtctccagggtatgtcgtcctgccatgggtcagctgggcagccagctggctggcaagggtttcatctctgtgcctttagcatcccatgaagactacccaggacaccacagtcctcattctgtcagggagcaggagttcgggtgctaacctctaagtggaggaggagcagtttcttacagcagccatctgcacaggcattctcttgagtacctactgtgtgtgtggaactattgagctaggcctggggaagtggtgcactctgagctgagaacctggattggctctaaacgaggattacagaagctactgctgaaggagctgtatagagggcagtgttcaggtcccacctatcagatgcaggagcaaagggtgctcccaaccagtgaagcatcagccgctagccctggcaggagaatgggaggcgttcagcaacttgcactaatgcagtttccttccagcaacatggttggcccagcgcccctgtggaagtcgctgtgcggaggctgggctcttgccttgggtagtcccctagcagcctcgtgtcctagttcctgggtctacagcagatttgtgagtaggactgctgtagcagcaggcacactggctggcagacctggtatcccagaaggctagccaccacaggccagataaggtgaaggcaaaactctcttccctcagggcgggcgcggtgtctcatgcctgtaatcccagcactttgggaggccaaagcgggcggatcacttgaggtcaggagtttgagaacagcctggccaacatggtgaaaccctgtctctactaaaaatacaaaaactagctaggtgtggtggtgcatgcctttggagaattgcttgaacccaggaggcagagactacagtgaggcgagagtatggcactgcactccagcctgagcaacagagcgaaattctgtctccaaaaagaaaaaaaaaaaactccctttccctctcagcgaagagcatgatccagtttagaatgtgttctatttagaaagatcaaaacagttctgtccttaactaaccatttttttccccttttatctgggaaatctcctatcagatacttccttctctaatgacactgagtcacttagggtctagtttttgccagggctgggtttcccaatatgggacaccgggagacctcggccagaagctgtgcgtggaggtctgccatgtgagctgagaggagatggaagaacaggagaaggggcccaagggaaaccacgctgctgggcgcgggaggggctgggtactcattgagggcagctcgtcccgcacccttccccttggtctcatgggcacactctggccagtgagctctgaaccctgggcgtgagttcagaccactttccctccccgtcctagcctgaggtcactagatcccaggcctgccttggtccatgtctttccttcctcagcgcacagcctcggggccactctgtcctttttattattccttctttttgctagagtgtggtacggtttagggtctcagacaattttcacaacctgtcactgtcaatcagcagattggtggtaactctgggtgagtcccttctcttttgcagcatcagttttaccggctgggaagcagggaccgtggccgtgatgacagggcattcatgagaattcagtgaggctgtgcctgagaagcactgcatggcccagttagcgggagggcattcccacacagagtagagaagcagaggcttcgccctggaggctgtgctcggagccccaggcctgcccaagcctggcctgcagctcagtggctgtggcatggggtggtggaagggatggctttccttttcttggaggtattcccactggctggacggagagattgtctcagcctcactgtgatatgagaagtcctctttagacaaacgtgttcactgttcttcatttgccacccagaacaggtcacgtctgtctcatttctagattgggcatatcgctagtcctggttttgcctgcagggatattcctctgccaccctaggtgaccagttcctttgtggttccaggtggaggagatgtcaagattgaaagtcagaagttgaacttcaaggagaaggcccaggccaaggtgggatccctcgataatgtgggccacctacctgcaggaggtgctgtgaaggtagcgagtgggtcactggggagacacagctggggaggggtgggaactatgcagttagggtcagggtcctcacaggtaggcacctgtcaccgcccctcagtctcttcaggagtcatgtcttcacccacaccattgccgttttcccaccgtgtatcatcagtcctgactgaggcagaagtgaagaggccccagcccagccacccctcacctgtcagctggaggcagaaccttgctcctgagagccatggccttcctaattgagcccatccagccatttgagaaggccacggactgggacacagaccacccccaggcgagcgggggttctgcaccacacagttctccccagctgtctcgcgccaaggggaatgtgggttcccgccccatgtcaggctccgctcctgggttaggagcaggacagcacattcttagctgccagcgacagcaggctgcctggggcctccctctgcagggcctgcctggggcctccctctgcagggctctgggacagagctcaagtggcagaggttcccatcctcacgactggctgggcctcttctcccttccctctctcctctttcctcccttcctccttccacagtactgtgagaccttttgtgtgccaagatgctgtctgtcctatgttccatgtcatccgtgggtggggggcccatgaggggcatcttgcagaccccgagcacaaggatggctgctgctgctcgggttcaggtgcgcaggggagaggggccaggagccgctgccctgggccttcccttccatctctgctccccagtgccagccactgcccagcccgtcccctgtcccatcctctcctgatgctctgactgaagccttgatcagcttccaggaacatctgggggggtccttgctgccacaggctctcagttcgtgccccccatacctcgtgaggatgccgttctcacgcccgtctcagtggggcgttaacttggctttagtctcttttccaaggacacagcgagcgagcgtggaccaggattcacatctgggcttttctgaccctaagccttgtgttcttttccttgttcacattatatccctttattagttctggaattattgtttttaatcgaggcctatttctcactatgccgattagaaaccacttctcccttgtcactttttgggtatttggcgacacacgctttccagctccccagtggcctctcgcagctgttctctcttctctgccttcctcacactgagtgttccatgtcccccaaatgtcctcctcctatgacgccctccaggcctccacagtgtccctgggttatacctccttggacacctttctgcctcccatggacccctggtcccagaatggtgccccgcacagacaaggcctcagcacctgtgttcctgaccagacagatgtgcaggcagggctgcccgggagctactgaggaccccactctgtgtgcagggggtggcctgggttcagggagggtttgggagggtgggctgtacccttcagggggctacccttcaggcttattgcttactgttgtcatggctacgtctttggtaccagcctgaggcctggcacctctgccctcagagaggcttcatcagagcctcacatgccacagaggggctctgagagtgtgtcactggtccagctgctcctgaccctcgggagtcggtctcccaggtgaggtggggtgggtggggccggggcacctgcctgggattctccaagcgactgtgccttgagccagtgggtgccagggcagcaagggtgggggctgtgtgtgaaacccaccaccatcaccccatcccactccccccctcgactgaccctgcactgtctcccccactgtttcattgtagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagtaagtggctgggctcggcctaagggccagccaggggccctgccactggccgcaaattgaaactcctttgtttttgactagagtgtggcctaaattttaatgaagtaaccttttattttccaggcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgggtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaagaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatcacgcaggcttcgtgcttctgtgtctcgttttgcatctaccacctccctggatcttcctgccctcagctcagcccctcagctgtgaacttgtggatgtggacacgggaaggaccactgtgccacatagccctgcgccttggctacctgtggaactctcccctagtctgcctgataaagggctacttgacacttacttgcttacttactgtccaaaactacaaggacagtgacagttctgacaggcttcctgtggtgggtaccgagagcagcagctgtgccaggggactggggtggttaacagcaccgctgcttcatgctctttcttggtgaagggaggaggttccaacccccttctctcttaaaagacttggggccacagccagcccgttccccagcaataagcatctcactctcttctctacctaccttcctccttcctctggggaaccgtggcccagtgtatggaggccctgagagaggagcccctagtggacagcagtggtcacaagggataaatagaactttattttaaataaacatttgcactctgtacacagccccagcagaagcagggctcagtcgtcagctgtcttgcgcacatcaaagctgccacagggtcctcgcagcagctctgccagtagcgcaagcagctgcccgtgctcctcctgtacgctggggggaagtgcagccagctcgctgcgcaggctccgctccaccatgcggcccagggcccgccgcagctccttcagcagccgcacggtacgcgagtcaccctccagccgcagcaggtcactgtcgctcagtgagatggtggcccggcgcccgt

SEQ ID NO: 17020 - DNA, 246230 bp, Human; identical to SEQ ID NO: 17019
  misc_feature (1)...(246230): n = A,T,C or G

SEQ ID NO: 17021 - DNA, 246230 bp, Human; identical to SEQ ID NO: 17019
  misc_feature (1)...(246230): n = A,T,C or G

SEQ ID NO: 17022 - DNA, 246230 bp, Human; identical to SEQ ID NO: 17019
  misc_feature (1)...(246230): n = A,T,C or G

SEQ ID NO: 17023 - DNA, 16605 bp, Human
tgaggcactaaatttaaaattgtattaatttaaatccaaatagccatgtgtctagcaaataatttaggagactgttggtatagctcaggtgatagaattaggacagaagggtgagttgatggatagttaagaggcaaaattatgagtctgtaagggtgtgagaaaaggaaatcaagaacaggctcccagattacagactttgtggttaaacagccaccattactcaggacaacagaagagaaagagcaggtctagagtgtatagtgatttcatcaattttgaacatactggtgtctgagagttatcccagtgggaatatttagtagaaagtttagcttagagagctgtctgaactaaagattcagacttcagaggctttgagccatggagtcagattacctagagaagttgaacaaaattagaagcaaacaagaatcacagcaaatatcaacacataaaaaggggctaaggaagaaaaatctactgagactggagaggaacagttacacaaataggaaaagaaacaagtgagagtggtatagaagtcaagggtagagagaatgtcaggaaggaaacatgatcaaatgtcgaatgcctcagaggtcaaataaagtgagaactgtaaagtgcttcctgactttgccagttaggaggttcttggtgacatctgccagaaaagttttggtggtagcagcctgacagaggtagcttgaagagtggggatggggaaagagaatgtgacaaagaattgagatagtaaggataatttcaatttcaggtcttggctgtgcaaggaagccgagagacatgagtctctaagagggcacgatattgagagggttgttatctttctgtcagcggggaaaccaagagaaaagtttaaaaaggtcaaaagggggagaagggaagacagcttccgggtaacagagaaggttgaccaggtcaatagtaaaggatttcctcaaaccgaagggaggacctctagtgaaatgagaaaggaatacacaattgacccagtttgcaggtgggaaatgggaagccagttctgcaaattggcctttctgttctgtgaagtgccatctgtcggtgaggagagattagggtctgcagcgtgaaaatctggaccatactctgggtaatcaagggagaggttatcggctaatgacaaattaaaggcttactttttagctggcaactgaatcaccataacattttatgttaccagttccaaaattttggggggaattcactcaagcttgggagaggagagatcataactttaagagtataagaggtttaaacggtccactacgaaataaatagagaaggaaaagttatcagctggtaaatatcgtagaaggtagagcggtccagggactcacaggtctcactaaagaaaagtctagcgtaggttcacggcacggagagattttaaggctgcctaagactaaagccaaatacgaagtccacatctgcggtccgcaccttatctctccgcgcggcaggcgcgacgagggcgagaaactccctctccagtggtcgcaccacacgacaccagggaaggggcccctctctccagaccctcatatctccaggtccaggccccattttcctccgctgacagctcagcagcgtgcgcttccgctggattcaggccaggaccagcgaagccgcaccttacacccaccgaggaggaaacaagcctggccacccgaggctaccccgctaggccgcgggtagtgggggagggggcgctgaggcaggaggtcagcacccgggcgcgggctcccgccccacgaaaagcgcgcgctccaagccccgccgccggagatgcggttccggtccggacgcctgcgcactacggctctccccgcagcctctggccctccttccccctcccccagtcagggcgcacccttgcgcctgcgctgtgtgtgttcctggtctgcggcagccatgctgaactcgtatggagaggcgagtgggggggacagagtccaggactgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtacgcgcgcggccccgatgctctccccacccccccagcccgttcgggaagggaggggctgggggctacgccccatcccccagcacggcttcgttttctgggggggggttgacaccccggattacataccccgtaccaagccgagggcaactttggaggccccctggaaggctttaggatccaggtgagaaggggcccttgtggggcggagatgtcagtcaagtgcttaaccaatggtggggagtccgggaggggattcttggggttcaggaaagaatcctgagagtgggaagatttgtccttcaaaccttttacagccaatgggagcgtggagggggggcgagcgggagagggccatggggggggaggggaatggccagcctcatgcctccgtacccattggagggcaaaggggttagggggcggtgtggccccccctattccattcgtcccctgggggtacagcagccgggagccaggtgagaagggatccatcggcggccgagggaggggtgacctggcggtgggctgaggagtggtggctgtggcccctacccgtggatgtgaatgctttaggagttggccacccatgttgtgaactgaggttgttcccaggcgccaacttcctttctccccagagcctctggagggagcattgctgtgcgccctttgtgtccgcggtaggggagctccagtcgtcacaccgcaggctggaggttacgcttcgagtcgcttaccgaatttgtgtgcattcacgtggacacggcctgtggggccttttgcccctgtagggtctttactgagcacgtgtctactccaggctggggtgcttacaagctgaaagcttgaggtctgcttaggaacagaaaccaggcccaaggtgggtgctggcagtagggggtctagacagcatggtctgagatgcgagggaggctcgggacctggaatgatttcacagctcccaaggtttcgggtttctccagggtggcctcttccatcgcctccctcatcccctcccccagtcctgaacagttctctccttgtgtactgcgggggagggaacggaaaggaggaaagagttactttcccaaattactgagtagcagtagcctccctggtgactcatgtgggggaagggaggatagaggatcgggaggcagtgattttccggaatgcagggaataaacgagagcaatgtctggctgcccttttcctaaggcctagtattttctcagcctcctaagtttttattccatggccggccccctgatgggcctctgtcctggcctgcagagccccggtggagaaaagcagatttgggaggttgggccgctagggggaggggaaaaggcctctgcaaagttgctgtgtcattgccctccatgctgcagccacccaaacggggccgcttgtacttttgggggccagggcctgatccctggctgggggaaggggactctgctctcctgacgctcattttcccccgccctcccggggtttgccctactcggggggtcagaagacaggagattggcggccattttagacgcagtaaccgaggttggagttgaagggctactgcagaggagggagggtggcgtggttgcagctcaaggacctaggcccttacgagcccttcccgggcgagggggaatcttaccgtatatttgttcacctacgttgattatttttcccagatacgtacacaagtttgttttctccctggtagcgaagaaaggggaaacgggggaggggacgccccaccaaagcccaggttttctcgggtgggggagatcctttcactctcttgtaagggggcggggacggccccagagatgctctggagatcctgactctgggctctggttgattcacagagtctgcacccttatttagataaccaagttaggaggaagacttaagagtaagttggggggagggggcgaaactgagctcccaaaatggctcctgcccctcctcggaggcggacggccggggggaggggaggaggggaggagggggagggctagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagaggtgaggtgtgttgcattgtatagggtagatggatgcgtttggagattttaatcccacttttagggttgccgaggatttttcgaacgagcagaaatgtattggtaactgtaggtgtgagtggggagggattagaaaggtgcttggacgtgcaaatttgggagacgtattttagcttttgtggtctttgggactaaacagtagtaaataatgttttgctcgtctttccatcgtttggcttgagggagggagtggagtattataagactctggcaacactgttttagactgtggggcatgggaacgttagatcccctcatcgccgttctgaagcccgtagctgttcgccatagaggagcaggccgcggcttctaagatggcgtctttttcctcgtttcagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagtacgtttccgcgagccgcgtgtgggaaggggatgttgcagggcggcggcacaggggtgtggggcgccgtgttgggagtactgagcggccccggcgcgctgctgttgcggcgcagctgtcgactcggtcgcgcggagggaattgagcgacggttttggaacggtggtggcggctcggctactgctcgtggaggggaatacaggttgtcaatttatacgctattaatgccgccgtggcccagtcttaaccgagtcaggcagagctagtttgacggtggagtggagtgaggttgaacagcaggtttggcgtttggtgggtctggtatctagcggcggtctgttagccttttaggggggattcacggacacctctagcgccctgtagggttgccatggtgacggagcgcttaagggactggcaacggggattcccagagaagggtaaagggatcactctcccgtgtgtgcaggttcctaatgcccagggcatgtcattaaatcttttgctttctttgggtgggtgggttgtgtgtggtgtttgttggtgcagggattgttttttcctaacattaaaagtttgattcagggcaggagggtagagctaaggttcctagttcagctctgcgatgtaaacaatgagattcccatatgatgttttaattcttaggtggtaggaaagactgatcggaggagcaccagagggactgtaaatgaaccactgttagcgtttggtgtccggagttggtgctacagggggaactggtagtggaatcgtgttgtgtagtgggtgggtggaagggggctatcacttggtgaccttgactgttttgtacggctttttgacttccttggagtgaggagactctgatttggtgcgaataattttgagggcctggaagttacgggctgtgaagtctgacaaattcttccttgtctgaatttgtttttaagttgatatggttcttcctctgggtttctagtctatgttctgttgtggcgtgaactacccagaccttgtggaagatggtgctctctcttctatctaggtggattattctgtgtcttatcagcattttatggaattttttatagccataatttgttcttttcctccttaccggcgctcaaccaccatggcaaccaccaaacccctagtgaggaggaagcttggggtttgagtttcttaactccacccattttgcttaagccccatccccatagggctgtagttctgagatgtcgtgccttgtcagaaacaatttgggagttttttaaaatatgaaaaagaacagatagagcctatcagacttaagaaggtgggatctagatagtatactaaaaatattaataaaaggaaggcggggccagcaataaaagctccacagattgtttggatattgtttctgcttaagaagcacttggcataagcttaaccacctcactagggccagcacctggattcatcagactattgtgcagatgcactttttcctcatttggacgatattgccctaattttgttcccatctttacaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggtgagtagagacattggagccggggaggtgtgggatgagcaagaatgcgtgtgaatgggggtggtctgcctagtgtagatgctgcggcccctagggagttcccatttctcccctgtagggcagttagctaccagatttctgggtatcttggtcctttgtgattgatccgaccgcttgctgtaactatcttggcatctttccttgtgccctccatgtgtccttccttaacttttgtgccctggctccattttacagattcccacctcgggttgggagaggaccacggtggccaaaattcttagcttcttcctttccctcatgcagcccatggatagccagccccagaggtaatgtcacaggatgggaagtttccagagtgggtgggaggtgggtggttagagaaaggcagcaggggcctccctgtggatgtcaagaatcttttttatttatttatttattttgtcccacagtttaattggggccgcagtttaagtaactgttcctttgatgcatagggggtgtgtgtgtgtgtgtgtgtgtgtgtgagagtcggggatcggtagtctccctataagcatttatttttctgtggttctgacctaacatttctttatttaggattatcacaaaattataaaacagcctatggacatgggtactattaagaggagacttgaaaacaattattattgggctgcttcagagtgtatgcaagattttaataccatgttcaccaactgttacatttacaacaaggtgagtttttctgtgtgttcatttagtaggtggggagaaacagtaacttctattattgctggatatgttgtctacataaagtttaaatcctttgctactgaaggtgttatccaggtagggtagtcggagtcttaaaaacctgactctagatggtactattgaacacagtgatgtgacttcagagctctagttgaaggttatttagaacacttcatacttgggggtggtggtcctgtttcttagaaatcaccagagacctgagtagaccagggatctgttttcttgtcagctctcaagttttttcttctttcgaattttgggagacagttaggagaaagtggaaattagtagtggcctggagtaggaaattttctttaagatttgatgacaagatgactggtgggggtatggtaatggcctagggcctgaatgcctctgagaaagatggtgtgtatctatcttctgttggcattttttaactttctttattgctgtctgtgttctcatagcccactgatgatattgtcctaatggcacaaacgctggaaaagatattcctacagaaggttgcatcaatgccacaagaagaacaagagctggtagtgaccatccctaagaacagccacaagaagggggccaagttggcaggtaggaagagtgggagttttgcaaatggacaactaaagatggggaagagaatcaaactacacttttttccttttttctagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaaggtatgatctgtggatttcctctgggcagcagggaggcaagggtcttaagtaaagtgggcttggagtgacaggttccctatcttgtttctttctgcagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaaggtacccactgcatggggcagatgggatgctcaggcagtgatgggagcctaggtgcaaaacaataagtctccttatgtgggcacacagcagtctttggttcttggcattttacttttataaaataatagtggaacagaaggtctggtgttttgagaatttgtatttcttggagtttgaaacagtagggtggggtttctttgtcttgagaaaaatactgtctataattaagtactaatgtggcagtgttgggttaaggaagttatagggtggaaagacaggcataggccacctctctgtcacttagaaatgatttctttttctagacataaatatttcttcaacccacccaaattcctttgacttcaaacttgaaccccagggcacagatccttaaggtcatccccactgtgctctcaagagagggctcttcttgtggtgtctggggttggcagggaaaggtgagtcttcctgcctgtgcagcttctgatgctgcctccttctgcagcggaagatggagaaccgtgattaccgggatgcacaggagtttgctgctgatgtacggcttatgttctccaactgctataagtacaatcccccagatcacgatgttgtggcaatggcacgaaagctacaggtgagtggaaaggttggagtttgaaaaataaatggtatggggagttattttgtcatgtgtgctgcatagcctcaacgtgagggtctcactgttctgtacagttgtaaattggagctatatcacttggtggctgggtatgtagggcactgtttatcagcatagttttgagtttgtgcctctttctaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacaggtattttgtcactcttgaaagtttttattgggtaagaggttcatgccctttgtcctcattttttcttcttgttattttatctttatttactttttccacttcatgttttttttcctttagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagtgagttagagtaggaagcagagactagtttggctatttctgtctctctgggggatgccatctctctttgcaaagataattctaaatggccagttaacagatacaataggctttgagcagtggtccccaacctttttggcaccagggaccagtttcgtggaagacagattttaccacagacagggtttgaggggatggtttttgggatgaaactgttccacctcagatcattgggccattggattcccataaggagcatgcagcctggatatgtaccatgcgcacttcacagtagggttcatgcttctatgagaatctaatgcttctgctgatgtgacaggcagtgatgcccacatgccggctgttcacctcctgcgtagcccagtaacaggccacggactggtactggtctgggggttgggacccctggctttgggagtcagggtgtttcacagctactctgacagtgaactcaaagtagccataaactagaaacatgaagatggctgtgttccaaaaagactttatttgcaaagacacgtggcgatcagatttgttctctgggccatatagtttgcctgttgctctaaatcaatgagtctagacttgtttttcatggcgtagtagtttttggttttttggtgtggttttgtgttttgtttttttttgttagtttttttttgttttgttttttttaaagactccaggctggagtgcagtggcgtgatctcggcttactgcaacctccacttctcgggttcaagcgattctcctgcctcagcctcccaagtagccaggattacaggcatgcgccaccacgcccagctaatttttgtatttttagtgcgcagctagtttatgtagttttagtggagacggggtttcgccatgttgggcaggctggtcttgaactcctgacctcaagtgatctgcccgccttggcctcccaaagtgctgggattacaaatctgagccactgcagctggcccatggtgtagtttggtagtgtttaagggagcagaaagacccatgtcagtatacctaaacaggtataccttgttttattgtgcttcactttacggagttttttttagatactacttttttttttagttgaagatttgtgacaaccctgtgtggagcaagtctttcaacagtttttccaacatgtttgtgtgtcacatttttagtaatattttttcattaaggtatgtacgtacattgtctttttaaagacatgttattgcctacttacagtcaagagcaaaatgctctgtttcactatacagtgtcccagtagcccacctcttacttggccattgaatggaaaaacagaagctccactctgggcaggaaataggatcactgaattataacagtgggaacatactggaagaggttaatgaagcttcttttgctgacaactctttttgcccttaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacagtacgtatgaaatgaggttcatctcatggttctgaggacagttgaggaaagatggtggggtctgtttgcattcaggattgtcagctcccaggataatgggatgtgttggttggcagctgacgttcaagaagggaacttgggaaccttaggggcccataataagatgcttggggcaatcttaatgtatcctgataaatttctttcattagccattaagaagcctgtgggaaagacaaaggaggaactggctttggagaaaaagcgggaattagaaaagcggttacaagatgtcagcggacagctcaattctactaaaaagccccccaagaaaggtgagtatatactttcatgccactacagattgactccatcctgccttcttgactgtcttttattgacaaatgaagattcagacttgaacgtctttaactttcgaatttgttctgcagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgagtccttagaagtaatctttaggtctacaatttgctcttgtttaaatgaaaaatagtactgtggctcattcatgctttaaccaagaactcaaaattttgaggtaggctttaggtttttccctgtggcactggatgtgtgaattttctcctgagcagacttaaaatatgagaaaagggtgggaggtagccgaacataagtactttatgcattgagtttattgccttttaaaaggaaattggcctgtaatcccagcactttgggaggccgaggcgggcagatcacgaggtcaggagatcgagaccatggtgaaaccctgtctactaaaaaaaaattagctgggcgaggtggcgggtacctgtagtcccagctactcgggaggctgaggcagcagaatggcgtgaactcgggaggcggggttcagtgagccgagatcgcgccactgcactccagcctgggtggtagacactccgtctcaaaaaaaaaagtaattgggcctactacattgttaaacattgttaaattttgctgccatggtcacacacaaatttacagatagtttattagtagaatactaaagagtattccaacgattaaatcacaaaactgtgctttctgcatacccccttgtcttgctaaggggagagaagggttgtataaaaagtttagggggttgggatgtgtgcattctggaatttggggctttaatactggaaaagtgagacatttgcttagtatagtgtaccatagtaggaaacctggatagagacgtggaaattagaatcaggaatgtagtaaagcaaatggtttattttgctgtaaatgacaccacaaactaagtgtagggcaacaccacaaactaaatgtaggaagcaataaattttactagtgatgctcagccctctttaggaattccggctaaactggggcttgagcaacaattttcaaaagctcgggagatggtaataaaaaattaggtttgtgaaccacctgctactgtttgccaagcacttagagggaaacaaacccttgtttgggctttcttgctaacttgtgtgcaccagtgaaagctcttgagctccctttgagctctggttcccttttgagaataacagatgttgaggattcgtaagtacttaatagagacgcgttgggcaataggtgatgagatacaaattaaagttctgaaaatcggagtaaatagatttaagctaagtgcatgtctatgtcaaggattacatctcatttcagagggaattgaaggatttagttggattagttttgggacaaaatatagaatattttgtctgactgcagccccttctgctcatgtacttttaaggtttgttttctgtagttcggaaaaataaaagtttcaacctgacattggaggcccctgagtacttaattccctgtaaatggaacccagaccgccctaaatgctttaagagagagaagggctggctgacacaggggcttcagacctgccttaaaccaattggactagtctcttaattgactttagtttgaacttatttcaagcctgtctcacttagggattgtaattgtttcaggagtttggttgagttccatcttggttgccaaaggactttattccaaaatagcagtctccagcacaactcaaaggactagtggagtcctgtgggcattatttccccctatgctcctctcagctcttggaatcatgggttctattgctgctgctttttccctctcccctcatgctgccatttactgcctt

SEQ ID NO: 17024 - DNA, 29393 bp, Human
ccaggcctttgctgatgccccatcactctggtcctcttctcccgaccagactgtgctccagatggcagggtccaggttagtctggaatcattggcatctagcccagtgctggctgggaccatgtgttactaagtgcaggctctgcagccagacagaccaagtttatcaccctggttcccctgctaccagtcatgcgacctcgggaaagtagtttactttaagcctcagtttccttatccaaaaatggagacagtaggactatgaaaggacataaattaggtaattcacatgaaagcacaaagatgacagctgccaaacggtaagtattctacaaaatgctggctataattagtggtagtgacaggcagctgatacactgctgtttaataaatgtttccgaggccgggtgcggtggctcatgcctgtaatcccaacactttgggaggccaaggcgggcagatcacgaggtcaggagatcgagaccattctggctaacatggtgaaaccctgtctctactaaaaatacaaaaaattagccgggcgtggtggcctgtagtctcagctactcgggtggctgaggcaggagaatgacgtgaacccagaaggcggagcttgcagtgagccgagatcccaccactgcactccagcctgggtgacagagcgagaatccgcctcaaaaataaataaataaataaacaaacgtttccatattcttagtgtctggggctaggtaaagtttgttcactcattaatattccaggtgccaaacctgtgagcaatgacactccagtagcaatgagcatttgtggcatccacatcttggtttctgaactgttgtctgctaaaaagtaaccaaggctccctgaagaaatgactgcagcagggagaagggatgactgaaacatcttgtatcagaaagcaagaaaatgctcaaagaagctggattagtgcccaaagaacataagaactgtcttgaaggggcttcactggccacatctgggggaaaaaaaatcgaccagaaagaataataattgattataaaagacaattttaaaaaatccaggaatccatagtgagtcttcgaaaaaaaagaaaaaaagagagggtataaaactgatatatatttatcatatatataatctatagttttatatatatatatataaatgctgctaaaatcactgagtgaaaggctgatagagaagaagatggtcccagagagtacctgttaattacaaatggaagaaggaaacattaaatggagaaatggggcagacaccacctttagcaagcgatcaagcttcacattaccaaaaacgggacaaactgacattatccaagtgtgttctgcaggaaaaaagaaaaattaacctttatctaattacaaggcaagagggaggggaggattagacaaatcaagaatatgggatattctattacacaactggtctggacccgtcaaaattatcaaggtgatgagaccccccctaaaaaaagaaggactgatctgaattaaaggagaccgaagagaaataactccaggcagtgagtgaatccagcaggggagggggtctaacaactgaaattgaaatataaactgtctattggctaatactgcattggctagtactgcatcgatattaaatctcttgggtatgaaaatggcactgatgtcatgaagaatggctttgttcttaggagatgcactgcagaagtatttatgataggaaatctctgaaaaggaacagacgttgagtcccagtctttcggcccaaggttcgcgcgtgcgcacagccccctttccgagacttatttcgcgcggtcggagaatcagattgtgcccacaaggcggaaatgtacgacagcgggttccggtgaccacgaaggcggcaaaggcgacggaatggaggaggtgcctcacggtaagctcgcggagggggcgtgggtcgcggggcgaaagtgtcgggagctgctctaactgtggtcttgtctctgcgcagactgtccaggggccgacagcgcccaggcgggcagaggggcttcatgtcagggatgccccaaccagcggctgtgcgcttctggagcgggggccactccggacacgggtgagaaaagggcaaggcctcaacaggaacttagaggcgcaggcccggaaaaggcggggcgtgggagggagggggcgggatctgcagaatgactgacagcggcaggctagaaggtattgtattcggagaggggtggggcccagaaggggcggggcgtggaaagtgggcagggtgagggcggagcttggaatgactgacaggaacgaggcctttagaaggcgagcgcgaaggacctggcgcggatggagggtggagactgaccggcgcggagtcgaaagggacattaattaagagggtcggggccagaggtttgagtgacaataacagaccgcagagaaaaacgggataagcttcgaagtcggggagtcttcggacttacatcctggctctgccagctactttcttgacacaattttcttccttttgaggagtgattctcccactcattcagcagaaatgtgttgatcgcctcgtaggtttggtgctgtcctggggacacagctggggatcaggcgtggtcactgctctagtggagtttagctttactggggaaacaaacacgtgagctagcaactaaaccaccgcagctttaagtgctgtgaagcacagattccaggatgagaggacccagggagcctgctcagaaggaccttaaaaagcaggaggcaggaggacaatatttttttttcttttttttccccctttttttttagacagagtcttgctgtgtagcccagaccagagtgcagtggtgtgatctcggctcactgcaactttcacctctcaggttcaagcgattctcgtgcctcagtctcccgagtacctgggactacaggcgcctgccaccacggctggctaatttttatatttttagtagaaccagagtttcaccatgttgaccaggttggtctcgaactcctgacctcaagtgatgcatctgcctgggcctcccaaagtgctgggattacaggcatgagccactgcacctggccaagggggagaatcttgaaggatttcagagatagactcggatttgattcttggatccatgcggtgtgaccttcagcaatagtcctaacctctctgagcttctggttcctcatcaaaaatggagacaggccgggtgcagtggctcacgcctgtaatcccagcactttgggaggccgaggcgggtggatggatcacttgaggtcaggagttcgagaccagcctggccaacatggtgaaacctgtctctactaaaaatacaaaaattagccagcatggtggtgcatgcccgccctcgaggctgaggtgggaggatcacttgaacccgggaggtggaggttgcagtgagctgagatcgtgccactgcactccagcctgggtgacagagtgagaccctgtctcaaagaaaaaaaaaaatgaagagaaaaatagttatctctgtcaatgcaatggagagactgaactgagcctcagtggaggtttattgggccagagcttgagggcgtgccctggaaaatacaagtgacagaaacatctgtggcctgtgctcgatggagtggttccagaaggctggtgtttatatatttcattaaaaggggaaaaagcatgcaggaaaaagtgcagtaggcctcgtggcaggtagttacattcttgtgaggttttaattcgtgcccagtatatctacactattcagaaaataaagtaaacattcaaaagagggaataaaggaagaattaattaggcagacgtctcagggtaggagaggaaggactatctcatcccatctttgtttggcatgtgggaggataagcttgtaatggacatggtcagtgtggcgtttaacagacatcagtaatagggaaggagttagactgaggttacagtcctaaagttacagttggcatgtccttgtttatgggaggatactcatcttcaaagatttaggggccagcaaaggagttccttaggagcaacttgtgagggcagtcatcccacaatggattgcatggggcctttggccttttgcaggtgtctggttaatgtagaatgctttgacacaaggttgggaagtaacagctgtctgttgatggggaggaggacagcagtgttgggaggtttccaggcttaactttcacttgagtttggccagtcatgagactttttaatttcctttatacctcgtgtattgttttaaggatttgaaataagatagtttcattggcagatacttagtatgtgcctgctgtctatcagagtttctcaacctcagcactgctgacatttggggcaggatcactctttgttgtggggggctgtcctgtgcattgtaggacatttagcacaatctgggctgtacccattaaatgccagcagtacctctcctgtgacaatgaaaagtgtctccaggctgagcatggtggctcacacctgtaattccaacactttgggaggccaaggtgggtggatcacttgaggttggaagttcgagactagcctggccaacatagagaaacaccgtctctattaaaaatacaaaaattagccaggcatggtggcaggcacctgtaatcccagctacttgggaggctaaggcaggagaatcgcttgaacccaggaggcagtgttgcagtgagccgagatcacgccactgcactccatcctgggcgacagagcaacactctgtctcaaaaaaaaaagaaagaaagaacagtgtctccagacattaccaaatgtctctgggggattttgtccccaagttggtgaccattgctgtttgcaaagttctcttctggagctgggaatacagcactgaaagcttcagacagttcctacctttgtggagactatgttctagttgggggagacaaacgtgtaaaccaataaatgagaccccttcaagtgtgataatagccttattttcttcctagcacttatttctaccattgtctgagaggtatttcagaggatcgttttaaacagccccaggactagtactaggactaggacttagctctttctagttgactggaagcgtgacattcgaggtttggtgtgggacctcatcccctgaactttggttttctttgcagctatagaggaaatcaaagagaaaatgaagactgtaaaacacaaaatcttggtattgtctgggaaaggcggtgttgggaaaagcacattcagcgcccaccttgcccatggcctagcagaggatgaaaacacacaggtgagacctcaggaaccactgggagatgctcattttgtctgagggtcgtgatggctactaaataactgattcctaggccaggcgcagtggttcatgcctgtaatcccagcactttgggaggccaaggcgggcagatcacttgaggccaggagtttgagatcagcctggccaacatggcaaaaccttgtctctactaaaaatacaaaatattagctgggcgtggtagcgcaggcttgtaatcccagcttttcgcgaggatgagccatgagaatcgcttgagcccaggaggcagaggttgcagtgagtcaagattgtaccagtgtactccagcctgggtggcagaatgagactgtccaagaagaaaaaaaaatgattccttatactaagttgaattggcctctttggaatctcaatccggcagagagcaaagaaatgcccagtagtcaaatgaagcatttcactggattccctagccaagaaaatggctagcagatgtacatctgtccttgcatgtggatagtttattacattacgttcacgcttctttttcctctttattaaccccttttagcttttctctaagccagggacctgcaaactatagccagtgggccaaatccagcccatctcctgccttatggcctttgaactaagaatgttcacatttttgaaatgttttttgtttgtttgagacaggatctcactctgtcacccaggctgaagtgcattgctatgatcaggactcattgcaacctctacttcctgggctcatcaagctatcctcccacctcagcctctcaagtacctgggactacaggtgcttgccaccatgcccggctaatttttgggttttttgtagagatgaggttttgccatgttgcccaggctagtcttgaacttctgaactcaaggcgtccccctgcctcggcctcccaaagtgctgagattataggcatgagccaccgtgcctggcctaaaattgcaatttttaaattagtacctaagtacctacatatgatccttgattttgcccacaaagcctaataatatatttgctgttggcccttgtggaaaatttttgctggcccttacacgagtttattcatttccacccatgcatacagacgagcatgaaaactcagattacccactgctgccctctggatctcaactttaataaaaggggttggtgggtcgctaagagcacacactctggagtcagacagcccaaactcaggtcccagctccatctacaccactgctgtgaccttgggcaagttaccaggcttactctgcctccgttttctcatctataaaatgggactccaaggactgagtgagatggcacagtaaagcacttagcacggggcccgacgaatagtcaatgctcagtaaaggtctgtgatggccaccatttttattactttatttcactctctggatatgaagggatgatgattacatctgccttagagatgagtttgtagcctacccaaggtatagtactgggcagattcaaaatacacttgttgggcagggcatggtggcttacactgtaatcacagcactttgggaggctgaggcaggcggatcacttgaggtcaggagtttgagaccagcctggccaacatggtgaaaccctgtctccactaaaaaatacaaaaattagctgggcatggtggtacgtgcctgtagtcttagctactcgggaggccgaggcatgagaatcgtttgaacccaggaggcggaggtcgcggtgggccaagattgccctactgcactccagcctgggtgacagacaagactccatttaaaaaaaaaaaaggatatagatagatacacagacacatacacacacacacacacacacacacacacacacacacacacacacgttgattcgtcattctgtgagtcagcgatctcttgccatttgagggtcaaatctgtactggcctagtgggctggccaagaaatctgctttctcagattgtctgtatcgtttagaagaatctttgcttttcgaagctgtcaggaatattcctaaacagctcactggagatgggctttcatctcaccacttgcaagtaaccacttgtgagtagacaactgtttacatccttcactttcatgtaattacgttctgaagtctttgctgcatgcctgtctagactttgcagtatacagaaggaaagcacaccattcagtgtggaaatatggctagatcagctgtatttttttatgcagtggtggtttaaaaaaaaaagaagtcagcatttaggaaagtgtgttttccccaggcagacctactcatgacagtgacatcactatctgcaaagtgtcaacacatggaaaatgctgaatatgtcttgattaaagtcaagcagcacagatttctccctgccctaaatccagcagggtggtgggacatgccctgacctttttctgcctgccatctggtggaagcttggctctaactctgtgcaagaccattccatgttagcgcttgaggcaggcaggcgcctgtcatctcattggcacaaagggccttggatcaagagagagcagaattagaaaacacccctgacgagtcacaggctgcccagggagtgtgtaagttgtggtgaaggcagaaggagcctctgtagcataagcctgagccatgagacagccaagagtcatacactgtcttccactgcaaaagtcaccgactcccagcctgggcttcaaagtgagacccctgtctctacaaaacataaaacataaaaaaagttagccaggtgtggtggtaagcacctgtagtcccagctactcaggagactgaggtaggaggatcacttgagcctgggaagtcaaggctgcagtgagccgtgattatgccactgcactccagcctgggcaacagagtgagactctacctcaaaaacaatgaataaataacaagtcaccaacttccataaattaaactttttttgtttgtttttttgagacggagtctcattcttttgcccaggctggagtgcagtggtgtgatctcagctcactgcaacctccacctcccgggctcaagcagttctgcctcagcctctggagtacctgggattacaggcgtgtgccaccacacccagctaatttttgtatttttagtagagacagggtttcactatgtttgccaggctagtctcgaactcctgacctcaggtgatccgcctgcctcaacctcccaaagttctgaaattataggcgtaagccaccacacccagccaccataaattaaacatttatgatctttgtgatctgaaaggcaaactgtcataacaaggtcagcactaggtgtttcaggactgagtgtgcgaggccctcctctgggtcctgggactgcagagctgagaggggccttgatgaccccggagcagttgtctcacagatcagaagcccagacagccaaggcttcgaaagcagaagcaacttgtgcaaggactaaaagttaggactaaatccctcttcccctaccctcctcatcaggggcagtttggggtgctgagtaaaggagacgctttgggtcccgacagccttgcagcatctccaccttctgcagcaaacgcggcctcttcccatcagctgcaaacacaggcccagaggtcctgctgggaggaacgcaggcgcattgctctcagctttgcttttctggcctaacctaagcaaaattaaatggacagattttggggtagtaataagatcaacaggaagtctgaacagacaggacccagggccgtcctggccatctgggtagcaggagcttgtcaacagcctctcgggcctgccacgggagtgagagagtgcgctggatctgcttctcatatccttacatcatttcgctcaagattcactccccaagggagtgaaattcctctaaagggaattgattaaattgttccctaaaggaagggcatggagacagagtcactagaaacctgagagtatcgaggaaagtctctatcacagtcatagtgatagtgtcatttccccgtggatcattgacacatcagtcccaagtatcaaggtccggagagagcaagtcaggttttccgatgatgtcgctctgctgttctccccggatggctccatagagggcacctgaggccagtgctggtctgtggatggcgttttcccgtgcacaagtttgagacagcgctgggtgctgaggaagtaggaggctgggtttgttgagaggattgaagagggtggcaagaaactaattcagggcaagttaaaaagtgacgcggaggtgcagcactttggatccgagtcattgcagctttcaagatgaatactagccctgttctcagaaggttcctgaaggccgtctcagacctcctgtatcagaggggaaggcttggggtggaatggggtcgcctgaagctgcacctgagtcacaactaaagagcttttccaggtttccatcttactttaagtttctgttctgtaagtttagcctaaaccatcattcaccttcaggatcaaaggaaaacagggcttggtcagggttcagctagaggctccactctggtcctccacagcaggcccgtggtgtactggaaagagccccagttggggccgaaagacctcagtttatgtcccagctctgttccctgcttattgaactggtcccctctgaacctcagtttcctcctctgtaaaccagagataatgatacttaccttctaggcacatggccgcctcagcctcccaaagtgttgggattacaggcgtgagccactgcacccagcccccaatattttttaatacattcatattctgcttaaatagtctagatttggcttgtatctgagactcctgaacaagataggatgagtttgagaaaaatttaagatgcagagaccaaggcttggtgaggggtgagcaaaagagagctgtttagggtggctccaacactgccgtctcttggctgttccatccattctgtcacacaagccaaacaggcgctaggtccctttccccgtctcctccaaccagggctcagtaaacaaggtctgagcccgagcctccaagtgacctgacagccaggtctgtaagatcacccttgaggagctcagccaggctgaggggtaggggaatgggggcatcagtgtttatgaaccttgagatcagcgttaggactctccctcaggagaatctgatggctccaagtttaacccagtttctgtcttctcccctgtccttttcctctaaccccgctcccctcctagttgtgtgtgtctggagtgtgtgcattcagttatataaccgctttggtctcttcttgtccccagattgctcttctagacatcgatatatgtgggccatcgattcccaagataatgggattggaaggagagcaggtaatagccggttacagaactcaggaaattattctcttaaggcaaactctgtagcactgaactgtcaaacctcaacaaagaggcatgcggagcccataaatgtttttttgttgttgttttgttttgttgtttttgagacaaggtctcactcttgtcgcccgggctggagtgcagtggtgcaacctcagctcactgcaacctccacctcctgggttcaagcgattcttgtgctcagcctcctgagtagctgggactacagtggtgtgccatcatgcccaactaatttttgtatttttggtagagaccaggtttcactacgttggccaagctgggctccacctcctgacctctagtgatcacctgcctcagcctcccaaagtgctaggattacaggcgtgagccaccgcacctggcctgtaaatgtttatgtggacatgaggagctcatacatgctcagtagtccatctgtctacttttaacaacaactgtgagtcttggcgggggaggggcgggattgtatatgaagtctgtctacaccattggagaagcattggtttcgatgcctcctcagaggggaagggaaacagccagtgaaatgcagaagtaagacacggaaatttagctctgactgggaacattagaccagggcttgctatgggtctgtaccctggaagcaagggaatatttctgcccttgtggtctcccctggggaactgagactgcagggcgggtgagcgatgtgggctgggggcagggctgtagcagtctatgtagttgctggcctcttcttgctagcaagaagctctccaagagaggattcccccaagggcagtgcatggaagctggggctgggggtgctgggatgtcccgagagtctcaagattggttctttctttaattagtgccaggaatgcattaatcctgttttggggatgcagtggtgaacaaggtccatgaagacccctgtctgggtgggagaaggcagatgctagataatgtgaaaccaacccagagtgaggggatggacagtagggcagagtcagaggggctgaggggtggtcaaaggtgccctcactgagggatagcatttgagcagaggatgacaggaggggagagctgggggaagggcattctgggctaagggagcaactgcatgggccgctgacacaaggtgtccttgtgtcctcagtggagtgaccagaggggctggagggtggcccgaagcagatggggccggccttgcaggcacttctaaggccttggggtttgcttccgagggagtagggaaggagagcgatgtcaccctgtgaggcttggtcacataccccaatggatttggtagcacacgccacagtgaaggtataagctactgtcatcacacgtaattatttcatgaaacagaaaattttaaaataaaagaaaatagaagtttccctattttcttctcctgcactattggatcatcctgtttacccctcttttaagacaaatggacttagcaaacgagtgtaaataggaatgaatggttttgtggggtttattttattttattttattttattttattttatttattttattgagacagagtttcactcttgttgcccaggctggagtgcagtgtcgcgatctcggctcaccacaacctccgcctcccgggctcaagcagttctcctgcctcagcctcctgaatagctggcattacagacacacgccaccacgtccagctattttttgtatttttagtagagttggggtttcaccatgttgaccaggctggtctcgaactcctgacctcaggtgatcctcccgcctcagcttcccgcagtgtttggattacaggtgtgagccactgtgcctggctgggtgtcttttaatagaacttcgaagtcagtcacagaggaccgcatgttgtgtgattccacttacatgaaatgtgcagaataggtcagtccacagtgagagaaagtggattaggggtcctgtaaggctgggaggatgtgagacagactgtggggggtggtgacagctgaggggtatagggattcttcttaagagtcaggcaaatgttctaaaattgtggtgactgggtacagtggctcacacctgcaatcccaacactttgggaggccaaggcgggtggatcacttgaggtcaggagtttgagaccaggctggccaacatggtgaaaccccgtctctacaaaaaatacaaaaattagctgggcatggtggcgggcacctataatctcagctacctgggaggctaaggcaggagaatcacttgaacctgggaggtggaggttgcagtgagtcaggatcacgccactgcactccagcctggtcgacagggcaagaccccatctcaaaaataaaaataaaaaataaaactgtggtgatggctgcatgcttgtgactgtacagaaagccactcattcaatgggtgagtcatattgtctatgaatcatgtctcagtaaatctgttgagaaaagtaaggcttcatcaagaaaattaaactttcagtgtgcgctttgtgtgctgctggacacctgctggggggaagaggtctgaatcttgttgccccaggaagctcccctttgtggctggagctgattggggacaggttctgaatcagctgtttcgtgagagctcattcccttcactcctgtgcttttacaaaagccacctcattgctccacaggtatctgcattttctcatcagtccccagccgatttttatgactcttttaagataccttagacacaacatcatatttgaacttgagtaactttggttccctatctagacatccaagtagagtttccaaataacccagcttagggcacaaagggagttgagttgcatctttattacccacgccctagctgttcacctccttttaggaatttcgtggtaccatgtaagacaatgaattatattttaaaaaaccatcgtcttactttgtacaatttgtctgtgcatgaaatgtgaccagggtacatgatttctactaatgaacatcggtgctcatgttcacacaggttcaccagagtggctcaggctggtctccagtggtgagttttcacctctttgccctattttcacagtagtgtgtggttgtgtgtacataatgggtttgtggtttgttggtccataggtatttattagggtacttttcgaggcacagaggatgtgattaaaaccagtgattggcaggctttttctgtaaagtgtgggacggtaaagattttcagcatgtgggcctacattccttgctgttgtagcacaaaagtagtaatatgtaactgaacaaccaggacagtattccaataaaagtttatttacaaacacagatggtgggccagatttggccctgaagtccatagtttgtaaatctctggttaagagagttaaggaggcagggtgcagtggctcacacctgtgatcccagcactttaggaggccaagccaggcagatcacttgaggccaggagttcgagaccagcctggccaacatggcgaaatcccatctctactaaagatacaaaaattagccgagcatggtggcacgcgcctgtaacactggctactcgggaggctgaggcaggagaattgcttgaacccgggaggcagaggctgcagcaagctgagattgcaccatgcactccagcctgggcaacagagccagacttcatctcaaaaaaatgaaaaataaaaaaataaaagagttaaggagatgacatttacttattttagctgagttccctgtcattgccgtcactgcagcccatggacatacagtgcctctttcaaatcccccaacatggtacccttttttttttttccaaaaatgatttaggagcaaagagtgaatatgctcataggtcacatggtagttttgtcctgaaaatgtttttttcagtcagagctcaaacagaagacctgggggagggcctcactgtgtggttttgagtaaagcgtgtcttgccctcaccctgttccctctgcagtacgtggaagacaacctgggggtgatgtcagtgggcttcctgctcagcagtcctgatgatgctgttatctggaggggacccaagaaaaacggtttgccactctgcctttttttgtctctcacattcttccacgagcgttgtggctcttggctttatctgctccctgtcctgccagtctcagcctgctggacttcacagtatattatttttaaccatccagtgcctctttcttcactggttgaaaagagctaatagaaataccagtttccattacgtaattataaatatctgctgtgagtttttctctccttaaaagctgtagaaccctggtcgggtgtggtagctcacgcctgtaatcccagcactttgggaggccgaggcaggtggatcacctgaggtcaggagttcaagaccagcctcgccgacatggtgaaaccctgtctctaccaaaaacataaaaaattagccgagcatggtggcacgtacctgtaatcccagctactcgagaggctgaggcaggagaacccaggaggcggaggttgcagtgagccaagatcatgccactgcactccagcctgtgtgacagagcgagactttttctcaaaaaaaaagctatagaaccctgaaattatttttatcatggttttatagtggcttatttgggtcagagaggtgagatcaacaggaggttgatctggtactgagacttaaggtaataatgtgaaagtgttatcagggcaagctttagcctcagcactattgatattttgagccagataagtctttgttggggggaggagtagaccgtgttctgcaccatagggtgttaaacagtgtccctggcctttacccacaagatgccagtagcaccccctactctatttgtgacaacccaaaatgtctccagacattgcaattcactcccagttgagagccactgacttacagcatagaccaaaggcacaaaaagatcagatcatgcttctccgtgagctgggcacagtggcacgcacttatagtcctagttacttgggaggctgaggtgggaggattgcttgagcctcagagttaagagccaacctgggcaacatagcaagaccccatcctttaaaaaaaaaagagggagttgaaagtacagaaaagaaaggaaaagtaagcatcccctgtggattcctctttctaggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggtgagcgagctgccagctggagctgggtccaaactgtgctccacactgtgagatttctttcctacctggctctgatactctggtctcaccaaggctcttcccagtgtgtgttccgcagctgcatctgatgtgggtctgcagaaacctcgtgttaaaaacttcagccagcacagtgattcacacctgtaatcccaggactttgggaggctgagatgggaggatcacttgagcccacgagttcgggaccagcctgaaaaacatagcaaaaccccatctctacaaaaaatattttaaaattagccaggcatggtggctcgcgcctgtagttccagctacttgggaggctgaggtaggaggatcatttgagcctggggaaaggaggttgcagtgagccatgatcacgccagtgcagtccagccagcgcaagcgagtgaggccttgtcccaaaagataaaaataagaaaaacttcatctttggtctagacatttgcagctgacaaccattcaacgatttggtttttttttagtccatggattaaacaatagtgggtcaagaatgctttttgaactttccttgaggaaactagggaaaccaccagtgcagttataattcatactgtgctgcctggccccgtcagccttgccgtgtccatgtgtcaggtcccccagcctacagtggattttccgtttacatcccaggatgatttaggaaatctctccagttttcaacagaaccagctgggtgcagatagggatttcgggataagccactgggtgccttcgcttcttccgtagtgacacccagcaaccctctgtagcagtcacctagtggctgtactccaaggcccatggtgagcccgagctgagaggagagcgataggaagtttcctctctgtaagtcctgcagagagcaactgcaggcaggaccatggtgctatccatctcaggggcctgagaaactgagggctcttctccatctccacagttacgcctgacttctcttcatgacgttctcctccacacttaagaaagcccagcaaaggaggtttgatttgatctcactggccagaatcagtcaggacgacccatagtctcacctcatccagcactcactgagctctgactctgacatgccgggcaccagggcagtaaaaaggcctggctctccctggtggcccctgtggctccctgaggaacacaggtgctggacacagggatgagggtacagccaatggagtggcaggcccagcggccatgggaagggtgtccgggtcagaaaatggtgcaagattcatgtccaccctggcatcctgcagagaggggacatggggacgcaaggaggagcaggacaccagctgggaccctggacaggagggaggatggcctggcccgggtgatggcagtggagagaaagtgtatttgtccttaggaatgttttctgtcccatttttaaaaagtggttggtgctgggcacactggctcatgtctgtaatcccagcactttgggaggccgaggcaggcagattacttgaggtcaggagttcgagaccagactggccaatatggcaaaaccctgtctctaccaaaaaaatacaaaaattagccaggcgtggtggtgggcacctgtaatcccagctacttgggaggctgaggtgggagaagtgcttgaatccaggagacagaggttgcagtgagccgagatcgcgccactgcactccagcctgggcgacagagcaagactctgtctcaaaaaaagaaagaaagaaatgagagactgagtcgcagcccattgactttctagctgagcgccccttcctccgcatcccagcctcagtgtcaagagccaaacaggcatctcaggaaaagaacaggcccaaagctgcgagcctttcgggctcacgtgagtggtgaagctccaggtgctaaggagtcactacacctgacagtgacaagccacagcaggacttgggtacagggatctgtgataacattaactgaggaaaatagggagctactgagcggtgtttatacacagtaatcacattggaaaaactcagagttgagaaggaaatgcaaagttgtccacattgggcagtattccttatttccttttagtcagttgtttgtgtttataattatctagagcagggattggcaaacttttctgtaaagggccagataggaagtaggcgttgcggaccccacggtccctgtcccagccccttagccgtgccactgtggcatgaagcagccacagacggtgcctagagggacgggcatggctggttccggaggaactttatttataaaaccagccagattcagcccccaggctggggtttgccaagctctggtctagaaaacagtgcacacactggcttaatatagtatagtatagggacatggagcatgtagatgcgttaaaaggtcattttcagataggcacagtggctcacgcctctaaccctaacactctgggaggccgaggcaggaggatcacttcacaccagaagcttaagaccagtctgggcaacaaccatctctataaaaaattaaaaagttagccaggcggagtagcacatgcctgtagtcccagctactctggaggctgaggcaggaggattgcctgagcccaggaggtcaaggctgcagtgagcaatgattatgccactgcactccagactgggcagcagtgagatcctgtctctaaaaaaaaaagtcattttcttttaggttgatttcttgctatttggctgtgtgggaagtaaatagcacctcgaacaaacagggcttagcactagtaggtactaaataaatatggatttggcagagggcatacattagttcattttcacactgctgtaaagaactgcctgagactgggtaacctataagggaaagaggtttcattgattcacagttctgcatggctgggaaggccccaggaaacttaacaatcatggtggaaggcaaagcaggcacatgttacacagtggcagcagtgagagagagagtgtgtaggaggaactgtcaaacacttacaaaaccatcagatctcgtgaaaactcactatcgagaccagcatgggggaaactgcccccatgatccaatcacctcccaccaggaactgcctgttcctgtagggatgtagggatgatggggattacagttcgagctgagatttggatggggacacagagccaaaccctatcagggcagaaacctctaaggctttatgatcgcagatccactgcattgcagccatcccctcggttgcacagacattccctttctcgcactttgatgctggaatcactggtcttttcaccttcgtaggaggtgtcactccaggatgtccggaaagaaatcaacttctgccgcaaggtgaagctgcccatcatcggggtggtggagaacatgagtggcttcatctgtcctaagtgcaaggtgagggcgcgtggggctgccaggcgagcaagatcttgctctcatggatgaggaaacgatcggaaggctgctctgcaaactatttctgctttccctgtcattttgggaagtggaatcacaattaaaatccctttctgctgactaaaggaaagttctttaggtgttaagggttccacattcaaactaagccttttttttttttttaagtttctttaaaatgtggtccatccttgtgattctgcaaaaaaattatgtttcctcccctttgaatttgccttgcagaaagaatctcagatattccctcccacaaccgggggcgcggagctcatgtgccaggacttggaggtccctctcctcggcagagtgcccctggatccgctcataggtgggtgaccccagtgtggggcggcacctcactcctcggtcagccccacaggcacgggtcgggcacaacagggggcggctacagagaggggcaatggaaggaggagggtcaatggggcgctggagccagacccaccctccagctggcaccccaagaggccaccgggagagaggccgagacccctgcgggcaggtagcgggagcaagcaggcctcaggcagaggggtgaggcctggaagaatggggtagaggttggtgagggtggtggtggcaggggactgaggagggcacccgatagaggggcggctccaggggatgcacatggcgtccaggttacagaggaaggcggcctgaggtgaaaatcccttaggaaggggccgggcctcctgtgcccggagaagccagcacggcacagatgaggcccctttgtctccagcaccgggacagaccggaacgcggatcactggcctgcgagcaggggccaagttcccaaaaaatgctcttcttaagtacgtgggtctcccaggatcccaagagatgcccactccctgagtggccctgaggctgaaggagggacggggtttcacgtctccacccacacgcccgccgggcgcccactcgccgcggggcgctgggcagggcctacactcgaagctgctcccccaggaggctgctgtcccccaggaccgcggagccgggcgggcctccgttactggggccctttagtggggctcctgcggggcgtccagcactcgcctttaggtctgaggggagaacagagagagaaggctggaggggaggccgggatccaggagtgccggctgcacccatgcctcggaacttccactccatttgtcagggaaccaaggccagtgtgaggtgtctgtgccgggacaggagagaggggccgggcgggtgaagtatggcctggccaggagagggtgggggccgcgtgcttggggagagggcggggcccgtggagagcctggaggcggggagggcggaggccacgtggggagccttggggaagggctgcatggggagaatgggagcctgtgggaaacgactgtcagtgtcatgtgcctgggaacaggaggctcaggagtggctgccctgggataggggttcaggatgaggccctgggttctggcgttggtgtagaaaggaagggacacacacaagagagaaagtgacggcatctgagggtcaaggttgtccctgctgccagtacaagtcacctggaggagggtccgtccctcagagacagtgaagcaggggtggtagagggaggccgggccctctggggtgctgcggctaaggggctcgggggctcaggttgtcagcaggttctggggtccgtcaggagaaggtggttcatgtccgtgcagttgagttttgaagccacaggacatggacaggattgccaaggggccgtgcagaaagcgggagccaggaggacagtgttgggggatggctgcctcgaggaagtggtaggggggtagggtgcgagggccactctgaagatgggaacagcccgggagaacgccagagaccccatgtgcccaggaggctgtgtccccaaatcctttttcccttattcccacatcccacaatacttctctggcatgtgatttccccaacaacatgcagaaaagtacagctgctttctcaaccttccccagcatcataaaacactcaccaggcagcttttgcagtggccggaagtggtgatgagagctgccctctgaggcccctggaggcagttgggctgcatgaatggatgtgattggggacaggagcttgcagcagcccagggcacatccattcctgccagcctgcacctctgccacagttcagctctgccgagatgggattggtgggcaggacgtttgtcaggggaaacatctgtgggagaaaatgacaagggagagcgttagcccacgatgaaggagtgggggaaggaacatatcagcccgaaagagcatcacggcccataggagtatctcagcccctggaagcatctcagcccaagggagcatcccagccctcaagagcatctcagcccatgggagcatcccagcccaagggagtatctcagcccacaggagtatctcaggccacgggagcatcccaactcaaaggagcatctcagcccacaggagtacctcagcccatgggagcatcccagcccaaaggagcatctcagcccactggagcatcccagcccaagggagtatctcagcccacaggagtatctcagcccacgggagcatcccaactcaaaggagcatctcagcccacaggagtatctcagcccacgggagcatcccagcccgaaggagcgtctcagcccactggagcatctcagcccatgggagcatcttagcctgctggagcacctcagtgtactttgctttttggcatctcagtctgctggagtatttgtctattggagcatctcagtctgctggagtgtggcagtctattggagcatctcagtctgctggagtatgccagtctgttggagcatctcagtctgctggagtatttgtctattggagaatctcagtctgctggagtatgccagtgtgttggagcatctcagtctgctggagtatgtcagtctattggagcatctcagtctgctggagtatttgtctattggagcatctcattctgctggagtatttgtctattggagcatctcagtctgctggagtatgtcagtctattggagcatctcagtctgctggagtatgtcagtctattggagcatctcagtctgctggagtatgtcagtctattggagcatctcagtctgctggagtaggtctattggagcatctcagtctgctggagtatgtcagtctgttggagcatctcagtctgctggagtatgtcagtctgttggagcatctcagtctgctggagtatgtcagtctgttggagcatctcagtctgctggagtatgtcagtctgttggagcatctgtctgctggagtatgtcagtctgttggagcatctcagtctgctggagtatgtcagtctgttggagcatctgtctgctggagtgtcttggctgctgtcgaggaaagctgggcacagccaccagggcattcctgagcccacttacccatcagaggggctgcatctcccagaagcgtgcctgcccgagtgccatgctcgtctcagtcactagctaggagcagcctgggagtggcattgcctcaacacaaacgtggtggtggattttggagcatggcagctgctgccagagatccaagaggtgtgtccttatggccatcacaattgccacattttccaaggtttaatgaagagctagaaatctatatccttacccaaagtctcctgatactaaatgatagcaactaactccattaaatacacacacacacacacacacaaccatgctctagcctgggtaacacaggaagatacctcatctcttaaaaaaaaaaaaaaaaaaaaaaaggaaaaaattcacccagtgtggtggcatgtgcctgtggtcccagctactcaggaggctgagttagcaggatcacttgagcccagggaggttgaggttgcagtgagccatgatcacaccactgcactccagcctgggcgacagagcaagaacctgtctccaaaaaaaatttaaaaatggcatgcttgctgacccacccaaatatgtccacgggcccagccacaggcctgcccttgccattgtctgacagatcaggaagtgaccttggggctattagatcctgatacggcttttcttccaaagagccagcaacctccatcttcccacctccctcacaccaagccctggcattggccctggtctttcctttcagggccacttttcacaaagaaacaaagttccaggtggttcacaagagctaatttcaaagcagaggagccaccagtgacagctgcgaggctcattctgagctgagaacattaagtgccttctagtgggcatggtcctgtgtgtcaaatggcacattgcagaagctcaccttgaggggaagccacagatagcaaggccagggagtgccagaaaggaaggggtggttaacactgtcacccacccaagagggtggagcatgagggccaagtgacagacacgcatctggcaaggtcactggggacagagtgggggaaaacccaccttcctaggaacagacaggaaggcatgaggacagcacttcagtctcctctggggacatggtggcaaagagttacagatgccagcgctctggtgctatgggtcctggtcccggtgtgctgaggatcacaggaagggctggcctcagagccctgctccgccaccactagctgtgggacttgggctagtcatttccgctctcagcctcgatggccccgtgtgtaaaatgcaggtgacagtggtgcctagtgagagggatctgccagggtggggtgagaggatgcctgggatctcttggaacagggctgtgctcacaccagctgttctgataatgctgcccgttcttggagaggtgggagcccagggggaaatgcagttaggaagggaaaacactagagcatatatgtgtgttgggggctggggagccctctggggaagggagacctgggtgaaagtcagggacagaaagtagccccagcatgactattctgggatccccaacctcccaggtctggcccagcgaacgtgcactcaggggcctccctagcgagttccacatggtctcatgggcccagcgttaacggcggaggatgtccaggttcttggtgtctggaacaaaaaattggacaaaacgcacaaagaaaggaaggaaggaagggatttattgaaaatgaaagtcaactccacggtgtgggaggagaacgggcctgagaataggggctcaaaggccccattacagagtttttgtgtttaaataccctctacttgaggtatgccctatataaacgaaaaggatgaagtaaagttacaaagtcatttacggcatacgtcctatggagaggacatttcctgttatggctcaagtgcgaattggccttatgttccctgcctctggaccctattttcctgactcactgggccatatgggctccccatctcccaccaacccctccccacaggcttcttccccgacttggacttccctgtcccacagggcgacacagtagtgaagttgaggaaatgatgagtgctaggtaggaacccctcctggggttcacctgaggctggtgaccggccatgggcagtgcagtcacttgcctgtttcgccagcagctcaggcctggggagtgggcagagcaagctgatggcaggtccacccacgactgggggctggcagggcagactggaggcgagaacacccccattgacccctagccctttgtgtcctgtccacctggctctgggataacatggtcctagagaaacctgggtgtgcataggaggggactggaacaatggccacatggcggggaaagactagcagactgatagacaccagcacagatgacctggaagataaaattatacacagacaaagcagcaggcagaatgtgtgtgtcatgtgctcccattcgtattttaggtatatgagagtgtgtgtatgtgtgtgcgcacacatgcaagtgtgcacatttatatgcgcataatctttctggaaagacacctagaacactagtagcccttttcggacttggccttttatgccatatccttttgcattctgtactttttttaaccatgtgcattcatgatcctttcactcaaaagctaatctcttaaaatgcagactcctgggcccatgtggaagctgctgaatcagttctctgtagggccctggaacctgcattttctgtacaccacctgattatttagccacgctgaaatgctggctggggaccctgctggaaggaaggtccctgagaccccactggtcttttctactttgttcttcattacgagtgaagcgggctcaagatcttcccattgtcaccagcacggaaagagccccaagatcttgtggccattctgttttcctcttggactgaattgtcttccgtttgtttcttttttaaggtaagaattgtgacaaaggccagtcttttttcattgacgccccagattccccagccacgttagcctacagaagtataattcagagtaagtatttccatgagtactaaatgcagatgcctgtggggcaggaagcaacataaaggagccaggggtgtggaaggacaggtgggtggtggggtctgtgatgaccacagagtggcccccatagccgaggaagccaggagtccatgagaaatctctcaatgtgtgagtattgtgaattaattcatagtttaaaaaacatggtgagggtgaaatttatggcttaggaaatacatcccaataaagggataaagtaattcatttttaaaagtaactgataaaaaaaaaaaaggccaggtgcagtggctcacacctggaatcccagcactttgggtgaaggaggcaggcagatcacttgaggctggtcaggagttcaagaccagcctggctaacatggagaaacactgtctctactaaaaatatgaaaattagccgggtgtggtggcgcatgcctgtagtcccagctactcaggaggctgaggcaggagaatcgcttgaacctgggaggcggaggctgcagtaaggcgagatcgcgccactgcactccagcctgggcaacagcgtgagaccgtgtctcaaaaaaataaaaaataaaaataaaaactttgttgagccagaccaaacccacgtgcaggccacattcagccagtggcagccatcagaggccccagagttagggcagaggtgtcagtgtttgttaaagctgtggtctctgagtttgtggctgggttttacttgcctagaagaatgatgtcaagggtaaggaaacagcattcccagaatcctccatctatagatggtccgaggaaggccgcagccactggttatgagcaagatgggtagtgtgaggtattccggtcactttcaaagactcagggcatcacagacacaggtctttttatggaactagccagaggattccacccctgtcaaaacacagccctccccagcacaggacagggctgtcaaggggtagacaagccattagcactctatgcctgtcgtcttgttttccaggaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctctcccccgaggcctgtttcacgtaaaaaacaaatgggttgtgggatcgtgggattctgctgtgtcggaagcttagtcgattgtagaaactcccgtttaagccatttctgcctgtgaagataagaaagcctagaaaagaaccaaaggggtgagtgtgcggcttcactgcagaacacacaggcttgttttcaaacaccacagtccaaacgcttttcttcagattgaggaaaaatctaaaagcaacagagctcacgctgggcttcgttctaaaatcactgcatatgacacagctgggtcaaatcaaaaagcccttgaagagtccttgaatcacccagtaagacagaatgtggggtctgtgtaaattccctgtgtagtaatatgtgcacagtatatccagtaatgtccagtgtcatgcaaaccaactttcaggttttttaattatataaaaaagagggacagatgtaaactctacgatcatcctctttgccatgaggtgcttgctctgtttgagacacacaggatctgagaccacgtgggagaagagtaaattcctgttttccctccactctggggcataaaagtgggtgggtgggaaacaagaacaaatccccttgttctttccctcccttgtctcttccctccccgcccttccctaggaccatacatatgatcagatttgcacatgttcagtgtgaggaaggtgtgacctcgccccccgacccccagctcctcacgccaagagcaatgaggctgcaaagcccagggcaggcccattgcccagtctgcttcctgcctggtcacatgcctggccaccccagggaacaggggaagcccacccagaccccgggcccctgtgccccaagagctgcatttttcagaattccccagttcctccacacgggtgccatgatccatttctcacctaatgctggtgaatctccagcccctcgaggccaggcttctgaaagtcacctgggcaggcctgcaaggggaaaagtcaaccatggttttctgtccttacacgcgagtggggcgatcctgctgatggaaggccagagaaaacccacaaagtacagaaaacctgcggaattggttgcttgatgtcttggcataaagcagtgctgttcaaatttaggacggttctacccatttcaggatgaacctggtcaaatttcaaagacttctgtctctcacttttagaaatatctattaagttaaaaaaaaaaaacaaaacaaaaacaagctgggcacggtagctcccgcctgtaatcctagcactttgggaggccaaggctggtagatcacttgaggcaaggagttcgagaccagcctggtcaacatggagagaccccgtctactataaatacaaaaattagccaggcatggtgttatgcacctgtaatcccagctacttgggaggctgaggcaggagaatcacttgaacccggagccggaggttgcagtgagccaacacatgccattgcactccagcctgggagcagagtgagactcccatctcaaaaaaaaaaaaaaaaaaaaaaaaaaaattgaaaaaccgtttgtgactctttccttaattctatacttttaaaaatcactgaaaactaacaatggcagtcacaaaaggacaaaaactataattgcacttataggaggtccctagggctgtcaaaccaatagatacagaaagcagaatgctggttgctagggctaggaggcgaggaggagggggagttagtgttttgtgggtactgagcttaagttttgcaagatgaaagcagttctggagctgggtggggtgaaggttgcacaataaagtggttatacttaatgccacagaactatacattttaaaatggttacaatggtacattttatgtaaatcttacaattaaaaaacaaaactgccaggcacagtggctcactcatggctgtaatcccagcactttgggaggccaaggcaggcgggctgcttgagctcaggagttctagagcagcctggg

SEQ ID NO: 17025 - DNA, 27412 bp, Human
  misc_feature (1)...(27412): n = A,T,C or G
agccagaatctgggtctcctaactctagttgcctagtcttgcttttatgcgccagtgtcgttcatcattcattaaatacatgttatggaggataaattaagggcagagcattgtgctaggtgctgtgggtgatcttatcagacacagatctttagggaatctagagattaaaaagtatgaataaagttatgtgacttggtgaaggtcaatggcgatttggtggaagaggtgacaatgcagccacgctccaaaaggcagaagggatttgcacctattatcataggggttaaagaaggaagtccagagttaagaaacaggatgagcaaagacactgaggtcttaagcctcaataaattttaggtaagtttcatcgtagtagaataagggctgtctcactccgagacttttgcacacttttgctccctcggactgcttgtcctggacaccgtgtaacctccccctgggcgcctcaccagacttctccaggccaagggaaggaccacctcttgggtttccatggctccctctctaaccacccccttctcaggacacctatgacacgactatttgacttctttgcctccgagcccccacccccaacgtttctggtcttgagagaacgggctgggcgcatccgtgtatctctagcctgagcacctggagcgtcctctccttttcttcttaaggcaaaagcctactcattcttccagcttcagctggaatgtcaggctctccacgcactcatggccctcccttccgccctctccacatacacagggcagggaagctgtgtctgattcctctttcggactccggggactgacatatcataagcgctcaataaatgctagcggaatgaatggaaacgttccgacccgaggcagcggatcactccaggcttctcctcaaagcgagcacacctcagtccagggagggcgcaggagctggggctgctgcggtgaaccaaccccaaccccgaccccgacgccgatcccggccccagagcgcctcctaggcgacccctggccccacccacgccggagccggcccgcgcccatccccacgccccaacccgcaccacgcaacatcgccctagcgcctttcggggcgtcgccgcgcaggttgcgccgcctccgattggccaaacgcggcatagcgccatctcggcctaccgcgcggtgcgcgccctcattggccggcggcggcaggagcaggggtagggggcggggcagcacgcggggcgcgcggtatgggcggactcgcgcctgagccccgcccccggtccctcgtctgggccgagcccgcccagctggctgagacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggagggtaggttgatttcaaagcgggcagatgaatgtcttatttaggagtaggattgggttcactcaaatataagttttatttgaattgcaaaaggcggcaggttagatgcttgtatacattctcatgtattttttattttaaactctgctgtgccttggttacatctttgaccttcttaagaatgagtgaagacatttgtttcatttagcattggttgagcctcagatggaggttggatatttgattatgaaagatggaacgaaatgttagaatttcattttgaaggagaagaacaaccactttccatgatgaaaaagtttttaaaaagttcttgggtaaggattggatttgtgcctgaggaagaaagaaacgtgctgcgggtaagtccactgcttgtaagaagtgacagctgactggggaaagtgacagaacagtttgaaaagcaggcagaaggagaatgctcaacattttgaggcattgggctcaaagttctcctcccccgaatattggagcattgagtaaatgcttgtagtaatgtcctaacataaaggccaggtcttcaaataagggtgtagttgggattcctgcaaagggagcagaggcggccactgggagaagatgagggggaagagtttaggccagatcatttagggcatgttggcaatgagtgttcgggctttttcccaagagttctcccaagaacactggaggattttaagtatgggagtaactttattcggtgtttactttttaaaaaatttttgttttttgagacaaagtctcgctctgtcgcccgggctggaatgcagtggcgtgatctcggctcactgcaacctccgcctccctggttcaagcgattctcgtgcctcactcagcttcccaaggagctgggattacaggtgcacgccaccactcctggctaattttttttttttgtatttttgtggagacagggtttcaccatgttggccaggctggtctcgaactcctgaccttaagtgatccgcctgcctcagcctcccaaagtgctgagattacagacgtgagccacggcgcctggcctgacttttaccttttaaaaagaacattgcagttgctgtatggagaatgggttgtaggcgtacaagaatggaagcagggctatcaggcaagagactatagcagtaaacgcccacttgctttttaaatttttgcgccaccgtttctggatgtgagatctttggcaaattgcttaatttctgtgagaatctgttacctcttccattagacgggaatggcaccacccttgctggtagttaatacctagtctataaccgcctgataatagtagctgttaatattagcctaggggtaatatacatctcttagggtgagctttatgagtagcgctgagttcagtgacatggtgcatgggtttgaggaatgggaaaggagggagagagaatccttaatgtttaatttgaacttttttgtattgtggtctgaaataatttcccttaaggtcactgagctctagttcaggtggctggaatgctgttcctgttttcatgctgtgtagagaaattttggagtaggaaaattgggttaccagcaatcaatattggttccattttgtgaacgccccaggctttctctttatttttttgtgaaccagggagttgttagattgtgatctattgactactaagttcccattagtgcttactctactgatcaggctctgcaaggcctgttttcctccagagctctcctttcagggtgtgtgtgtgtgtgtgtgtgtgtgtgtgtgtgtgtgtgtataaaacaggaaaaacttatgaagaagcacatttttggttaagatgacaaaaggggcttgtcttgccccctacagtaatttaaatatagtcagttctggccattaagacatactaatgggaagagtagaatattgagatcttcccatagtaaaaggacagaaaagtatttttctgagagaaattaaaaaaaaaaaaagaatagacaaattcccagtccactatagaggtaaaagaatgctgggtggatattagaatcacagagtaaagttctaaaggattttaggcttcgtcttcctttttgcttattttttaaaaaccccttcaaatggcatttagtcttatcttaatcattaaggtcaaagaactcaaggaaggtggttccttgcaattctgtatctgaaatgtattcaaatgtgtgaatccatctaccaagaagaaatactacaaaattgaattgttcattttaaaaagccactgtgcactgttgttcttagtggtcataaatctctcaaaacaagactttgcatctttttatgatcaaagttaaagttttgctgtcagttcagccagtgacaggtttaatgtttttccttgttccttttttggggaccacctctttgactaggatctcttagagtatcaggatggggaaaaaggagggataaattaaatatgtgcttatatgttaaggaccaaaattgtaaacaagtcaaatctaagagtcggtatgagttatttcttctcttgtaattttgtttatttagataatcttcaattaatagattggtaggcaggatttgacaatccttttgtcatataaaagtgatattaaattaagatagatttttcaaatgaaaatccagaaagagaaaataaagatgaataatgaaaatatctaaggccgcacgcagtggctcacgcctgtaatcccagcactttgggaggctgaggcaggaggatcacctgaggtcgggagttcaagaccagcctgaccaacatggagaagcccagtctctactaaaaatacaaaattagccgggcatggttgcacatgcctataatcccagccactcgggaggctgaggccagagaattgcttgaatccaggaggcggacgttgcagtgatccgagattgcgccattgcactccagcctgggcaacaagagtgaaactcagtctcaaacaaacaaacaaaaaaacaaacaaaaaaaagaaaatgtctaaaaggtgccgaatagtttgtaacatgaactcaaatcagaagttgtaagtgatttgcatcttgtcgattcccaggatatatttgaagaatttagttattaatgatacagtttgccctataataagtctttgaagccccttataaacatttattatattcggcccagtgtggatttctaaatatgtctgtataacattttccaaatatcatgtttagaaaacaataaatatttaattttattgggataatatgacacacttttatttaacgaatattttgatatcattgatttttatatattatctagattttaaaatgtaacaatttgtttggtttgataatatttagtatctagctttagcctaggatgcaaaagtccagtgtgtccacatagcggtagcatgatttgaatctaacaaatttggatacctagtttacctttttttttttttaaacagcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggaggtaggttcatattgattttcaggagagttacgtggtatgaacaagcactcttcacttagaccatcctatgaccagtaagaaggtattccattttattttcatttataaaattttctatactcatttaccaacaaatttgcatgaaagtgagagcaaaggataaaataagcatttaatagtatgattagatgtgaattagacttaatgagatataataaaatggccaaaagattgtaatggtcaaaattaaggactggaaaatcctagaatgagggcattaaattttgtgaaaggcgaagggaactgtcatttgtagagggtatgttgtatacttgttacagtgttattacgtagaatcttttatttaagcaccattcatccattcaaccagtgctttttaagcactggctattcatttaggaaatatttatgcactgtctactttgtgtggggatggggtggtggggtggggtggggtggggaaggtgggagagacacaaagaagtaagccctcccctgtctttttttccaagggcactaatcctatcgtgagagtctaccctcatgacctaatcaccttctaaaggctccatctccaaatatcatcacattggggattagagttttagcttaggaattttgggaggacacagacatccagtcaataccatatttgaacattttatgtcactaatatatatactagagtccactttttcacttgacagaaatatatttccaatactgttaaccattctttatcagtatctttttaagcccaagcatagttgtttttcagttgacttcataatgtacttcacttttcaaacttagatgaatgtttaggttattttcagttatccttttttaggtaacactatagtgaacctattcttgcatgtaactttaaagattattaaatattatgtctttaggatgaatttcttacatggatttccaagagtaagattattacatcgaaggatgctaatttcttcatggttcttgataattattgttatattttctaaaatataatattagttcatagtatcaccagtagtatatgaatttatcagttttatcataatctcatcagtgattttgatggtgtcctgttgtttcaatttttacttaattttttttatcgtttgaacattttttctgatttgttcactgtttctatattgctttatatgaatcatccatacatgtttttgtccattactattggcgtcttaatatttttccagtggtttttaatgagtaaattttattatatatacatgtattaatcttttgttctatttcatatgtctttcccaaagtattgttttagtttttatttttaaaattaattttttaactttctaattttcggttggcactttaaaaatgtgatattttctattgaaagttttttatttttcaactgcttttgctgctttagatttaagaaagaagtttttacatgattctgatgaattcagtgttttgtttgctgccatttaaattatttgatgtactaaaaagttctttgcagtttgtcctgagtcacttttaatggatagtatgtaatcatcaacagttgggggataactctaccctttccatttggtttggaaaatctactttttcatatattcagtcattatatataaattggggtttttttttgagtttccatactggttttattttatttttatttctttttggtgacaaatctacatattcatacattgaaagaagtgttaagaaggactaaatgtgttcctatgtctttatggcagaacaggtttactcaggagaggattatggtttatttcatgttgcattttctttctgaagttgaagtggaattacagacctgaaatagttatgttgttatctttaaatgatattacagatttgctaagactctcattgacttccagaagcattcacagtttctgaaatagttacattagttttgttcagttctccagatttgaaggcagagactcatttttgatgtgtgtgtgtcttctttggttcttagtttaacgctgggtgtgttaacagaattgattgttttgaactcgattgctttgcagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaagtaagaccacagtttcaaatatataattactaaagaatcaatgcatttaaatttgacctttgtacaaataagattttataaattttaatgaatttttggggcatagtctagaacatatgtatattaaaataaactgtcagtcaaaagagtgttagatattcagtgcttttgttaagaatatcatatagagaattttcctttgacatggaactatgaagagttctcctttgactaaatgaaaattacataatttttatgtgacgggaatttagaggatatatttgtaactaaggcataagtccatttgtgcacattttggagtttgagtttgtggttacgatactttctattagaagtcaggatacaaaactgcaaggagaaatccctgtttcattctcactaaagacccagtctgttaggactggcttcttctcttgtttattaacttatatttaccagtaacctttaaaacactaattgaagaagttttaagcgtgagaaccctcatgtgactgacacagactaaagtattgacaaagcaagtgaagaagcaagtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgtgatctttctgactagaaataattactcttttttttttttgagactgagtctcgctctgtcacccgggctggagggcagtgttgcaatctcggctcactgcaacctctgcctcccgagttcaagcaattctcctgcctcagcctcccgagtagctgggattacaggcacatgccaccacgcctggcaaatttttgtatttttagtagagacggggtttcaccatgttggccaggatggccttgatctcctgaccttgtgatccgcccaccttggcctcccaaagttctgggattacaggtgtgagccaccgtgccctgccagaaataattactcttaacagtttgcaggatgcattccaatacttgttttcccctctgtgtatgaatgtatgagggtatgtaaagtttctctgcctatattttattttttaacaaattaatttatttttaacaaattaagatgaaaatccaatgttactttttaaaatatttttaaaatatttaatgattactaatgattactaatgtaatcattagtaatatgtattaaatgttgataaattagaaaataaaaaacacacattggacacatgtttgcacacacatgcatgtccagtttatatggataaactggagataaggaatttatatttaatttaaattgctgaaatgtgctgctttagaaatgtatttttttttattctttagtgcaaagtttattgaaggtgttgtgttacagttattagaggaagatgatgttgtgatgggagttcagtacaaggataaagagactggagatatcaaggtgagaaataccaaatgtcacctcttcctaagagatgttgtttttcctgctttttcacttacccctttaaaaaagtaggcttaccggtttacatgttgagtatctcttatctgaaatgctagggatcagaagtgtttcagattttttatttttttcagatgtttgcattatacttaccagttgagcatctctaatctgaaaatctgaaatttgaaatgatctaatgagtattttgtttgtcacattactgctcaaaaagttttggatttcagatttttggattagagatactcagcctgtgttatttatcaaatgaactgagttctttctaagccatatgcaacaggatgggtttcagattgcaacacattgttctttagaggacttcagaatgctatgcaaaaaacattttaaacagaactaatgtgaatagtttttgaaacagtaatatacatcagcagagaagcagaggggaactagcaggggaaagaaggcaagattcaacataaaagaaatgattcagataaaatgagcaatttaactcaggtaatagtaagagaatctttttaaaaacaatttatccttttattttattttattttattttgttttattttttgagacggagtttcactcttgttgcccaggctggagtgcaatggtgcgatctcggctcactgcaacctccacctcccaggttcaagcgattctcctgcctcagcctcctgagtagctgggattacaggcatgcttcaccgcatccggctaattttgtatttttaatagagacggggtttctccatgttggtcaggctgctcttgaacttccagcctcaggtgatctgcccacctcagcctcccaaagtgctgggattacaggcgtgagccaccgcacccggccaatttttcctttttttaaaaaaaaattatcgtagtaaaaaacatgtaattctggactgctccccatagggttaccacctcttagaaattgtcctctaatgaaggtgactggaatgttttctctgctcatactgtagtattataaatacatgtagtcatttgtacaaaaattcttctaagccctagctgctgactaaaagcactatatgaagttaggaaattttagaatgaaagaatctggctagtcccttgaatttgtaatgagattgactgctctgtgttacatgcctgccttgtagttgtttcccccattgtctgtcaaagtggagagtaatcccagatggtttgcatgggagggctacaaagggagatgatcctcagggactcagaggaagtatctaaacactggtcatgcgttatctgaagcccacgtaacagtttcttcaatagtattatcttcaactactctctataatgctatctgataatatatctaaatctcttcacgcacattttttaagaatggctttttttgctgtgtgtttctgactactaaactgagtagtcttcatttctgttataggaactccatgctccactgactgttgttgcagatgggcttttctccaagttcaggaaaagcctggtctccaataaagtttctgtatcatctcattttgttggctttcttatgaaggtactgtaggagtgtgttattgtaatttcaataaaagaaacttgaaatttgaaaattattaaaacattttctttttatttgttttagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctggtaagaaatagcatcttcagttcttacaaaggctgtgtctaaaataggccagagataaggatggcaggtgaaacattcatccagtcaaccagatattctggaactgaactatttaaactagcacttaaaaacagcaaaacaaactcccaaattaataaaaaaaagtttcgggccgggcacagtaggtcatgcctgtaatcccaccactttgggaggctgaggtgggcagatcacctgaggttgggagttcaagaccagcctgaccaacatggagaaaccccgtctctactaaaaatacaaaattagccgagtgtggtggtgcatgcctgtaatcccagctactcaggaggctgaggcagaagaatcgcttgaacgggaggcagaggttgtggtgagccgagatcgtgccattgcactccagcctgggcaacaagagcgaaactccgtctcaaaaaaaaaaaaaagttttgatatgtttttgtcacataatagcatagtttttagaataattgtttttattggcatatatggtatttttaaaggtagtctctggacacgaatctgactctgaattctttatctcttatacctaaatatttttgtgcttggtttttgtagtaatgacagctaccatttcttgaatgcttactataaagtgtttagcaaacataatttcatttaatctatgtaaccactctgtgaggtaggcattatcattattctcattttacagatgggagaactaaggttcagagagattagttagctcctccaagtataaactattagtaatggcagaaccagggttgatatcaggtctgtctggctcatatgtgcctgtttgaacagacatgtcctgtccgcagaatgtgagaattgtaagggatcttcaggatcatgttagttttgagttgaatataaaggcttcatgagatttagatagctttgtaaaaacattaataaaaattactttttcacaaatctaaagttttcatggtacagtttttaggatctttttttgagaatgggatgatataggaaagaaaagtaaaaaaaatttaagaattttgataaaattgaagggaaaccctcattgtcaattatgatatgattagagtaataggaaactatttttggtatgagtacattttgtttaaatattccgtttttttcaagttattttttaaactaagtgaaaccactttagtaacaaattattaacagaaatgaagtgaaatgaagtgggcaaacttagattttaaataatgacattttcaacatgtacatggaaacatttcaataaattttcatttagttaagccacttttgaagctttcagatggggaaattatgaatatttatgaaaagggtcatccattacctgatatttttagcatttatttttcttttattgtaaatgtggtggtttttcttttttttttcttttttccaatccagaggttaattggagtagagtgccctgaaattatggagagaaaccattggtaggtttatattaatattagttagattaccaagattctactccttaatatgaatggaataatttttaacagaggcttctgctcctctattcccagatcacactgggaattgtatgacagttcattttctatataagtagcacagaaatttaaagcttgtttggaagtatctcagagatgagctgatcaaaccatttcatttttatagatgaagaaattgaagctcagagaggtagggctggcctcgaattccttttctagtgtacataccctcctgctgtttgtgaattggtagtgtatttcatctgattattacaagaatatattgattataatacattaaatattaaatatgacagtagtctgttaacatttggaagaaaggtaggtggttttctccctgtttcatttcatctgaatttgcctcattgttttttcattcagttgtatgtatgtttatattaatgttctcttagattccttagtcattccttggcattaacagctaagtgcttaatgaataattttattaatgaaataattagttcttgatttatcacaagggatatatgtaacaaccataacagatgtatagtaggcatttgtttatacttgataagaaaatatgtgatactttgaaattgaagtgttatgacccatttctttgggttggtgggatttattgcagatcacctgaaagaaccattcttagaagccactgacaattctcatctgaggtccatgccagcaagcttccttcctccttcatcagtgaagaaacgaggtattattttttgggcttattttataaaggaatcagtattccaaatgacaaatatatgattaaatttatactgttacgaataacttctgggacagatagtttgtcactgtggattagtgcattattaataccaaaattagttttatgatctatttagttattaacattgagtgtatagaagtattgtgctagtcagggaaacaacaggtaaaaaactgaccttgacctagagaaggcctttttctttttttctttttttttttttttttttttttttttttttttttgagacggagtctcgctctgtcacccaggctggagtgcagtggcgggatctcggctcactgcaagctccgcctcccgggttcacaccattctcctgccttagcctcccgagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcccgagaaggcaattttctacttaggaatgtagacagataattttacaacactgttgataaataaaacccacagattcagtgtcaagaagtgtgcagagcagggagggaagcttgtgaaatgggaggggtagttagggaggacgttgttcaggaaacagtggaaacaaaggaccttggacctggaggatgagtgggagttcatgaggtggacagtaagatgaggaacttctaggtagatggaataacattgccaaaggatgagaaatggtggcactttcaaggaactcaagcagtttcctatggcaggagcatagggtgggtgtcagagtgggagacagaccattaacatttaatcttacagacaatggaaagtcatttgaagtgttttcttgttactaactttattgatatataattcacaaatcagtttgcccatttaaagtgtacagtacagtgacttttttagtatattcacagtgtgtgcatcaccaccacaatcaaatttagaacatttttatcttgcccaaagaaaccccgtacccattggtattcactccccatttcctcccaacactcagccctaggctacccctaatttactttctgtgtctagatttgtctatttgggatgtttcctaaaggcattgtatagtaaagccctttggaactggcttttcatttagcacaatgtttttgaggttcattcatgttgtagcatgtttcagttcttcatttgtttttatggccaaataatcttccactgtgtggctatattacattttgtttagccattcatcaattgatagatatttgggttgtttctactttttggttattacaagcaatgctgctatgaacatctgtgtgcgagtttttgtgtggacatatattttcatttttcttggttatatacccaagagtgatattgctggattacatagtagttcacgtttaactttttgaggagctgctagacttgttttccaaaatagctgtcccagttacattcctttcagcagtgtgtgagttctaatttctccacatccttgtcagtgaacacttgtattatctttgtgtgcatagccatcctagtagtgtgaactaggccttttatcattgtgctgatttgcatttctctcatagataatgatgttgaacatcttttcatatgcatataggccatttgttgtttggagaaatgtatatttagactttgcatatttttttaattgggcagatttaaaatttatgtattgttgagtttcaagagtcctttatatattttaggtacaagtcccttattagatatgtgatttgcaaaatttttctcattctgtgggttttctttccattcttattaatggtttccattgaagtacacatggtttaaattttcatgtttattttttctttcgttgcttgtgcttttgatgtcatatttaggaaggctttgtccaatctaagttcaaaaagatttactcctatgttttctttttctttttctttttttttttttttttttgagatggagtttcgctcttgtcgcctaggctggagtgcgatggtgcgatctcggctcattgcaacctcggcctcccaggttcaagcaattctcctgcctcagcctcccgagtagctgggattataggtgctcgccaccgtgcccagctaatttttgtatttttagtagagacggggtttcgccatgttggccaggctggtctcaaactcctgacctcaggtgatccacccacctcagcctcccaaagtcctgggattacaggcatgagccaccatgcctggcctgttactcctatattttcttctaagagttttatagttttacctcttaaatttagctctttgatccattttgagttaaattttgtgtctgttgagaggaaggggtccagcttgatttgtttgtgtgtggatattcagttgtcccagtatcatttgttgaaaagactgtttgttccccagtgaattttcttgcccttgtggtcaaaattcccttgactgaaaggtaagggtttctttcaacaatattttgtagttttcagagtataagttttgcatttcttttgttaaatttattcctaagtattttaccttttttgatacttttgtaaatggaattttcttaaagaggcagtggcatgattagacttttatttcaggaatatactctgacatttttgtggaggatggtttggaggaaagtctagtaaaacatacactaagattaattattctgtcaatgatgataaaaggccagaactagggttgtaaaatgaaaggtaatgaataaatttgggtaatatctaggatgtagaatgtaaaaaacgtgatgatttggatattataatgagagtgaaatctcttgatgtaaattccaggtttctggcttagatagttttgccagccatttgctgacataggaacaggaaaaggagttaattgggttttctttcttttttcttagtttgtcttaaaggtttgctgattttatcttttcaaagaaccaacttttcattttgttatcttttgtatttttttcatttcatttattttggctctgatctttattattttctactaatttggggtttggtttgctcttgcttttctggttgagatgcactgttaggttgtttatttgatgttttcctgcttttttgatgtaggcacttactgctaaaaactttccctttaagtattgcttttgctgtgtctcacaggttttatatattgtctttgcatttttatttctatcaagaaatttttatatttacttcttaatttcttcattgacccactggtcattcaagagcatgtggtttaatttccatgtgtttgtatacacagtctccaaagttcctcatagtactgatttctagttttattccactgtggtcagagaagatacttgatatgatttcaattgttttttgaattttttaagccttgttttgtggcctacccatgatctatccttgtgaatgatcgatttgctgaggagaagaatgtgtattctgcagttgttggatgaaatgttctgtgaatatttgttaggtctgtttggcctgtagtccagattaagtctgatgtttgttgtttatctgtctggatgatctattcagtgctgaaggtggggtgttgaagtctccagccatgattgtattggggtctgtctccttagctctaataatatttcctttatatatctgagtgctccggtattgggtgcatatgtaattgttacatcctcttgctgaattgacccctttatcattatctaatgaccttctttgcctctttttatagtttttgtcttgaaatctattttactgatgtaaatatcactatgctcttttttggtttccatttgcatggaatatctttttccatcccttcattttcagtctctttgtggctttataggtgaagtgtgtttattttaggcagcagatcgttggttctttttttaaatccattcagccacttacgcctttcgagtggagtttagtccatctacattgaatgttattattggtaagtgcgtactattgccattttgtttttgttttctgattgttttgctgtcttttcttccgtcctgtttcctttctgtgaaggtaattttctctggtagtatgttttaatttcttgcttttaatttttttgcctacctcttgtaggcttttgatttgaaattaccaggaagcttgcaggtcatatcttataaccgattattttaaactgatgacaactgattccacaaacgagcagagaaaactaataaaaactctacactttatcctccttgctttttaacttttgtgagttttgtaccttcatgtaattgcttactgctcgttaaggtccttttcttttagattgaagaactcacttcggcatttcttgtgggaaagtttggtgttgatgaagtccctcggcttttgtttgtctgggaaagtctttatttctccttcatgtttgaaggatattttcactggatatactattgtagcataaaagttcttttccttcagcactttcagtgtgtcttgcccctctctcctggcctgtaagatttccactaagtctactgccagacatactagagctccattgtttgttgtttcctttctcttgttgctcttaggatcttttctatatccttgacctttgggagtttgattattaaatggcttgaactagtcttgtttggattaaatcaatcaccaatccttgcttggtgttctgtagctttcttgtgcttgaatattgatatctttctctagatttgggaagttctctgttattttttcttcaaataaactttctaccctcatctttctctatctccttttaaaggccaagaacttagatttgctcttttgaaattattttctagatcttgtaggtgtgcctcattcttgattattcttttttcttttgtctcctctgtgtattttcaaatagcctgttttcaagcttactaattctttcttctgcttgatcagttctactgttgagattctgccatgttcttcagtaagttaattgaattttttatctccagaatttctgcttgattcttttaaattatttcagttgttttgttaaacttacctgatagcattctgagttccttctctgtgttgtcttgaattttgttgagcttctccaaaacagctattttgaattctctgaaagctcacatctctgttactctgggattggtcactggtgccttatttattattgttaatttagtgagttcatgttttcctggatggttttgatgagtgtggatgttcaccaatgtctgggcattgatgagttaggtatttattgtggtcttcggagtctgggcttgtttgtacccatccttcttgggaacgcttttgaagtattcaaagggaagtgagtgttgtgatctaagtctttggtcatagcagccgtatctgtattaaggggcaccccaagtccagtaacattgtgacccttgcagacttgtagaggtaccgccttggtggtcttgggtaatatctgggagaattccctggattatcaggaaaagaactcttggttctcttcccttactttcccccaaacagagtctgtccttctttgttgagctgcctggagctgtgggggacgggtgacacaggtatgcctgtggccaccatgactggcgtgtgctgagtcagacctgaagccagtacagcactgggtattggtgaaaggcttgtggtgatgactgcctggtcaccgctgatgttccctcaagactcaagagctctacagtcagcacaaatccagccaggcttgtgcccttcccttgagggcagtgagctcctgggggcccaggactggtccagaaatgctgtctgggagccagggcctggagttgggaaacttaggaatctacttggtgctctattctactgcagctgagctggcacccaaaccttaagacatattccttcccactcttccctctcctttcctcaagcagaaggagcctctccccatggccaccagtgctccaggcctgcagtgagtactgcctggctgctgctggtgttcactcaaggctccagggctcttcagtcagctggtggtgaatgctgccagacctgggtctctcccttcagtacaatgggctcccctctcacccaggacggatccaaaaatgctgtccaggtgccaagacctagaatcagggaccccaggaacccacttggtgctctgtctcactggccaagctggtacccaggctgacttttggttcttatgaaggtgctttcctgtgtgggagggggatgatcgccagaggacttgctttgtatacctggatacctgtagattctttttattttcttcatattttaaggaggccttacaaatgtattgacattattggacttgtcattaggtttgtatatgagcttcatgagggcagaggccacactcttgttattaccatatccccagtgcctggccacctattaggtacccaacattgattcaaacaactcttgaatttttgcctcagcaaattttaatcatgatttgttttcatgtattttcacatttttcttattattagcttacatcagtaatctttatacattgagttatcctttttgttttgtctcaagggatgctctaaaataaaatcttcattacctctcttcataggtgttcttcttttgggagacgcatataatatgaggcatccacttactggtggaggaatgactgttgcttttaaagatataaaactatggagaaaactgctaaagggtatccctgacctttatgatgatgcagctattttcgaggtaagatcaattattttgacaaaaatgtctcaaaatggatttatttctgggggttaagagcagtggggctctgatggggagatctgtactaaggaacctgatgctttataatagctcttaggcatcttgcttaggcttaaagaacctgacttgcaacctgtgaatcttagagaatttctaaatttgaatattatgtaacacttgattgctatgggccacttagctcatagtggttgtaaatttagcttcagtgtcatataacccattgctctgaaggtgattttttattttttttgtaaatgataaacataaggcaatattacttgcagatagtccttagaaggataagtatcagtttgaggggactataaacatcagtttgtgcttttttatccttaccatataataaatgagctatttcttttttaggccaaaaaatcattttactgggcaagaaaaacatctcattcctttgtcgtgaatatccttgctcaggctctttatgaattattttctgccacagatggtaagtgtagacactttttagtgaatattactcaattgcagatttttagcgtaggaaaggaataaacaagttagtgatttgtccagaaataaaaatgttacctgagtttgctaactcccaagttggtagttttttaaaattccattttgagcaatagttgtagttttagttttagtttggaaggtagtggaatttccttagacaacattaatagcaatgcctcagtaacatattcattattttgaattcctctggtgcagactagatcatgcttgtcctcacacacacaagactgtgatggaaggtgtttttggccatgtattaaaaggcaatgtagtctttttcttcctaacactagtttcaatttctttttaaagtagtattttataaaatgaatacaagctgttaatcttgtccctgttgaaaagcacaagtaacaatgcattcaccctttacttatttggattattttggtgcttttgtttctgtttccatattatagagaggtcacggtcaatgtatatattagagaaaacacaacttagcagaagcagtgttagaaatggaggaaaagaggccaggcgaaatgattcatgcctgtaatcccagcacttcaggaggccaaggcaggaggatcgcttaaagccaggagtttcacaccaacctggacaataaagcaagaccccatctctacaaaaaattaaaagatcagcaaggcatggtggcgtgtgcctgtagtcccagctatttgggactatatagctcactacagtgagctatatatagtgagctatatgaagtgccactgcactcagcctgggcaacagagtgagacttcatcttctaaaacaaacaaacaaaaaattaaaagaaatggaggagaaaaggcaactgtgccacctcctcaccacagcagtgtacacatcagtttaatagtaggttaatgaaactaggcttttcagttttcaagaataaatactgactcatatgccactactctagtatatttgcaacatagctatttgtatgatctggctgaggccctagtgataagtgctgtggttataattacaaaagatgatacaataaaaatgctttctgtagcctctataaccattaactcttcctaaggaaaaaaaacaaaacaaaaaccccaccaatctcactggttatgatttttccaaacaaatttctcttgctaaattggcatagaagttaaaatggctggttgggcaaatgaaagtaactaagtttagagttttgggcaaataaaaagaactaagtttagagttttgggcaaataaaaagaactaaatttaagagtttttctgagctcttctttctaagcttttctaacttcttgagttcttaacattatgaatttaaatctaccaacaaaacaacattttttaaaagttacaagattggaggaggaaagacctttattggagcaaaagtttacctgttgcatcctttactttttaaaatctgttgtaaagaaaaatctgggcatacctgaacagaacattgattctaaatggttaaaaaggttatcaattgattacactacattgtgagggttttatgagttactttgaaaggtattaaaaactttatagatataaggaattattatttatcgctactcacagctctcttcacttgataatttactgcttagttagagatactggttggacatcttagagactaggaatttggtttctagaattgtgttaaaaagagcttccaaagtattttgcatcacttaatgaattaacagcaaaatcaaggaagtaccttttaaacaactcttccaagacctaaatattagtagttttttactaacagaaaaaagtttattcatatttatattactctccataatgctgattatggaattcagaagaaatcctggttgttgaaattctaggactagatatttaaaaattatctgcaagatgtagcgtttgttatttctcattttttctgatatatcattagcatcctacataagtgtgtacacatatttgattattttacaattttattttagattccctgcatcaactaagaaaagcctgttttctttatttcaaacttggtggcgaatgtgttgcgggtcctgttgggctgctttctgtgtaagttgtgatggcacagaggatacaaacctgccagattttcttaggactgttcagttgatgaattactgcaaatctttcctccttacacattttgatattttattatctgttagtatcccaatgagaaggtggcccaaagaaatgaagaaacgcaatatttagtactgttttctttctagggaacagcagttaaaggtggtggtagaggaagctataacccttgattaaaatagaagcttgttttttgcctatggatttatccatatgttctggtctgtgggagccaggaataattgagaaattttaatttaagaattagtttcattgaagtacagggacttatacaacccagtattagttttgagcgtacagacatatgtggaactattcttggaaagtctacaaagtgaaatctatcgagttatttctcatttgcaaagtgatcctttgagtcatttctcataatctataatctgaatgttaatactggtatttttaaaagccctacatcccaacagaccaggccatctagatatttcagcgtggtgtctcaggatgagtaaacaaacagctaaaaatatatgacttatgtaaactagagttacaggagttactagcttttctgaaagggatatattctaagtattttttcttaaaaaaaaaaaaaggggggtggggggtttgctcctgccatcaaacttaacatgcagacatatttgtgacgtcctctaaaatgtagaatgtttcatacagaattatgatgcttgggtaaaaaaaagtaggatgtttgttgagcttcgtagattatatgtaattggaacctttggagtaaattttagtttctgagtcttaccaatatgtatttttttctattacagattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaactttcgtgtctttttgtttcttgttgtgggctcgtttacatagcttcatgataatgaaaaagaaaaccaaagtgggatgaaaagtgcagagggaaacctgttctattaaataactggggaagttgccttaatgtcttgaccttgatttcctcatctatccagtgaagcaatttgataaggttattttctttaaaaaaattacttatttatttatttattttattttggggctgtgactcagatttgaaccgaaaggttctttgctgagttctctgaaaatatcagattctgacaggaaaggcaatcaagggctttataagttccactgtatagcaacatttataaggcagcccaggatgacatcaagaaacagtgagtgaacaagtaagcacttgtaatacccggcataataccttaaaatccgttaggatttactgagtttatctatagtaaatttgaagagactatggatgttcaaagggtatcatcataaaagttcagtaaatctccaaataccatgaaagtaaattgttacttctgaaagagcagtaaaatataacctggcaaatgaagttactacttgagattctaacagggctaaaatataacttacaaagcttttacaataaaaatttcaatttttaagttttttcagttgaaaaaaattcttcactggccaaatcactagcaaaatcagtttcaaacatcactgccttgttttagtagagcatatggtggacccatttgcttggtttcgtaagattcccatctaactgaccctaaacttctattttctggttaaaaactcactttcccagatctggccttcttagcagttagttagctttctttttcgagaacaaagatctcacttcatgtggttattgttaacaagattacaaatgaaaaataacacgctatcgttgagatatagatgttcccacacaccgtctttgcagggggtgagacttccaagctccctacgtaccaagcaacagttctcttaaaattctgccctggcctcggtgccctcatggccaggattcgaggttacccttgttcgccactgagactcctttaaagtcctttctactatgatagtgaaataatcaaagcctgtaaagtcttttcttcccttcaatatcagaatttgaggccttctgacaaaagaaataaaatgagaaaaccgaaggaacctgagaaatcctttagtcctaattttacagatgatgccagtaggctggcttgggacaaggtgtagcttgtggcagaaccaggactcaaacttaccctcctgattgcaaatcagtacatcttcccccaccactagcaaaatgactgtcaaacagattttggcttctgggtttggtttggtttgttccttcctctccagagaaggacataaccatagagatttagggtggaaacatctttcttgctctcatccaagttgttgatacccaagttgccacagtaggatggcagtgatatggtgtggctctgtgtccccacccatatttcttcatagcagtgtgagaacagactaatagtggcagcttccttttcagggtaattttcatgcagaaatgatttaggatttcgagggagttaagcttatgggaaggctattaccaaaaaggactctggataatgatacggttgtggggacttggggcaggactcaggttgctgaggaagataccggaaggagcagctttgttaaggagtcctacagaaggaatgctgtggaccccctagggcatgtgggattggaagaggatgatgagacaccaagaaacttcaatggcacatgacacagattgtgtggccactacatttgctactagtctggctatcaccacgtgcctgccagcttgttgggggtgagctattatacctagcagagtcatctcttattccaaacagggttttttacagggtgaatacacagtttttgaatcataagcgagacgactttgggtactagtaatactattttac

SEQ ID NO: 17026 - DNA, 190078 bp, Human; identical to SEQ ID NO: 12707
  misc_feature (1)...(190078): n = A,T,C or G

SEQ ID NO: 17027 - DNA, 48135 bp, Human
ataaattttcatcaagaagatattttctagattcagctttgatgagctaatttaattttagaaaaatttttctatacatcatatgacattttcatttttttattttcatttttgttttatttaaactattttcatagataccaattcttttccatataaattttatgccacagattgatttcattgatctttttaatgtctatattaaattttattgataatatttgtaggctttgacattattagttttcttcttgagattgttatttatcctaattatcttgggccaaattttgtgggtcagggaattttatgttgactgttcctatcaataatctttattaggaattggataagagactgattatatgtatttctcagtaaatccatgatgaaattgtgacaaattctttttagatatgctaaaaattaatctgttattcagattgtggtattgcagggatcagcaaatcagggtcatgtgagctaaatctggcccgatacttgtagggctgcaagttaaaaatggtctttacagatcaacttttgcaatctatttaataataggcaatactaattttaatcccaattagaagaacattacccacacccccaaaattaatttaattcttcttattaatagacatatattacaaatattatattcgattattactattacactggattttttttttttttgaatcttgctctgttgcccagactagagtgcagtgctgtgatcttggctcactgcaacctccacctcccaggttcaagtgattttcctgcctcagcctcctgagtatctgagattacaggtgcatgccaccactcctggctaatttttgtatttttagtacagacggggtttcaccatgttagccaggctggtcttgaactcctgacctcaagtgatccactcaccttggcctccgaaagtgctgggattacagatgtgagccactgtgcctggccttacattgaattttattaataactatttcatggaaacttgttttctctcctgtcatataaattctacataatattcttgatttttactattgatgcacaaaccctaaaatatttactatcatgtcctttacagaaaatatgtgctaaaccctgctccattgcattgctaacctgattcttctgaacactttccctccccacattaaggctctgcttcattggggttacaaagaacaaatggtgaatagcttagtctgttcaggttttcataacaaaataccataaactgtgtgggttatgaacaacagagatttatttctctattatttattctcaacgatttattaattaacagagattcattctcccagttctggaggctgggaagtccaagatcaaggcaatagcagatttgggtgtggtgagggcccactttctggttcatagatggctatcttctcactatcttctctgtcttctcagaggggagaaagtggtatgggggagctctctggggtctctttcataaagacactaatttcattcataagactcatgactgatcacttcctaaaggccccaccttcaaatatcatcatcatctgggggattaggtttcaacacacaaattttgggagggtcacaaatattcagtccatagcagtgactgaggtccctatgtttttagggttgaaattgtagtctgtcctgcttcagttaggaaaatattaagtggatgagtgtgatcacattgctcagtgataaagggaaatgctctttaaactctaacacattgtgtcaaataaaaacaaaattgacatgagagttttaaaataaaagtcaatttcccctttttagtattaaagtatgatgagtctaacatgttggaaaagccaaaatattgtttcaaagcatcaacatttcaaagaaacatagtcttttgaaacttgggagagtcgagaggacttttactttttcctactgtttcctactgaagttagcttctttttctttcctttaacagatgaggaaaaagaaaataatagagcatccaagccccactccactcctgctactctgcaatggtaagtttccatttttagcaagttctgtcttcagaggatgctcatatcttcttgtctataggataggatatcacttggatattttaacattgtcctgataacttgacattccacaacatgaaatctatttaatttgcagtatatgtaaaatgctcaactagccttagatctagcctggagattggaatttttgtattttattttagggtagatgttttttctgttatccaaacactggcaaggactggattccccatgggtattattaattgattttaatagaatccattattacaatttataataaaaacagaggtctgttgactcttaccaatgaacccttaattcataatgaattacaattgtatataattattttaacattaataacactaacaagagtaatctactagaatggctttctctttaatatttggcattcctgggcttgatgaaatatttaataatgtttaagtggttgcacttgtgtttgatatttacagataaattctcctctaaaagctttatttggaaattatgttgtagctttgaacactagagctctctatgcctgagattcaccctatgaagaatcttggccattgaaggcgattattcccctagcagtgcagccgagcaatatgaaggaattaaggaatgacggggaaggaaagagaaatggggaaaagaaaggaactaaaatccattatatgcacccctccaggctaggcactttatatatatgcctcatttcattctcacaattctgtggagttgctattgttgtgcccatttaactgatgaggaaaataaagctgaaccagttaaaccatttgcctgaatagccacacagccaatcagtggcagaggcaggaagtggctgggtctctttaactgcaaagctcatgcttgcgaagaaaggaaaagaaacatcaggaaggatagagaagagaggacagatcagaaaaggaagcagatgggctttaatgagcaaatcatattagattctctagtctaatccatccagaggtgagaggaaaacaacactgggagaaagcattcaggaacgtaactcaatcttctctaacaagagcctcagcagtcagcttgttttgcttcaagaatagcaaaggttgttttcaagagctctatttccagccttttggcctctttccatcatttgttcctatagactttttctcattgcatttgctgctttttgctttatttaaaattctactttatgtatcagatcaaatctcccccttcacccttctctaagtattatggccatgcaagttcccatagtgccaagacatcgaatgaggcatcgatgtaaaggactctgggagtgggagtttctagacatgcatggaattgacagacttttttttttttttttttttgaggtggagtctcactctgtcgcccaggctggagtgctgtggcgtgattttggctcactgcaacctctactttctgggttcaagtgatcctcttacctcagcctccctactagctgggatcacaggtgcctgccaacatgcccggctaatttttgtgctttttgtagagacagggtttcaccatgttggctaggctggttttgaactcctgacctcaggtgaccctcctgccttggcctgtcaaagtggtgggattacaggtgtaagccaccatgcctggccaacaaacattcttgctttaataacctgaacatgtcatatgtttcagagtaaaaaatttgaaaggaactagaagaaaatcactttgttcacatctatttttctgggattccaggacatctgcctgggagcagtgaggctgtaaatggtgcagtctctgaaatcaaactgtcatggcttaactcccaactctgccacttacaagctgtgaagtcttgggcaaggtccttaacctctctgtgcttcagtctactcacctgtaaaatggggatagcaatagtgtctagctcatagggtagtcatgaagatgaaatgagttgttctatagaaggtgcttgaacagcacctggcatggggtggggctcagtccttccctcagcacactccttccttctgagacccacagggaccacctggagcaggccccgtctcctccctggcataggcacagccagttctccttctatggtacctaattctgcacaaaatatctgtttttctaaataaagggtcacatagatcattccagaagaaatttcaccctccaagtcacaaggtcagacagtgaattttttttaatgataagtctattttcaaagccaaaccaaatctgagaatttgtacatattcgcctattcttatcaaaagacatcaagttgttcaaagaacattaacgtttgctctaattatctttatattatatgtttaagatagaatttcagtcattaactaattcaataaatgtttactgagcacctggtatttgctagctccttgttctaggctctggaaatgcaatggtggataaggtagaccaagaagaggagctgatgacaggggaaaaaggggaaatatctatatctatgtctatatctatctatatctatatctatctatatctatatctatatctatatctatatctatatctatatctatatctattttttgagatggagttttgctcttgttgcccaggctggagtgcaatggcgtgagctcggttcactgtaacctccgcctcttgggttcaagtgattctcctgcttcagcctgccgagtagctgggattacaggcatgcaccaccatacccggctaatattttatttttagtagagacagggtttctccgtgttggtcaggctggtctcaaactctggacctcatgtgatccaccttcctcagcctctcaaagtgctaggattacaggtgtgagccaccgtgcccgtatatatatgtcattaaactaatgacactcagggcacagtggctcacgcctgtaatcccagcactttgagaggctgaagtgggaggatcgcttgaagccaggagctcaagactagcctgggcaatatagtgagaccctgtctctgcaaaaaacaaaaaacttagctgggcatggtggcataagcctgcagtcttacctactctggaggctgagacaggagtatcgcttgagccttggagatcaagactgtagtggcctgattgtgccactgtactcaagcctgggtgacagagcaagaccctgtctctatttaaaaaaacaactaatgattgatagataaacaagtaatgcattagatagtgagaagtgctgtgcagagactttagcttggctaatacgatagtgtctgagaggctatttcaggttgagcagtaagggcaagtttctctgagaaggtgacatttcagtggatacatgtatgacaccatgacagtgtgaaaaccagggacaggggaatgttgcaggtggagagaacagcttctacaaaggccccactgttgcaggtgacctctccagattgagcagagttgtgcctacaggtggtttattagggcatgcgcccagcctccacgcccataggggtgtgagggatgctggaatagacagagggggtgttaggcagtgaagaggttatcacagaggcttcagccaatcctacagggagttctgaggtggagatggccagttaaaaatgatctgaatcaaagcaacggatccagacctttatcccccaaccccattgtccatcactgaatacaggctgcccccagggtgggggtgtaacttgggagaggcggttgccttcatgttttgctgaggatcactccttggaatgattcagcctcccagtagggggaacaatgtctcagtgcctcagggcagtctgggcacactcagcgtccaccactccttcccgggatgggagcaggctgagcttgctgaaggacccacgagaaggtggcccatgtggttggagcatagcacacatggaggagaatgacacaagatgaggtgggagaggcaggcaggggagaggctacataagcagtagggaaaagaaagtaggacattaaacttagataggaacagtcatgcttaaaacggtgtggagaacatgtgacctcctacgtaaagctgcacatgtatcatcttttaaaaaatatggtttcagtataaaaactttctctctcaaaagagagtggatgcaccctccattttacaaggaaaagtgacatgatttacaacgtgtcccctttttgctgtggctgccgtggggttgagagctaaatctgatgcttacagacttttgcaatcacttctttcctttgtctaattttcttcttcttttgctagcttaaaaaaaaacccaggatataagtaaatttaataaatatatttttgctttacttttattttgtttacacaagaaatacatttccttgttaaaaaattaaaaacattataggtaagactccagtccatttctccttgtagttctttgccttctcctcaaaagcaaccctattcagtgagacatgtgtgtgcatgtgtgcacttgtgtgtatacatatgtgtagatatgtattacagacccttccctatgaatttgcacacatatgtatctgtagaagtttctgaagtatggtttttaatttagcattgtctcctttataaaaagcatgcagatgtatcacactaaaaatattgacccgcaacctgttatgctgtattgatccactacttgctttcttccttagtagaatgtcctgaagctacactcatggttcataaagaacaacctcattttaactgcagctcagtgtttagcataagacaatggcagaattaatgttgccatttcccctttttttttttttttttttttgagacagagccttgctctgtcactcaggctggagtgcaatggtgtgatctcggctcactgcaacttccacctcccaggttcaagcaattctcctgcctcagccttctaagaagctgggattacaggcgcgcaccgccacatccagctaatttttgtattttggtagagatggggttttaccatgttggccaggctggttttgaactcctgacctcaagtgatccaccggcctcagcctcccaaagtgttgggattacaggcatgagccaccccacccggcgccacttcccttttgatgaacatttaagttttgttcaaatctcatctttgccattacaagtagggcctcacggaacatcttcgtgtgtgcccccttggacaccgtgggagtgtttcttcatgtctgtatcaagaaacagaattgctccattaacacttaaagtgttgatgggattgcaaaattacccatcaaatggctttaccattttatatcttcatctgcagtgcaaaatacttacaaaacaaaacaggaacctaatgctaggacaagcatctcattctctgaggcatttatgtccttcatgctgtgccctctctccagcggcagtggccagcccctgaggacagagaggagggcaggcccaggaaaggacactggccgcaccactaaggcgcccgccacccgcctgacagtgtcgagctctcctgggacatttggcttgttattggaattgggttaggagctatttgcttctccttcttccccttccttgccacaaaccccctccccctccccctagaacaaataacaccgctctaagaacaaataatacagcagccaagcagcctaaaataattggggacacgtgatctggaggcaactcccagcagaaaacaggcaaatattgtcaaatgccttctgccaaacactttccagcatcctcggtcacgagggttagtaaatcccaactcactggggatggtgagcgctgctggaatcccggccgcacaataacctctattcatgcagagaatttcgaaatggaaagcagcctgttccgcagtcccggcctacttgctgccaacacatgccccctccgtgccccgccctcgcccgccacccttgccgcccttacccagagctccttgtacgccttctgggtggggacgttttcccttccagcaatttactgaagaaatgaggctcttccaaaaaggaggacagaagatcaaattgtcactttcgggggggattggggggagattttcctttcttttgaaaaaaattaaattgaggacttgggtggttgacaagctatcaatattccaaattaatatgaaacaaaagaaatttataatttctctttagaatgttctggaaggtcataggtaagacattgggtttggcactgttccaaagaagaaatacattgacattttagaccagatcacagctgctagatcagactcattggatgtaaccgataactgacattttgcacccttttgtgacttgattcttactcaacagtgacagaacattgctttcataatgtgagttaggtaacatggttctaaaaagggaggctgaacacttttagctctgaacacaaccagtgttgatagataatgccactagatgtgactgtgtccctccggatgacctcagctacagatggagaaaggtcagttaagctggacaacccaatgccaagggcagaaatttctcagggaatgagatgctgtgttgtggaaccacaactttttttaaaaaaagtattttgtgctgtgggtaaatgtgtcaaatggtaaagccatttgacgggcaattttgcaatccattagcatttgaagcacatgcagccagcagctgtgcttcttgatgctggcagggagaaacactcccacacaggtgtgtaagggggcacatacgaagatgttctgcggggccttattcataatggcaaagtgcagtagagatgagtagagtactgggtataggtggaaagggaccactgaggaggtagcttctggtaggggatggtgccaaaatcacctcagctactgtccaggacaaccagagctctgggctgcaaacctgtagcctaggccccaaaagaagcattcggaaccaaatggaaattgcaacactgtgcttaatacattgcctagttttatccaaaaaaaaaaaaaaaaaaaaaaaaaaagaggggacttgaataaccaaaaactgagctgagagattccagaagctacctaagcccaggccttactagaacactaattcagtaggttgtaggtcaaacccagcgtaggaattggatgactactgttctggtccagtttagacattacaatggcaggaataaatctctgattcagtccattgccccacatcagccaaacctacaggttcagcaatcacccgtgggatgccaggcttgtcaggtgatgtcactgctgagcacacctaatcctcatgaaaatcctgtagagaaggcaggacagctacctgtatttaaagaggaggaaaccaaggtagtctctttctacacaaagagggggacattcctgactccccagggaaatcctcaacaacaaggaagctgggtcagctgaagtcccctgagaaatgtcagtgtccacacaaatgcatgtttctgattggctcgtctacttggcagcaaagcatggcttaatggttgtgtaatgaaatagattgtttttttgtttgttttattttgctttggagttttctagacttagcctcagtcctaaccagagcctgtatgagccaaagcccactgttttctattcatttgctgtctggtggtgttatctccctagctcccatcttccttctggtaaactgtcagtttcttaaaggctggggcaagagtagcatcttcttgttcatggctgtattctacagtgcctggcatatagtaggtgctcaataaatgtattctgactaaccaaatgaatgtcagtctctggcacatagtgagaactttagaggcatcatacctgagttcatactttttaagcctagcttttcccagcagagtcgctgtggacaagccactttacttccttggccctccatttcttcctctatgtcctagggcatagtgtttactcatcttgtgggggtagtgatagccaatatgaacatccctagcgcagggtaggcacttgaaaatataaatcaaatatattaatattaaccatgcttttcctttaactacccagatattaagattaataaaataccagaatcccttgacctgtgcaaaagcctgccttccttcttattggcctttcctcctttcccctccttcctcctgcagtgtttactgactgtgttcaggacacagtgctaggaactatgttaacatcaataggaatttggtttgatccctgccatcaaaggactttcagtttaagatacaaaacattacctgaatattccacaatattgtaaaataatgctaattgttactctttattgagtgtcccccacaataaagggcctcaggctgtgcatggattcttgtctagtcctcacagcaagcttgggagatggtacagtttctctcattttacagatgaaggaagtgagagagttcaagtaacgtgccccaggctatatgcttgtaagtggtggaggcaggattcaaagtcagtgatctcaaactctaaaaccagtgctggctcctgatgaagctatttgagccataagctatgaggaaccatggccatccctgggaagtagtgagagctttacaagcagaggatgtggcttttcctacagacataacagcagctggcatttagaccactgcagcactctacatgttattgaatgaataaatgaatttggcagggaggaaaggatgaagaagtggttagcagatggggttgagtgtgcactgaacatagttccatggaagagaaatgtgagttgcgccttgatgcgtggaacacggtggaggaggtcatcccctgcggtaggaaggtgatggatcgtgtgtgtgggtggaaggtgacaaggtgtgtctcaggagcaggaaacgatccagttggctggaaagaggtatacgtgtgggaaagcaggacggaaaaggagccaggggccttggatgccacggtcaggaatccagacttttgtggagagggaacagggagccgttgacgggtgtagactactgtcttgtcctgattgcttagcaagggttttttttttttctacatagtttacagtctcagatctctgtgacaacttcagtgataagttaaaatagttaatatttttaaaaatcctgttgtcttgtaaagtctgggctttctgtaaaaaaaaaaaatcctgtggggttttttttttttttttttggtaaaagagaatgaaaaagtttctgttcttgacatgtgtgcaagaacttgaggagtgggcactttgaactgacgcagagcgacctttcctaagaatacatcgatcatgctgcccccatgctataaaacatctaatcagtttaaaagatctctgcatatacatataagaaatcacaggtttaaaatgaggacagtgggaaatgatgccaggtgccgaaacatttgcttttcattgtaaagtgctgatacaaagcttcctccatgtgccttaggaggccacatgctgaaaccttgtgaggaagtcttcttaaaaatatataactcagataatgactcatgttagctagcagactgagctcattatctctccataataggataggctcaattcaaatataatcaagttgttaaatagaagataaggaaaatggaagaagtgggaatttttttgtgatcattaaaaaaaacccaggtataatggagcattgttcaccatgtcagactaatgatgtcctctaaaagagaggaggaaacgagaaaatttcatcagatatgaagaagaataattaactgcctttctttctgccatgctttggtcagggaagtggacattccaattagcaactttagtagataggcagaacctctggttttgggcaaaggtgtcatgatgctattcctgtagaaacttatcaagcatcaaaggggcccttccatgccaattacatccatttgttcatagagcttattaaaatgcttcatagttataagccacctagttactttgaggctcagaagctccggaaagaggaacaaaacgtgggctgaaatgtagtaatttaggaggctctggcctttgacaggtaactgtttaattagcccagcctgtgtgaaccatgacttacacccatctgatttgaatagtttgttgctgctatgggttcatttgatgtgatgtttcttaaccatgatcttgtattttaatcttgacctcttggccagatttagtaagcacacaagccacaagaacagcaaatggaaactgaggcacaaggagcttaaataaagtaacttacttagaaactcatgctgtttaatgctgcatttgaaagcatgattttcacccttaactgtcctctccttctgcatttctggtagtggagaatggagccccccattcatccattctgcccagttaggaacctgagggtttgcttggttactcctgtcctcctcacatctggcagcatgaggcccacaccctaagtgttacctctgcccccacaaccattgcttcagttcatgccccatcatttcctgccagaactattatagtagctcctaattggtctcctgtgttcattcattcattcaacaagtcctaattaatcagccactatgtgccaggctttgatcgtcctcctgggccacctcccctagaggtacagagcaaactttccaaagaatgcattgatcatgccactcccatgctttaaaaaatctaattggttttaaaggatttctatcaatttaaataatcatatgcaagatgaattctgaatggtttgaaatacacatttgtttagtgtgttcatggatttttttttagccaaaataaattctaggaagccattagcaaaaataagcaaaaagggatacttttatcttccccacagcttgtcatacacaaaattgcagttgcccaaattgttcatgtgtatgcatgagactggaaaatgttccactacaagtgttgaagtcaaatctcttaaaaattgcttaatggaactctcaaaagtcaaagatggccaggcgctgtggctcatgcctgtaatcccagcactttgggaggctgaggtgggaggatcacttgaggtcaggagttcgagaccagcctggccaacatggagaaaccctatctttactaaaaatacaaaaattagccaggtgtgggacacctgtagtcccagctactcaggaaactgaggcaggagaattgcttgaaccggggaggcggaggttgcggtgagccgagatgtcgccatttcactccagcctgggtgacagagcgaaactctgtctcaaaagaaaaaaaaaaagtctaagatgatacctatgagacaggtgttttgttgttgttttgttgtttgacattcttttattatactcaagccattcctggcaaatagaacgtattaagctttaaattaatgtcagttattgttgttactgatgatattattattattatcatcattattattcctatagcatcccggaagcactcaggtcttcccgactcctttgagtctttgtttctttcagtcctcctgagtacaattctaccaccttcttctgaaaataacatttttatagtaactcttgaactccaagtgggtgctaaattcttaagccaaatcatatccatttgtgtggcatttaaagactccctccacctcccatagttcttccctttagataccctttccttctctctttactcagatcagcatctccatcattaaaagcacatggcactgtctcccatccttgctgttctacttgcctggaacctccctccctcccccaactaccgtggcagaataccagagagatttggaatgagacaaaccctcctatttactagctgcatgactgggcaaatgagttacaccctctgagcctcagattcctatcctgaaacatatgtataaatacctacctcatgccatacggttattgtgaggtcaaatgagaccatggatacccagtgcccagcacctagtaagagctcaacagatgctaactgttgttgttacacaatcctaaacccaactcttctatgaaactttaattatctactctcatctacacatcaatctctctgttttcccaccttcaactgtacctatggtcaggagtttatagtaattaaatattatttcttgtgcatatgtctccccaaatagactgcaaagttaactaggacatagatcatgtcttatgccaacacaagtgcctacaggagccagacaaggaacagaaaatagacagggtacaaagaaatagggaggagtgaggactctggccaacttcagggcacatgtagctctggccaattgttgtcgtgcgggaatatgggtccagtgttgccagatctcagctttttcaaaagaagccagaaatccagattcttatgtgcaatgtcctgaattttaaaaattgggccaacactgttcaggccaaaacaaagcatgtctgtgagaccccagtttgagaaagctgtcttattcagatggcccctacaagtttgtacgcgagctggttatttggacctctgaactcacttttatagagaaacaatgccgcgaatggcagttaggggtccaggctaacctcccaggctgattttcattcatactggacctgaaacttaggacagtcctaagaaacctattctttatgtgaaacccttttcccactggaaaacacacttagaattccaatttatgatgtcaaagacatacatcagaatgtaagcctgttcaggacaggaccattgttttgttcaccactgtttccttaatgtctagaacattgcctggcacttagtaaatatttgttgagttaaaggttatctgtgtctttgtccatctgtctaccattaatctgttcactgtatgcaagcatggactatcttgctcactgtgatatccccagcgcctggcaggtgataagatcaataaatatttgttgaatgaataaatgactgaaataatctatccataagacacttactgagcccctactgtgtgccaaggaatatgctggacctcaatgatgcagaattgactcagacactatcccagcctcaaggaatttgatcacctagaaaggattacatcaactctttctgggaacatttctaaaaactatcccaagttactcaatgttccccatcccagaagcgcgggaagtagatgagatgatcggggactattcagcaccaggttttgtcttggtgctgacaggtctgtgtccctagggttgtattccccctctgtggggtttgggtatgaaatgattgaactgatgttcttgcaatcacatgttggaataagttgagcgagtgctgccctttcaagtgggcaccttggggggccgtgtcctcattccacttcacttacgacagcgctgggccacttctttggcaaatgctctcagagggagttttgaagccacttgaggacatttatttcatcactttggaattatgccttatttttgaccaaaaaattgggggtgggggatggttttccagtcactttatcccccaaacttgcttccaaataactttgggttgtttcctaaaatctagttaatgatcaaaggagaaatgtttcctgttggtgcattgatttagcagtaggtgccccaggcttcgaaggcatgaccctaagagaagttcccaaattgtcttgtgccacagcagttttcttgggaaaggtatttaactttccagagtgcctaggacaatggaggcaagatttatttggatgcctacattctggtgtttgggttaaagaataataaattttttaaaccctgtatctaatttttgtttatatccccaatatttagcacacggtcaggacatatagtgcccaaaaatgttttctggagaggaagaacgaatcatgaggaggtctgacgtcttctcagtgcttcccatgcacgtgccaggcaccatgcggatgcttgtcacacgttacctcgtctgatcattataaccactttaggaggcacttacaattcaatcccaccaaaaggaaactgaggcctgagcttaagtaacttgcccaaggtcaccaagccagcaagtgacaaggctgggatgtaaacccagttgtagaaaatctctcctacagaatccctaatggagactcactaagaaggtgatgggtatagaatcattattcctagcacagcagaggagaagaggattctaaagtaatcatggggccaacttcctcctctggtcatgagacctcccttcagtcagcagatcagtgtctgtacagctatacaggcctctcctggggcattggttttcccagacaatccccctccatagcatttgtcagccaaggagctccaagatgttgacacatcctccttgggcttttagctgttacaaatggctcctcaagttggtctgtggttccattcctggctgattggggcacccacaagaccctatgtagtttttggagtttgcatgtatctgatctagccagaacaaggccaggtcaatgacagtacagagtagaggatctgggaatttgggctgaaaaagtagcctggtgtcatacccaaaggggccaggattctgacactgccaagccactaatgccaggcatgaccttgggcagcttgctttgtcttcctgggccccagcttctccacctgtagaaagaacgttatttctaaggactgcccatctctggaggactagaaagaacagaccgttcttgcttggggaaggtaacacattttttgctcattgggcgtttatttccctaggctggaggagaactatgagattgcagagggggtctgcatccctcgcagtgccctctatatgcattacctggatttctgcgagaagaatgatacccaacctgtcaatgctgccagctttggaaaggtgagtccagcctcatcaggcttgtcctccctaccaccccaactttaagtaatttatgcacagttttaaagcattttagttattttttttaagttatcaaagtacttacttactttggtactttgacaacttcaacttcactgtaatactttgctatcaaaatttcaaacaattcaaaaacattgtaaagtaagaaattcaatgtctcacttgaatttcctcagtacttaattttcatgaagtcacttattttctctgagaggcaaatattgaactcacaagtgtgttacatggatgtcaatcagcctgggacaggcaacctgcttggcttagtcatgtggatgcctggagaaactggaaatggccctgtatccttagattggaggtgtgggagtcctctgcaaagagtggtactatttgcattatcactacagtccagactgttctctttccaccttataaaaaaaatgcaatccacatttagagctatgtctacaaaaaattgttagcagtgatcattcccatttaataggccaaggaaagctgttggggcattctttaagactgatcatttatttatttgatggctacaccaaaaaaatacccaatttgagtcaatacatctaaaccttcctccttttgttagcttcctttttctatgtgtaattttttctgcatctgctaacaaaaataggcttgttctgtaccatgattttttatcagttttctgagtgcaggaatacgaagggctgaaatggcagaaagaggtcagtgtatgagtttcaggaattcccttttcagatccccaaaagataaatcatcagtaggaaaagacaaagagccgtgttagggctgagccagccaccctggagagcccaaaaatggagtggctgagaaatggctccattcaataaatgggaggatgctctgtgatgacttggggaggaaaaaacatttttgtgttgattaacatgatttctccaaagtgaaagggatgtttttttaaaagtcagtggagaaactacctttggctatttctttcattcatttcttcaatccttcagtattggtagagactggctgtgtggcaggccctgtgttaagtagtggcagtggggacccagaaaggaactcagtatggctctgctatggaggtgcccctcagcaggtgggagaagggagagcacacaaggtggatgtgtatgctaccagagcttggtcaggagtttgcggtcctggaatattcagtggcacctacaaacccctcgcagaggccacagtggaaagcccagatgaggcctcttacatacaggttggggacaggttgggtgaaccaaaagaccaagaatcctgactttcctggacttattatctaacctctctaagcctcagctgccccagcttcctcagggggatgttgcaagagtcaactgagatgatgtcagtggatgatggaaggtactgtttactcagtcatccaataactcagacatttattaagcacctaccatgtgcgattacaactgttgctgttatgaattctgcatgagatgtctgtgcatggacataaacagacatttgttagcttatattctgcaaaacaaataaaaaccctcaccacttgtagaaactccaatttgcctgcacaagaagcctctattctcttttcctcaactacttttgtaaccctattagcttgtggttttcttgacctcctgatctaggtaaaatcagtttaagcgcacgccttcacctcagcaccccagtcccattttcaatttaagtctcaagcctgccccaagacttcagcaaatctcaaggcatttgcattctcagggtcaccttgacttgagactcttccttctggtcattagccatgtgtggctgtttaacttaaacaaaataataacttcagtacactagcagttgcattaaccacatttcaaatactcaagagccacatgtgactagaagctaccatattgggcagtgcagaatgaaacgttcccagcatcacagaaagttctatcagagagtcctgtgttatactgcagtgagccaaggaggaaactcagtacccactttgcttttcacaagacagcccacaggaagcctctgtgatcctagtagagtgagatttgtaggagaggtttacatcccaaacagggttaacatcccaaacagggtcctacggaacagacatcccccacttcaaaatgctcttcatcctcttcaccacagtgggggcttactggccctgcccctgatggttcccaaagctagtcccagtgcttctccaccctgctgtctcccttttctcctcttccatctcccttctcctcattctcctctccccttcctccttgagacaccccccaccaaatgtctctcttctgcgatctttggtttctgctgacatctatgcccatagaggtacctcactcaccccaaatggcatttcaaaatatttttctgaacaatacatttcctccctaagaattatagtgccagctgcttccaaaatagtcatttaaaaaacatccgaactccatcttatcttcagccttaaaacaaggaaatactctaatggcattaagaacacaaatgcaaatgctctgtgcagctgccttgccatcagtttcaaatggactgggcattggagctgtccttccagccacagaggacaggagctgcctgctaagggtttccacactgagcttgctggattgaaatcccagacacatttgcctttcctgaggactccagcatgctgcagctgccatctccttgagagaaagggactagttgttctgtgaaactttgagatgaaatcgtggacagtcttcctttgagcagatccatccaaacttacaattcattgatgaacttttaacttagagcaggcgaggtttaatatttcagcttagcttttggagaacaaatacattggtagtagtctctacccagtttgcaagtgggctgaggcaacacagacatcaatgctgaagctgtcccccagggacaaccagggtgacctggttgggataccgttcttcataaagtgggtggcagccattgcttcgctgcaagtaagatctgaaatgtaaatcctctttccaagtctgtggccaagccccaaaaacaccggcttccagtaatgctgtattgactttgggtcccagaattaatttagggagtatagagaatgtgaaagcttctagctgaactggtcttgtgcctgctttcgctgttaagggtaatgaaagttcacccaacttggagtcactgaacttttctgagctcatatttccttatctttagacaggaataatccctcacaaaactagggataaaatgagacagtgcttatgagggcgttttttgaaactgtcaagtgctctacccatcaaataaatcatcattctctaaatgatggcctcattccatctcacctcccatccttccttaccatgctttatttttctttatagcatttatcatgacttgaaatagatatatttatacatttatatagtatagttttctctctatatatagatatatagctaactttccctactgctactctatgcttgtcaaatatctatatctatgtatacacctaccatgtgagtatacagaagcattatatatacgtaatgattttgttttgtctgtctcctctagaatgaaagctctatgaggactttctgttcattatgcatcccctacacccagaacaatgcctggcacagaataagccctcagatatttgttacatgttgtatgatttatatttacattacttgtcagggaccatgtgaatcacttttacgtatgtgaactcgtttaaccttcatgataataaccctatgaaactggtgttgtatccattttccattagcccatttactgagtagaaatgaacttattgaggtacacatggaaactagctgtatttttacttactttgaagaatcgccttcaaagttctccacccaactcttcctgctctgatgatgatgtcttcagaggaaatcccacagcatctggccatgttcacccatcacatcagtcttggctgaataattacagctcattctcagctattaaaaagtgtagttcagtccaatttaaaacttcaatctcacatctaagtcagaccttcttcctccttgtggctcagaatttgctctgggaaagaggggtaggatcagctttttctccttccttttctggctcctccagggttggggttgggagacagtgggggaggaaaggcaacaagagtcatttgacaaactggtgctcactgggggcttctcctagctataagtgccttctgctatgactgtcacccaaatgctggggccaggggtcctgtcataggttttgggggagccactgtggatctctgtccacattagctgagagatgtgctctctagccaacctcctaccacctccactcacaggctgctttggcccctcaggtaactgaggagtccctctgtagctctgttattgtgttggaagcttctggccaactcactgcacaccgagtgttacaccctgattcttagagatgcccagaggagccccaaaaagcagaactggcagataggacaggctgaactcaatgaagcataaacaaaaaatagctttgctttgttccaagtttgtctatggcccacttccttccctgacccctgattgttgcatggcagatttaatagcttttgggttattgattataagaacaagcatcttctcaataatttatactcttttttagatgttaaaagtccagtccagtccagttcttgaatttaaaactgcagtctcacatccacttcaaaactcctccctagcccagctggggtctggctatctgtggcttggggacccacagtgaggaagggaagagtgtgatctgatcttctcctttccctgaccattccctcctgctcctggtccctttaggtgtgttagactgagaaaaaatactttcagaatataactctagctctccagggaaacagtgaaataaatttttagagaacaacagaactataaattgaaacaaacatacggtaatagggatcacaattggcatgctcatgacgttgtccaagcttattaataggcaattttttaacagatggtagaagtgtctagctctgtctaacttagaatgcaacattcagttttcatacgattaaagagcaaacatttatgtagggctttctgtatacctggtactgttctaagcactttacatatatcaaccgtgtctagtcctctaaataactctatgaagtagatactgttattgttcccattccatggatggcaaactgagtcccagagaagctggatgatttgccaagttcacacagccagtaagtggtggactcaggatgtgaaccaaggaaatatggccccagagctcatgcccttagccacctcatttacacaggatgagttatttcagggttaggctaggtatgtgtggaggcaggttttgtgcacacacttgtccttttgactttgttgcagtcattagtagtcatctggtgatctcctaggtgatggaattttggagagaagtctcagcctctgtgtatctcagggatcaagtgtgctgatcactgcagttgagaaatgctttcccaaatcttcccagctggggtgttctgggtactgtgaactctggggtactgagtactaactccctcagcacccgggttcatccatttatctgatattcatttatctcatgtctgtgtggacccagccccgtgctggaagatgggatacagagtgaagtctgcctccaaggagaaggccctgtagaggagatatatacacatgagtgactgcaaaaccagatggcaaatgcaattcctgagtatgaatgcaagattggaagggcacaggattagagggatgcttcctccttgtaggggtgaggggcagcctgagaaccaggctggttgtggaaaagctccaggcactgagcatccccctctctcagcccacaaccctggaaggtccatggaagctaaagtgggtgttttaatttcaccagaaacctccttctcctgcttgaccacttgtctttcagaaactctaataaaacaaaaactctacccacacaaagatggagcatcactgcatttggccaacaagctaagccttttcagaaagaacaactgagcctcagatttttgagaaaagagaacatctctagcctacaaatgagttgctttccaagcatttgtaagctgcatttcagtagagcagaggtcctcaacccctggtctgtggactggtactagtctgtggtctgttaggaactgggccacacagcaggaggtgagtgggtgggcgagtgagcgagcattacctcctgagctccacctcctgtcagatcagtggtggcattagattttcacaggagtgagaaccctattgtgaactgcgcttgtgagggatctaggttgtgttttccttatgaaaatctaatgcctgatgatctgaggtggaacagtttcatcctgaaaccattccttcaacctgtccaagggaaaattgtcttccatgaaaccagtccctggtaccaaacaggttggggactgctgcagtagaggccacaaagtgaaagaatgtcttcttcaactcacacttattgagggcccaccatgtgctgtagcccatggaatttccaataatgtcaggttttgagccctgaacttgaggatctttcacccttactcaccatgtgatgatgggcaggtccttttccctctctgaacctcacttcctccatctatcaaatggggaagttagtctacaagcatatgaggatcttaccgtattagcccaaaacacttttcaactagaaatcataaaatagctaacactgactctatgccagttcctgggcaagcccttttcatggattatctcatttaatcctcgcatactctgtgaatgagatgctgtgatctgggttttttgtttgtgcatttaaaactttttaaaagagaaattttagtttgacagcaaagaataaattgtacagagatttctcatataccccgtccctacacttgcccagcctcccccattaacaacatccctcaccagagtagtacatttgttacaactgatgaacctacattcacacatcatcacccaaagtccatagtttatattagaattcactcttggtgaattcactcacattggtgaattcactcacatactgtgagtttggacaaatgtataataacatgtatccattgttttggtatcatgcagagtattttcactgccctaaaaatcccctgttctctgcctagtcctctctccctgtcccctaacccctggtaactactgatctttttacagtctctagttttgccttctccagaatgtcatatagctggaatcgtacagtatgtagccttttcagattggcctctttccattcataatatgcatttaggtttcctccatgtcttttgtggcttgacagcacatttctttttagtgctgaataatatttcattgtctggaggtaccatggtttatttatccacctacttactgaaggatattttggtttcttcccattttggcaattatgaatacagctgctataaatatgcatgtgcaggtttttgtatggacataagttttcaactcctttgggtaaataccaagaagggcaattgctagattgtatggtaagagtttatttagttttgtaataaactgccaaactgtcttccaaagtggctgtaccattttgcattcccacagcaataaatgagagttcctgttgctctacatcctcaccagcatttggtgttgtcagtgttccaggttttggccattctaataggtatgtagtggtatgtcgttgttttaatttgcatttccctgataacatgtgatgtggagcatcttttcatatgcttatttgccatctgtatatctctttggtgaggtgtttgttaagtaaggtctttggtccatcttttaattgggttgtttgttttcttattgtttttaaagagttatttgtatcttttgagcaacaatcctttattagatgtgtctcttgcaaatattttctcccagcctgtggcttatcttctcattctcttgacattgtctttcacagagcataaaattttaattttaatgaaatccagcttatcaattatctctttcacggattgtgcctttggtgttttatctaaaaagtcatcatcatacccaaggtcatctaagtttccttctatgttgtcttctaggtgttttacagttttgtgttttacttagatctatgatccattttgagttaatttttgtgatgggtataaggtctgtatctagattcactttttttgcatgtgtatattcagttgttccagcaccattttgtttaaaagattatctttacttcatttattgcctttgatcctttgtcaaaggtcagttgactatatttatgtgggtctgtttctggactgtctattgtgttttgttgttctatttgtctattcttttcccaataccatactgtcttgattacagtagctttattgtacatcttgaatatgggtggaatcaatccaccaattttgttcttcttcaatatcaggctgactattctgggtctttagcctttccatagaaacattagaatcaatttattgattgccagaaaataacttgctgggattctgattgagattgtattgaatctgttgatcaagatgggaataactgacatattggcaatattgcatcttcctatccatgattatggaatctctatttttatctagttcttctttgatttagttcatcagaattttgtggttttcctcgtgtagctcttatacatagcttgttagatttctacataagtatgtcattttgaggggatgctaacataaatagtattgtgttttcaacgtcaaataccacttgtttattactggtatataggaaagtgattgacttctgtatattagccttgtatcttgcaaccttgcttattagttccaggagatttttttttcttttgtagaatcttttggattttctacttggacaattatgtcatctttgaacaaagagttttatttctgccttctcaatctacatgcattttatttccttttcttgtcttattgcattggctaatgcagtatgatgttgaaaaggagtggtgagaggagtggtgagacatccttggcttggtcctcatcatagtgggaaaactttgagtttcttatcattaagtataatgttagctgtaggttttttgtagatattctttatcaaattgaagaaattaccctttattcctagtttgcagaaagcgttttttttttttcaaatcgtgagtgggtgtttcaatttgccaaatactttttgtgcatctgttgatatgatcatataattttttagcttgttgatgtgatagattacattaattgatttttgaatgtcaaaccagccttgtatatctgggataaatcccacttggttatggtgtataattacttttatacatcattggattcaatttgcaaatattctgttaagaatttttgcatctatgtttatgggaaattggtgtgtaactttttttaatgccttttatctgattttggtactaggtaacagctgacttcatagaaagagttaggaagtagtccctctgcttctgtcctctgaaagagattgtaaagaattgacaaaatttcttctataaatgtttggtagaatttaccagtgcacccatctgaacctggtgctttctgttttggaagattattaattattgattcaatatacttaatagatatagacctattctgtctgtttctttttgtgtgagttttggcaaatcaaatctttcaagaaactagtccatttcatctagattatcgaatctgtgggcatagagttatttatagtattcctttattatccttataatgtctataagatctgtagtggtgtctcctccttcaatactaatattactaatttgggtctgctctcttttttctttgttatgcttgctagaggcctatcaattttagtgatcttttcaaaggactggcttttgattttattgattttctttattgatttcctgttttcaatttcattgacttctgctctaattcttattgtatcttcttcttacttcagattaaattcactcttctttttccagtttcctaaggtggaaacttagattattgattttatatcttttccaatatatgcattcagtgtgataaattttcctctactcactgctttcatttcatctcacaaattttaatgttgcattttcattttcatttggttcaaatatttttatttctctgagatttcttctttgctccatgagttatgtagaattgttgttttatttccacacattcaaggattttctagttatctttctgttattgaatgatagcttaattctactgtggcctgagagcagacattatatgatttttgttttatgacccagaatgtgatctatcttgatgaatgtgccatataagtttgagaatatatattctgctatttttggatgaagttgtctattaatgtcaattatatttaattgattcatgtccttactgatcttctgccttactgatttccatttctgatagaggggtattgaagtttccaacagtgatactggattcatcaatttttccttgcagttctattagttttggccttatatagtttgatgctgtcttgttaggcacatgtatattaagaatcattgtgtcttcttggagattgatacctttataattatataatgcccttctttatccttgataactttctttgctttgaagtatgctccatatgaaattaatatagttattcctgtttcttttgattagtattatcatagtatatttttctccatccatttacttttaatctacatggatctttatatttaaagtgggtttcttatagacaacatatagttggatcttgttttttgaactgcttaggcaatctttgtcttttaattgatgcatttagaccatgatcttcgaagtaattattgataaaattggataatatttaccatatttgttactgttttctatttgttgcccttgttatttgttacgatttttgtcttccactcttctgctgccctttgcagttttaattgagcatttcatatcattccattttttctcctttattagcatatgttatactttaacataaaaaaaccttttaaatggccttcctataatttgcaatatatatttacaactaattcaagcccacttttaaataatgctatgccacttcacaagaagggcgagcaccttataatgagaaaatcataacttttgtgccctctgtaaaaaaaaacatgcacacatacttatgtatgtgttttaattgatatacacatataatcaagtactttgttgccattattattttgaataaactgtcatctgttagatcaattaaaaaacaagaaaaataagtttttattttacttcacttattccttcttcagtcctcttcctttctttgtgtaaatctgagtttctgacctatatcaatttccttctccctaaagaatttcttttaacatttcttgcaagtcaggtttactgaaaacaaattcccttaatttttgtttgtctgagatagtctctactactacttcagttttgaaggataatttctagtgtacagaaacttaggttggtaggttttttcctctcaatactttaaatatttcatttcactctcttcttgtttacatgatttccaagcagaagtcagaagatagtcttgtctttgtcctatataggtaacatgggttgtttttctctctggcttttttcaggatgtttttcgttatctttgattttctatagtttgaaaatgatataccttgatgttgttttcctgtggtttggctttttgttgtttatttgacatttatcctgcttggtgttctcttagctttctgaatctgtgatttggtgtctgacattaatttgaggaaattctcagtcatttttgtttcacatatttctttgcttcttttctctctttttttctctttctgatattcttattatgtgtatttacatcttttgtaattgccccctagtccttggatgttctgttcggtttttcagtctttgttctcttcgctttttagtttttgaagtttctgttgatatctacacaagctcagagagtcttcagctgtgtctagtcacctgcaaatccatcaaagtcactcttaatttctgttacagtgtttttgatctttagcatttctttttggttctttcttaggatttctatctctctgctcacatggtccatctgttcttgcaggctgtctaatctatcaattagaacccttagcaaattgatcacagttgttttaaattcctggtctgataattctgacatccttgccttgtctggttctgagccttgctgtttctttaaattgtgttttagcatgccttgtaattctttcttggtggccgaacatgatatgccaggtaaaaaaggaattgctgtaaatcacctttagtcatatggtggtaaggcgtgttgttggtgggggaagcaatctattgtcctgtgattaggtctcaatcctttagtaagcctatgcctctggactgtgaactttactacaagtgtttctccattttttccctcccctcttagatgtcataggatggctaaagttggctagaattggatatttcccttctttcacatggaaggttagaggggactggtgttgggttatttcccttctccgcatggaaggctagagctgactggagttgggtatttcccttctcccaagtcagttaggctctgataataccccagcagattaggctctggttaactagcttctcctgaaagcaggccttgttaagaagaacagagtgctccagcgtatttcaaaatggttcctttactccttcccctgccggaagcgtgagggacttttgctctgatatttactgtgggaacctggtcaagctcctagaggtacatctctcaatattgtgtgggttcccctatgattgggtctccctagagttattttttaactctcagccttgtctgcattaagccttcacaacttgtcaattacaattcaggtgttcctaccacagtactgggtcctgaggcagttcccactcctgagtctctgctccagggagccacgattccctgtatttacccgtctctccaatcttgagggcagcagtttgctctgtgtcctcccctctcttaagaacccaagaagaattgttgatttttcagtttgttttgctttttacttgttaggatggagtggtgacttcaaagcttcttatatacagaaaaccagaaactggaagtcaaaatgctgtttttattcccatttaaagatgaggtagttgtctccagggcctgtgttgtcaatatcggatttctgatcaatgcaaaggagcaaaacactggagcattctctataaagtcgatcctaggtggaaaccagaaggtctctgagttattacaaaaattggggctgtggggaaagatgtcccccccatgcctcaatagtggcttaaataaattagtggtcttacttttctcacataaactaagtctagaggaaggtaacccagctgcagttgggcagctccttaaaagcatcagagacccagtttctttctgtctttgtgctctgccctttctagcagatggcttccagtttctatatcacctcatggtccaaaatgactgctagactccaaaaactatcttccaggaaagaagtagaaaaaaatggggtaagggaagaaaggtcaaagctcccagttcagtcagccctctttagactctttcccagagctcagcccagtgattttcccttacatctcattggctgcctttggctatcagggaggcaagaaaatgtggtccactctatcctggaataaaaactacggtttgagccaggtgcaatggtgcaggctcatagtcccagctactcaggcacgaggctgaggtgagaggatcacttgagctcctgagttcgagtccagcctgggcaacacagcgagagcccctcttaaaaaaattttttaaacttaaataataattaggatttatttaccttggactaaggatgaaggggaaaaaagaaaaaataattagggtttagtggggaaggagtaggcaactagccattttatccacataagggtgtttcacacatccatgcatccttgtatatgctacaactatgaaatggaactcaggatcctggaagagtataggttattctctcaaattatgagctcatgggaagtaacatgggtggtacaatgtgatcacttaagactgtggagggtgacatgattcatggtcagcaatttgctgaacttttcaggaaaaggctggcttatggataggcactagatagttgtgatatagtgtaatttgaatatgtggagaggccatttggcctcaaaaatataccttctgaaataaaggcttaatgatgtcttaaattcctcaatcccacttatttaagtctgtaaaaatgcaactagaacaggataagatcattcattaatacttatcacttactaacacttcagtatgtatgagtttaatctattaaggagactcagagatcagttgatgcaatcccttcactttccagatgtggaaattaaagctcagagggactgagtggttttccccagttcctacatttggtggcaggtctccccctcccccacactggatccagtggtggggctgagagtgtggaagagacaccagtaagaggtagagagactggagaaagggaagctgaggtgacagatgtgcttgtatgaattaaatttatttatatcctgcattttttcagtgaggacatgggtaattggcagtttgggttgtgggtggctcatccttgaagatttggctcctttctcctcgctgaccatccttgggcaatggggaaaaaagccaagtgtgttctggggacctgtgcttcatcagctgcacttacctgcattggagagaacagagacttcctcatttacacggtggccctcttcttctagtcccaccagtctgcccaccctcctcccatcctgacgtggggtcacttgcacacccctgaactgacacagcagaagatgagggcactcttgaggcatctttaggatccttcaaagatggtctttttccagttctcaaaggaaaaaaaaatacgtacatagacagactttccttctacttttaattcttgtatatatttttcttaatatttttgaatctgctgtggggcatccatgacagaatgtctgatttcacaccaggttttttctaggggtgtgtgtgtgtgtgtgtgtgtgtgtgtgtgtgtgtgtagtgccatgtaaaactctggggggtcaaactctttgggtttgaatttgaatcctggttgtaccacttagcagctgtgtgagctcagataatttcctaacagccctcagcctcagtttcctcatctgtaaaatggaatattgatagcaatcaatcacctggagaactgttgcgataatgactgtaaaagggctacttagcacagagcctgtaattataaacactcaatgcttgttagttatgacttcagtttattatagcaatatttcatgatcactaacatatcagtgttccagcctttctaggtgctcttctttctgaacaattttgagaacaattgttctaaaaatgtcctacatcacacacatgctgccatcaccaccctcgccctctcttattatcatcttcagaattattccatttttgacttaacctgtatcttatgtaactcacctcattctagctaaatcagtgtgtgatgactgccttctctcatgtacacgtgacacattatccagtcaccctgaggacaatgaggtgttcacatatggatttttggcattcttgttattgccatccgtggtacccctcaaggggcaacagattcactgttaccttttcagccctggggcttttcaaagaattcttcatcaatccataggcatgatttgaaattccacttctgtctcattgccctcagtatgaatttcttgtagaaattttgcaatttctcttagggaatttcctgtgacacctgtagcattctctaaccctttcattccccagttcctggcacccaggaagtgtcataaaaattgttgagtaggtaagagttacatcagtatagtaaaatgaccccagcaaacactcattttaagatggaagcattgagataggatgttttacagtccccattcatatcaccagctttaattattttttcttttctgaaaaatagactaggtttattgtcaaaagaaagaaagtgaatatcctgctttcagagttaaatttgtgacaattagttccctttaaccaacttctttccctaatcatttctctctcttgttcaaagcattgtttcttatgtgtgtttttaaaaatatgccacaagatttccacaatatatggttataaaacaggaacttgtcattgtattaaatttctaatttcttgcttcttgaaaagcccttctttacccacacctaaaatgacccctgaagtaagacccacaactctcatttttaaactatgttcagcatactttattctacatgagtttatctccttcagtgtgtggaaggacatctactgattccattgcattagaatttattttagatcacttcttgttgatggcaaatctttacctactgagggtgggtggaatttttggaaacaaacgcccgatgactaagattggagatcaaactgatcaagatcatattatttggggtcaaaattgaaggctgtattatgtagagtgatgagactgaatggccttcctgggtggctctgggggtgtctcttgaggcaacaccaagagaggcagtggggcagggggtgtcattcacaatgagaggacaccgtgctggctctggcatgtgtgggcatgtgtcagccacagtaaagaagatgacaggtagaagaatcagattcctgtttcttccactggccagagactgtgaatggagacagccttgaatcaccctagatcccagttcctcatttgtaaagtgagatcatcatactctcttccagtgttgttttccttctttcttttcttttctttcttttgtttggagatggagtctcgctctgtcacccaggctggagtgcagtggcatgatcttggctcactgcaacttccgcctctcaggttcaagtgattctcctgcctcagcctcctgagtagctgggactacaggtgcacgccaccacgcctgactagttttttgtattttagtagagacagggtttcactgtgttgcccaggcttgtctcaaactcctaagctcaggcaatccgcccacctcggcctcccaaagtgctaggattacaggcatgagccaccacacccggcctccagtgttgttttctaagacaaaatgtactaccgagtataaaaccacctcatttagggcatggtgcttagtgatgctcagtggctgacagttcctcttttcactctttcctttcctcatcttaaattaggagggcaattgtttgaacatgccatctcggaaattcttgcttaaaactcatgtttctttaaaaaaaaattgcacccacaaaatgatgtaagggtatcctgcatgctgggctaccttcaactggagtgtggtgtatggggaggagaacggacaggggagatgagtgacatggccaccaccacctaaagaagaattccaacagctccagagagagtagttctccagagcttctctgcttcccacccctatccctgcggagcccccagctctgtctgcccaggctgaaagagagaagggtgggattcatgagtaattaaagggaatttggaaggctgggatgttgcggaatgttagatcagtagctagaacagcatgtggtgttctttaggcaggcttcattgaatccatacaaaaaaagaaagaggggctgcctgcctgtctgctcatttatcaaacagcgaagctcaactttcacagctccacaaaagtgttttactgtttgctgagtcttgctccagaaattaaaagctgagcagcctgagcggggctgaaccgaccctgcattttgagactcgaactaaattgtgctgggctttcagattcagggaccagttgattatttggtgaaaggagaggagaataatttgtaatttgcagcccataagaaacacttaaaaaaaaaaaaaaaaagccaaacccccttcccacaggtttttgttgcagctgcaaggaggaggtgctatctgcagcagccctttctttgctcagagtgggaaaagtcttgacctgcatttgggcagaatgtgatgtgatacagcagcgcttccacccatcccccatcccctactcacagcaaactccctttcctctgatttctttacttgagattgcctttttctctcttcggaggaggaggagaagatttggccattagatacttttaggtaaaagaattttcacaaacagaactaaatattccaaccacactaatatgttccttgggaaagcataatataccacaaaagcccaaaaactagattgaatgaggagcgtctgcaaatccatgaaggatggaagtatagagggctaactccgtcagtgaagagaaagggctagaaaataatgataactagaggacgagtcactagagaggcagagaggagtgttaatagatatggaccccctgctccggctcctccctggcagctggtcactcctggctcccctccagccagcgggctgtgaaagcctgttgaggttgagctcttgccctgcactcttgtcccacttccggctggtgaagtcccaggaggcaagcctgggtacccagtctctagcctctctgatcctgctacgagcctgtgagataagctgagcgagtgttatgatccccactttatagatgaagaacttgatgctcaaatggaagaaagagcaaaaggtcttttgtgacttttcaatttagcacatttttataaagtgttaatgctgtcctatactttataaaagtgtgttttaagaacattgaaatgtgtctccccttggataaagcagctccacctttgagaaactatcacgaggaggaaatcccaaaacaaagtatccacaataaaaaacaaaaatcatgccacaaaaagatattgcttatagcattatttgcattaacacaatgctggagacaacttcaatggccaatcaaagaggaatgattctttcattctttcattcaatgagtcaatgaattaatgcactgagccaccttctctcccacctggactactgcagtagccttccaactggtttccctgcttccatccttgcccctaagtcagttctccacacagcagccagggtgacccttttgcatggtaagtcaggttttgttccccactcccctccttaaagccctctgaagtcttcccatctcactaagagtaaaagcagacagcttacaaaggcctgcaaggccctgtgaacccctccagcccccagacctctcctcctgccactccctcgcccactggctctgctccagccacatgggcctcctcattcttcctgaaacgaatgagacaagctcccacccaggtccttcccatgggctattccttcttgcagtttccttcccccagatatccacaaagttcattctctcacttcctttaggtcactactcggatgccacatcatcacagagtcctaatcaccctaaacaaaataacatccccacctccattttctttcttttttttttttccaagacagagtcttgctctgtcacccaggctggagtgcagcggtgtgatctcggctcactgcaacctctgcctcctgggttcaagcaattctcctgcctcagcctcctaagtagctgggattacaggcatgcaccaccacgccaaactaatttgcgtatttttagtagagacggggtttcaccatgttgtccaggctggtcttgaactcctgaccttagtgatctgcctgcctcaccctcccaaagtgttgggattataggcatgaaccaccgtgcctggcccccacctccattttctttattcccctcaccctacttttgtgttcccctctggagcacttacctgatagaagatacattgactttttcatttatttttggtcttctcacactagaatgtaagcttcttgaacagaggctgtttctgttttgctcagtgtgtttctcagtgcctagcaaaatgtccggcctgtagcatgagctcagtggatatctgctggtgaatgaatccctgctttgtaccattagccaacctattatggttattgaggctgcagcttgttgaacatggggaaaatgaggctggagatccagtttgtgtggagtcttacaggcctaggtcaggactttatagagctaagcagaacactgattatttataaagattctatgggagtggcggagttggagaaatttggtcaaagaatacaaactttcaattaggcaggaagaacaagttcaagagatctattgcacagcatggtaactatagttaataacaacgtattcttgaaaattactggccaggcaccgtagttctggcctgtaatcccagcactttgggaggcagaggtgggtggatcacttgaggccaggagcttgagaccagcctggccaacatggcaaaaccccatctctactaaaagtacaaaaattagctgggcatggtggtgtatgcctgtaatcgcagctactcaggaggctgaggcacaagaatcacttgaacccaggaggcagaggtttcagtgagctgagatggtgccactgcactccagcctgggtgacgagtgagactctgtctcaaaaagaagaaaaaagaaacaagaagaaaagaaaattgctaagagggtacattttaagtgttctcaccacaaaaaaataacaagtatgggaggtaatgaatatgttaattaactcaatttagccattccacaatgtatacatatttcagaacatcatattgtacaccataaatatacacaattttatttgtcaactttaattttaaaaaaagattctatggatcacataactacggtcacccaacaagtggcccagggaaagtttctaggaggaaataaggtacaagctgagatgtgaggatgagtagacattaggcagaaaaagggtgtgaagagagggctctggacaatgagaacatcctgtgggaagggccagagtaagacagaacacagtgtgttcatgaaacttggaagaagttccattccgtatggccggagcacaggaattgggagaggacggggagaggtaagctggaacaaaggcagggccaattaggcaggacctggtgggtctgggttctgtctagaggcttcatggaaaagtggtcgtgatggggcatgacgggaagcagggccaatgagactatggcagcactccaggtgcaaaaccatggtcctgggatgcgtagagatgggaggatatgggtagaatcaggaatatgaagatagagggtagaacttggtcacaggttggaagtggcacatacaaggcaatcatggtttgggaaaggcgagctctggtgtggtcaggtaatggggaaaggctcacagagcagcagagtgcatgctgcgtggctggatgggctctgagggcacaggtagtgaggagggagagagagtttaaggtagaaggtgcagaggtatggacctgggaagcattcagggaatagtgcaacaccaagtagtctgacttggacagaacctcgagttcatggaaggaaatttagagaaaagatggaagcaaagagtggtgtctgagtttcaatcaaaagaacctctgctaagtcaggtgaccgtggagaattgccagaggcctctaggtagacaggtaatgatctgcatcattccttcagtaaacctacttggggacctcaattatgcaaataatgatttttgattagcattttattaagcaggagcatttcactgccagatgatcacttgagtgggtgcagggaaatttcatccaggaggagacacggggctgtctgctgatgacaccatcccctcagctgcttctcaccttccctagcctattgggtgcagggccctcagatcctgttcatagcagaggccaccagaacatctccaagagggtcaatgtgaggagaatagaagagaaatcttcactgaagagttgatgagaacgagaaatcatttcattcctcaaacacacccaatgtgtaaatgtaggaatatgacataaaagaaataaaggttactgttaaaggaaggaatgagaggcttcgagacattctcattcgtctagaagcagtaacattgcggtggtagagtgttaagttggactggatgcattcaaatcgcaggtctgcatctgagctgtgtggctttgtgcaggttgcttagcctctctaaacctcactttactcatctatactgagggaatatcagtggaacctggcgctggattgttgtgatgattaactgagataatacatgtaaagtggttagcacagtgcctgagccaggactggaacccgggtgagcctgactccaaagcctgtgtgcctaatcactgtataccactgtttcccaattcactaggaaaacagagaaaggaggcagctaaggctgcatgggaagggtcacagggcaagtgggagaggcttggagaaagctaggagttccttggggtgagtggaaacagtgtggccttggcattccaggcacagggaacagcactgtggatgtgggagcaacataagcctggagctctggggagtggctggatttcaggctgggcagctgggtgggagtcgatcacagagggcctcatggaccatcctgaggagcctggatttttattcagagtgggcagcaagaagacatccagcattttcaatgaggaagtgaaatgatcatattggcattttagaaagatcctgccgctgaggccgggtgtggtgcatgtacctgcagtcctagcttctctggaggctgaggcaggaggatctcttgagcccaggaattcaaggctgcagtgagctaggatagcaccactactccagcctggtcaacagagtgagaccctgtctcaaaaaaatcaaaaaaacaaattccactggtgaggcaacaagactggtggcagggaaaccagttagaagaatgtttctgtggtccaggcagtgagagatcacagtggactagtgcagtagtgggggtaagggcagaaagagagaaggggctagattcaggagacatcctgaaggcagaaccagtaggacctggggttgtgcagtgttaggaagagaggagtcagggaggactctcctgttctgtcttaggtaactcagtggagattgatgctggtcacacagatgttaaaactgcatgtattgatctatacattattcaaaaagaataagtaaaaaccatcaggaatgaagggagtcatagattaaattgatccgtgaattcccaggccccatgctatggcttgataattcctcaagatcacagtgcatagaatcacaaacacactgattgtacacgttattgcctcacagaggtagaacaaatggctccagaaggccagtcatttcccaggggccttctggcacatctctagaacacagtcggcaacccctggtaccttcacctagggccaggcatcaagggcttggcctgtgttgctttatagatgttatgtaggataccatttggataaacacttagaaagatttcagaacttagcccagtctcttaaatcaagtaatcataagacttagcaaccaaacaaaacaatgctgctttcttcaattatctacgtattgtttatagaaaataggaaatgatttatgtttttaaaaaaggaaagaaagaaaaaaataacaacactataacactctggtagattttaggtgcttcttccaagattatcttgaactttcagttatttcaataaggaaatccttttctatttgcaaaaaacaaaaagtttatttagtacataaatatacaaaccctttttgttctacccacaatcccaatgccctaacgaatatccattttcattttaccacattacctgtttattcctatatttttacaaacaattctctgttataaaactataacataaacacagattgagatctgctatttcatttaacattataagcattttctgtgttgtgacatagtttttgttaccatcatttttaatggctatttcataatttctaccgtgtgtatatatactatcatgtttttagacagtttcctatcattagacatttatgctgtttcaaatttttcactctcattagtagacttacatttagcttttccttatttcagattatttccttggaattaatagatcaaaaatataagtactttatggcttcctatgtattttaaaaacgctctggggaagggttgtgctaataaatgatatcatcagccatctgagtattccagttttactacagccttgacagcactgaatattaacctttccaaaatgtctgtgaataacagagggttaaacatggtgccttactggccaagtgcagtggctcacacctgtaatcccagcactttgagaggttgaggtgggtggatcacttgaggtcaggagttcgagaccagcctggccaacatggcgaaaccctgtctctactaaaaatacaattagccagtcgtgttggtgtgcacctgtagtcccagctacttggtaggctgaggcaggagaatcacttgaacccaggaggtggaggttgcagtgagctgagccatgccactgcactccagcctgggcaacagagtgggggctctgtctcagaaaaaaacaaaaaaaaaaaccaaaaaccacaatactttactgttgtgtccatttgtatcggagaaattttccagacctaaacataggaaaatttctgctttttctaagcaactagtatgcacttatattgatactgggactcttggaactctattgtattatcttctttgcttgggtggttaggaaacttagaacccacttttaaccaatgtgaaaaatcccctggctcaatttttatgcttcccttgttttctttctatcgctattagcatgtctatgtctgttcagtagtgtgcctttgtgaacagctgcttcaaatcctggctctgaagccattcatatgctgaaagtctgaagggcttggccacaggttaatataaatccaaggtgatgaggccactaaacctggatgcagtcttaggctgcactgctagacaaagtgtttaaagagcactgttactgaccccatcttgaatcactgccttttactcaggtcaccacaatttgagaaggacataaagtgaaaagcttggatcttcagtttacaagagtcagggttaaagagatgggatttattgcctacaaagtggtacccttaaagaattcagagaattgttgcatcattttgttcagtattatcaccatgagatggtattttaaaagccttttttacttccaaaagtggtttcatgatgctatcgtattagattctctaaacattcttgtgaggtgcatctttttgtcaacgattctctgatgctgaaatgctgcggcatccattctccacactggaggtggtcagctccccagtgtagagaaatggtcagtcttcaaggttctcaatttctcactaatttgtgcacttctgtccatcccattgataccattttagttgagatcaccaacacctagccctccaattaggggaagactacacaaccccttagtcctcaaatgccacaggaggaaattcaggcacagagaggttaaacagtatgtcccagttcaaacagctaacaaggtcacagtccatatttgttgagtgaatgagtaaatcaatcagtgagagtagtggtgtggataaaagaggggtgaatagatgaatagagattcatccccatccctagagaaagcactcaaggtttatgccctaccaacaagaaatcagcaacagcatcttttctcatgaaggcttactctctctgaccatgtatgcctgctcagtgctgtaccaggagggaagggagtcttggttacactcaaaaaatccctggaagtaaaagggtcatcaggacaatcagtggtaataatgggtaacatttattaagtacttactaactgccaggcactactgccagctatttacatacattcactttttaaaatttcacaataactctagaggttattatcattcctattttacaaatggggaaactgagtcatgtggatactaaataacttgcccaagggcatccagcctaaccaatgcctgagcttgcattcaattcaggtagtcgagttccagagttcttgcacgtaacccctgacctgtcatgcctctccacaaacatcatctccgtaaaccccaaggaaaggggcctcatggttatgttttcaccttgagagatgctctctcttcacggatttcttgtgaactggtgtggttgtcctgggcaacagcaattatcatcctctgctctgcagacagaaaaaagatacccctaggctttcattccttcattcaacagatgtggattggggtctttgcatgtgccaaaccctgtatgaggtccttgctctcatggagcgtgtgttcaagcaggaggagacataaactaagtacccagagagtaagtgaacaagataacttcagatagtgctaagtgataagaagacaaagcagggccatgtgacccttgtgctactccacactggctggtctgagaaggcctctgggcagaaggacattgtccagacgcctgaatggttaaagaggaggcagtcttgtgaagagctgagtgaaattccactcctgggtgcagtacaaaggccccccatggggagcaacgctggtgtgtttcagtaatagagaaaacaataaaaagccagtgtggctgggatctggtgagtaaaggtgagaattataagagaggaaggccagaaggtaagcaggacgagttacagaggctaagtgtgggttttagttccaggtgctgtggaagccactggagggttttaaacaggggagaggcaggttctggaccaaccagaactctccttcctttgtgagtaggacggggtgaagcatagagtggccaagtgagacccccttagtatccagagccccacaaccatccaagcactccccactctgacaccagtagtcttctccagggtcctcacagactcctattaagtcattgcaaccaaggacctatgttttcctcccttctgtagatggctatttgtaaaactcagtcactatgctcccaactcttcccaatgggtaactgattcttgtgttgacttacagatcataaggcagcagtttcctcagttaaccaccagaagactcgggacccgaggacagtcaaagtaagcaccggacggccattccacctgcagagcgcacatctatgggcctcgagacaggccacacccttggctctttatcctgagctctgtctgcaggcctggcagaagtctgtgcctagagggaatatggaagagctttatgacggccagggcccctctctcaggactcctgaaagagaggttgtccaaaagcccaagacgagttggctctgctgctttaaggaatctgattttgtaccaccctgcttttaggcatattttgtaaaatagtcttgggcatcattgaaaggattgccttgtggcctcttggaggatcaccaggttatctggactgttttgctgagcaaactctgctctgatagtatgcagtagaccagagaagcaaaactgtactattccctgcatgggagatggggcagaaaggtccagctgcaccatggtccatgagggttcacggcttcccattcatcagtttcatcaagcaaccaaccaactcatgctttatactttctgtgtgtcacatatgtggtgctaggtactgggaacacaggagcaaatcagttgctgccctcgtggagcatagattccggtgggaaacagacaaaacagagaatcagattgtgacaaagttgtagcagagagcaacaaaagaggaatggccagggaaggtctttcagaggaggttacatttaagtaaagactaggggagtgcagaaggctgtgcagacacttgtctgctaggtgtgagtcagtgggaagggaatctcttcctgtactgctcgaccttcattaaaatctgcatttataggacttgcctctaaggatgtttcaaaaattgttggacgataataggtgttccatgaagaagagcagcaggccctataagtttggttaacactaagtttaaacagtttcctttactgcaagacttctcagaacccttattatgctaatgtacaaggtgactccactagagggtgccttattatgcagcatttctaagcattttgaccacgttgagcaggtcagcacatagtgacctataaaacactgtaactttttagaaaggcaaccatataggacttttaagacttgtcttgaaggatgtgtcaaaagcatgtccagtgctctcaccctgggccaaacccctgtccctcaccagctcctctcatccctgggcagcacattcccatcctccaagggtgggtttgattttggagccaaggtagggaaagaaaatggatgatcgaactgggaaaaacccttttttggtattctgaaaataatgagactaatttttttggtgtagctcagaagcttttgaaccagtctctaaagggatttccagaagactgttgaacaaaggacctcttggaataaattcctaataattttccaaaatgactattctgaaaaaaaaaaaaaaaaaaaaaaacaaacaaacctcagttataattttaaaattctggtatttgtttaaaagtaaggtttcagccttggtacgattatagattacaaaagccaggttcttccttgtttgctggtaaacacatagtaggcaattcaaaatgttggtcaaacagaagagtggatggacagaacgatatggaataaatgaaaataaattatttttctccagctcttggtctttgaggaatcagtggctccgatagcttgttgctcatttctaagaagagcagaaatagtaaagacacacagtaaagagagagcagaaaggtttcccatcctgcataaacagagaaaatttccttctgtccacatgggagagtctgtttttgttttgtttgtttttctttttctttaacctcgaggttggcaaaataccctctttaaaaattctgtataatcaattttattgtatcctcttccataaggatactccaaagttggtcacaccttcgaccagttgaaaggcagtaagaagctcttgtctccaacctgcatcatggccttatagagaaactcccttggcaaattgacaatgacagaagaaatctgggggggtgggccaggtgcagtggctcacgcctgtaatcccagcactttgggaggctgaggcccgtagatcacttgaggtcaggagttcaagatcagcctggccaacatggtgaaaccccatctctacaaaaaatacaaaaattagccgggcatggtggcacgtccctttagtcccagctactcaggaggctgaggcaggagaattgcttgaagctgaaaggcagaggtttcagtgagccacgattgcaccactgcactccagccagggtgacagagcgagacctgtctcaaaaaaaagcacattctgcacatgtatcccctgcctttttttagaagaaattaaaaaataaataaataaatctgggggtggctggtgaggaatgtgttgttgtgccctacagaactgaaatagaagaactcaagatcagagcagtagcttcactgtggttgttgattttagctacgtgatctctgaatagtcaagaagtggtctggtctgaacatattagatgatctggctcttaagaagttataaaggtgaactttttaaggttacggtggtgtgtcataactgtcatcccacctgaagccaccggaaccatgctcctcccccacccacagagtgagttccaggtgggaaggcagttatgacagttgagaagtagtagaagacacggaaggcacagaaggcagacttcgctcagcacaaagaagaattttctgataaccatactggcaaaatgaactgggctgccttcggagggtctgaattcttcatcccagaaggcattcagatagattcgagatgcccactaagcagaaatatcacggaatggtatcaggagtaaaggagggttggggagagggaaggttttgacgtgctcatctcttccctcctcgcaaaagcccttcccataattcaaaatgccttctcatctgtatgattttgtgactttcattgtatctccatgggtagagaaaagtagttaatatgttgtgcggtgtttctgaaagcgaggtccacggatgacctaacatttgtattgccacgggactgtgaaaatcgactctagacgtactaaataggagtctttaaggggggagcagggcccaggagtctctattttaatggttttttttcttcttcttcttttagtcctagctactagactaccagggatattttaatatgttttgtaagtgattcttagtagtagtaaggtttgagaatcactggcttagtggttcaaagcacttgggaggttcaaatcctgcctctgctccttactcactggctgatcttgggtgcatgacttaaattctctgggccttagtttccttatctataaaaatggggataataattaattctagctttatggggattttgtgag

SEQ ID NO: 17028 - DNA, 88557 bp, Human
  misc_feature (1)...(88557): n = A,T,C or G
gctagttcttgtctttataacacatgatttttttactggttgtattcataatgtagacatatatttttaagtatcagaaatccaaattttcataggaggaaatttcaattttaataactatttttagattattttcctcatcctgagtttatttcatcttcttattgttttcttctgaatttacatcttttcatcagaacaaaaagaatacaatcagtttttcagaagtttaaaaaattttttcaaatatatagcaaagaatgtcatcatttttatatactctaccaggactcctgaaaccaaacacttaagaaaggttatgtctggaaattttttcaaaatctatatgcatttcagtggtggagaaatagttctgtctggaagcaggaggctgaaattatgaccctgaagatttcttccagcttttgaacttcttattctatgacaactcctggtagatacaggtttcctggtagggattgagcaagaagcatgcacaattactttatgagtcttgataaagctggaatttcaggttgatggttagaaggagttcggctgggtcgtgagaatgcttgttttcctggttactggatatgccatgggctgtatatcttgtgttgtcctgtggtaactgaagccactgttgctgtggaaaatgatggcagtttgaatgagataatttagagtgacctatggaaatctgaggctgtctccttaatgtacaagaccttgtatgtgtggcactgttgtatttgaatggcacacatctctttagttcccttcaactgaaatgacaaaaggtgagaaactgaatcgtaatttgatggcttaatattaaaaaaaaattggcaaaaatgctaaataaggaacaattcagaagaattgctgatcatttcaaaaatattatttgcatagcatttataggtagctaaagaaagagaaaaatggcttaatattttaaaaataatttggtcaatttagcgatctggggattctgcgatccccagaactttgcatccaatttccaaaaaccaaaccttacatctaatgtaaaatgacacaaaaaattctaaatccagtctaattcagtagtatatagcttattcccagtgatgtctcacattcgcaagcccgttacacgttggttttacctgtcaccaaaacctttgtatcactcttataaaaaaccacatcactttctataaaaagtgagtggaagaatctaatattgtaaaactgcacgtgcctcgcgtgacctgagcagaaaattcctagtttgggattttctcacaggcatacctaaactgacctctgctcctagcaggtaaattgctagaaggagaagcaagtgtcagtccaaagaaaacccttgttgtgtgattttttttttctctttaatcgctttttaggtggagtacccgctgcattctctaaagtctttgccaccaccagattaccaacgttttcaccaatttgccacctccctactcctctcctttccaaaagccctcattggaaagaactttctctcgtgacccccctattccatctagttccaatcactcccagcgccccccatctccatcggcttcccctctcccgcccagaatccaggttcccaaaccacttaagagaaaattcacaaccctcgcccccttcccgggcgtccggaggaggcgctggggtgggggtgtctgtgggggacagggtttcctggggtctcctgggtcttcctcgcgcacccccaggaggtgttgcagggggaggggagcgcgggtgggtgggaccgggccgggtgggggaggggtgagggcgaggaggaggaggaggaggaggcggcggcggaggagtggtgtgtgtgcgagcgtgtgtggctgggggaagccattgcctgtttaatagttgctgttgctgcacttccgcttctctcccagcgagagagagacacgagtggccaggcccagccgcagccgcagcagcagccgccgcggcggcacggaggagccagacacaaagagaggtacggggatccccccagcggcccgccgccccccggccgcgccgccgggcctcggggacacccctcgccgcctcccccgactcgcgccgccggggccgccgggccgcagggcacggggccggcgcggggggggagcggagaggggctggggagccccaggggtccggggcccgcccgcgggggatgggcagggaccccgggccgcgtggggtgcgggggccgcccgcattgaggacgggggtcattgtggctcgaactgtcagcgctgccccaagagccccccactggccaccgaggggcccgggagcgggggtgggagggagttgggggagccccgttttccccaggggcgggggttcgcggggattaacccctccggggcggaagggctcattgttatgtcttcgctgcggaggccgacccccccattccccgccgcagcccctatccccctacaggagtggcgatcgggcgtgtgctccggacccccgcccggccgcatagctgtgagcagggcggccagaggcaggcaggccgggaggggcgtcggggcgcggcgcgggggggcctcgggcctcgtcgcccctgccccccgccggcctctcccttcccccacccgggcacccgctccccgcctccgtccccctgtttcggcttcctctcttactccttcccgcccctcctctcttcccgacctcgccaaactccgctcgtggccccacagtctcacccgggccaccggcccctcacgacccccggaaagcggacaaaaacagccccgaggccggccggccgccgggaccttccctccctgccccgccgtggcgccccgcgccccccgccctgccctccttcgcctcccgggctactccctccctgcccagcggagagccccggggggcgagggaggggcctctctcctagctccagaccgttttcccacagcgttccccacttggggccaaaaataaacaagccgcgtccgatttgcaaaagccttaatgggcctgcagactttgaaaagcgagtggagggcggtgggcggccgcgtgcgcccctggtcaatgccctcctgacagcacccgagttccttatttacactggctgcatggtttgtgtgtttctgttttgtttctctccccctgcaggggctgtttgcggggtggggtggggggttcgctatgtcggatgacgattcgagggccagcaccagctcctcctcatcttcgtcttccaaccagcaaaccgagaaagaaacaaacacccccaagaagaaggagagtaaagtcagcatgagcaaaaactccaaactcctctccaccagcgccaagaggtactgtgctcttttttttttccacaggcttcctatttccgaactgcctcttgctgcatttggtctgcctcccaatgaggatagcttaaacgctcctcatggtttatgtgttcttaaaaatgaaagaagggccttggaagccctaattattttctctattgctgcttctgtttttaaatcattgctcacatgcagctgttgcggcttgcctctcgcatttcttgctgaagtttgtaagattcctcgttacttttattagtgacccccaaatctgatttcagatttcttgtcctactaatggttaatctgtgaccttccccaaggccatgatcccatttcttaattactaataccagcccagagaactgcatcaaaatgaattctgtgaccattttaccttctcctcacctgttgcatggatgatcttttctaaatagagctttcttcacaaattgcataaggaataagaaactcatattagcaggtacaaaatttagtaggtgaagacagatgttttctggtggaatttaaagagatttttctgagagttgaggcaaatgaatgaatcagtaagtgactataaaatggttattctaggttatttttgtggttctctttaaaaacttcagtttaccaatttcagggagacttgtctttttttcatgctatttgctgtcctcatgctgtgaaaatgttactttgccttattttttcaatttaagtggtctcccttttactttattcttttcctcttaaggccctgaaggtagctactttttatccctgccatcctaagcggtcaccctttttctttattcttttcctcttaagcctctggaggtagctactttttacccctgccatccttcagtaatatcctctgatcgccatgaccctcaaaatcatctttagtggattcctaggagctctgagacaccctttcataaatccttctgctctcagagttaggcagttgttaaaaaggtggcaaaccaggaagatagtaagaactccaaatgatgggatagggatacccttcttaaaaatttttaaaataaagtagaacatgagactttagatctctccactgagtagtgagcctggaagtcagggtttgagagtttgttctgtcattctccctgacttgtaatttgaaaacttggcagtgttttggtgacctaaccatgggctgatgaaggagtgacttttaaaaaatagtgtggaggtcttaagtggcaaggtgcctctgcaagattgttctcatttttataggtttggtttgattgtacagcttctcaggaggcctgactgaccctcactgattagccctgtgcggttttcctggaacctgacatctactctgcccacttgggacgggcccttccttaatactgcgccccacctcaatcctctaggctctctgatcctcattcacgttttggcctcacgtgctcaagccaggatacttgcttttggtaatttgcatttttatattttgctagatatccctggtgtacatgaatatatttgggggtaaagacacaggtatcaaatagaaaatactctgcttttgttgtgagtgaattacagagagggggatttttttcactagacatactttgtttattttaaacaagttaagaatttatttggaagttctggaaaagagatgataggtgtagaaaaatgaaaggtgggaagctacaaatagtaattttacctataaattaacatcagggcttttgttttgtttttgcaatgaatttagctccttgataatcttgctgaaagagtagctattagtgttaaagcagacctaaagttaatagaaaaaggtaaaaaaatggagagggacagtgtatccaggaaagagaatggggaaaattgatgttagtgggaccctatagaggctgttctgtgaagtatattgatttggaaggtaggtgttgcccatagaattggaaggggcacattcaccaggagtaggagtgaaaaagaagcctgaattggcagactaacaggctgctaactgcatgttggaaagtggtttctaaaccgtgggtagaggaaagcccccattgcaagtggtctgaacaagaatgactctctggaaataggtatgagttactcctgcaaatctcttgccagttttttggaaatgcaaatgctgtctgtcaagatgaagttgataaagctttttggtattaacgcttcttaggtattaaagaaacaactacctttttttgtgactattttatagtgggagttgggttggcaaggaggactgaagtcaatatgtatttttatatgcgttgtgctccggggaggaaatttttgcctacgtgtgtaggtcttaaaatacagttatttgaaaagattcaggtaaagaatcaggaaaccaattttccaaactttgagtctaatgtacagtcatgagtcaaacagcgggagtatgaatgtctcagaaatgaaacgctttttgatagtagaatttagcaggacacaaatacgtgtcaattgagattgtgaacaaacccctttctaaagttgacagatacgtagggacaggaaatgtcctccagtaggaaggtttatagaacctcccccagtcgtcgtccttaaaacctgttcctcattacatatagctcgtccgtcctcctacccgcagaaaacctttggaaaggaaaacgtatcctttgtgaattagattgctctgtgtgtgtgtttaaaatttttttaactacagtgctgcctcggtgagatttttaagttgtaacatagccccattgggctttatatgataggaggaggaaaggttataaaattaggcaccgtttagaaggtggaagaagcttagaggccctaaactgtcgtattaattgatgctctaagtgcctaggtaagcaaaagacaaaggccagggcttggtgtgaactgcctggtggcttcggcctatgagtgggggatggggccctttgtgaagtcgagggttggtgcggagggagaaaactgcaggtctccagtctatccccagtgtgagctagagagcggaccatgaaggaagtgggcagaccccgggaagttagaggacgcccggggaaaagcaggtccggggaggtgggccgagagtcccggccagcgtgcggggcggaggcagggtccggtgcacctgtgcggccgcgggccggccacttggggtctgtggtgcccgagtggcgggcgggggtgttcgcgccctgctttcgcgcgcggtctcgggccaaggttctgggcgccgggagaggagagctggggcggcgcggagcagcccccgtgcgggcaccctgttcccctcccccgcccgcaacttcaccggcgcggcgcgagccgtcgggggcgcgcgcggggtgggggcggcgtggccgggcggtggcagcccaccgctggggagcgacctgcggtctgggcctcccgggcaccccgccacggctggcaggtcactcgggcccgaggggcctcgtggggagcggccatgttggcttcgtcactgaggactccgggcgggtcgggtgttgagcgaggcctcggaccttcggcctgtcgggggcgccctgccggggtgggcatgggggcatctgaggggtgaaaggggcaagggaggctggaggctggcgtccttcccacgcaccgatggctgtgatctctccgtgctggggagaggtgcaggggagggactgaggaaaccggtcggcaagtgagaaactttaaaattaggtcctacatggaaaacaccgaggaatagaactgccctggtgtgcgaggcaaggttggaagccaaactttgcagatgagaacaggagattccaggctgcctcacttcctccgtgaaaagtttttttcctaaactagggacctgaagttcttgatgtgtagttcctctttgcccagtagaatccagtgatcgcgcttaggtttatctgcagacctgcacgctacaggtgggaggcttccgcgccttaatgcttcttgtgtttgtctttcccatttctcccactccagaattcagaaggagctggcggacatcactttagaccctccacctaattgcaggtgagttgcttttcggattttttccatttttaaaattcttctaacctttgtcttgggtttttctttttattatatactttttctttgattctttggctaatgcttgttatggcactaacatcacgtaacagctgaaatttattaacctgagtataatgttttgatgagcctctgacaagctcagtactgttgagaagaagtaatggatttatttggagtggatttttacatatatgaaacaaaactaaagtaaatttaaaggtgtctccttgcctaatcatgggtctttgatatgccattaaagatgatgtaaaacctttcagatgcgaaggacattttggtttggaaaactgctttgctacagtaatctcttattcaatctctgctaagctaagagaacattagagttaaacactggatcttcaaacttactccatagcatatagattttttattagacttttggcagagcaattcaggaaacaatttctggctttgataaaggttttcttttaaattgtagagttaaactttcatggggtgtttttttcacttgctttattcagactgtatacatatgtgtgtttcagtttcaaaacaaattgaaaccagctttctaagggtttgttgatcacagctttatttagagaagccattttgctactgttgagtcaaggtggaagacttgatgactttactagatcaacaatgaagtgagggtaacttacaactatgtattagaatagaaccatttatttaagggaggtcctgtaactcccatactttaaaaattaagtataacatttaacctagttctcaagatcggcgttggaaagggatgtgagatttcagaaatactctaaacttattggtaggagtagaagttactgacaaagtattcagcggctatacacaatttttaagatgagtgtgtgggaataggttgaaaagctaaatgaagtattttgtttagtaacagtgaactttggaaactaattagtggattaaatacaaaactattgccgttttggttacattcattcttaatgttgattaggtgtgggatgctcttccgtgaaactttgtcctgttttgtaaggaaagtcattttgagtttgaaatgctcttaaactatagtttataattggaacacttaatcattctggggaattctttcctggctaataatctctcaagatggttgagaagtggaaaaaccataagacttaggcctaactcattattttgatggtggtggttcacgtggaagcctgtagcttcccttggttgtttgtgtggaatccatgtacattccccaaggtggttctgtgctgtctagttattgctcctgcttggtattgtgtgtctcctatgtgtgtgttattaataacattgattaaaacatataatggctttcttgtgaataagcacagtcaaatctaaaattgtaaaccatttgaagattttcatgggattaagcatttaaaaaaaaaaaacagtgtaagtacacttcagtttcacatcgttttaactgagtttatgtgtgaaagatttatgctcctgaggcatgtggaacttttttatctttgggaaaccctcccaattaccccttcaaggtgaaacgtttgggaattacctgtggtcaggggatgcaccaaactgggtggctgttgggtgattggtgttacggagtcaaagctcaaaatactaaattttaagaaaaatctctgatttgagagaaaatacgaggcatcttcattttgcaagagaatgtatattacattgtcttttaacaataaagatgactttattttctgaagatattttccagtggggccgtttgagtaatgtgaattaaaatttttacttttggttggctaatggtgctgtcttaatgttatatagtagtcccaatattcagctctcttaaaagagttcggttttacgttttgtgctgttaccttttggaatttaattatttagtattttaatgtactttattggagataaagatggattatttatttatttatttatttattttctttttgagacggagtcttgctctgtagcccaggctggagtgcagtggcatgatttcggctcattgcaacctccacctcccgggtcctggttcaagcaattctcctgcctcctgagtagctgggattataggcacgtgccaccatgcccagctaatttttgtattttgggtagagatggggtttcaccatgttggccaggcaggtcttgaactcctgaccttgtgatctgcccgccttggcctcccaaagtgctggggttacgggcgtgagccactgcacctggccttggggatactttttgaagtcagcgtccaatgaaaatctatgaattaagtgatatattaagtgcgtacatgtttaaaattaccctcagcatgaaagcatgagatttgaatgagttaaataattggttttcaattagtctgtcttatatttttaccctttgccatacttcctttcttcagtcagcattcagtgtgtagttttaaacacgttattaaaatatggcacttggcacatagtaacttctcagtaaatacaaaaattagccgggcatggtgatgcactccagcctgggcgacagagtgagaccctgtctcaaaaaaaaaagttgattattgcaaatcagtagaattgctcctcttgaaggaaggtgcactgtttgtgttcactaattttggcacttggcaaaaatatttgaagttactgagcatcaaaacttatgtgaaatgcaattgctcaatatgttataatgtatgaaaacataaaattaaattcttaatgttgtatattatgttgggtggatattttttagaacacagtacagattgtgttcaatgacctggtccaaagtcattttaagtaagtattttcaaactgctttatgttgccatagaaatcaaattcttaattttagtatctgtgatttgtgtgtgtgtgtatatatatgcatacacacacacacaaaatagtttcccaactcactcttcattttggttaggcttttattcccatatcatttagctctattcttttagggaaaaaaatatgttaactttgtaatgattccctaaagcgtgccagatcttagattgtaaaattatgccttttagatagctgatgaactctgggccaccagagtcagttttgcagctgttatttatagcccagggctcaaactttgctaaattgactagttataactagcctgtagacacgaatatctgtagacagtatgtctatacagactaaatggcatattttgcctaagtcctttaaacttcagattttatttaatggatatatttgtttcatgagtaaatgtctcagtgacttaacctagaaattcagatggggtgctattttaggataaaatgtctgaaaagtcattaaacacttcaagcatgggtgagaataataaaaatacatttctttctttctcactttttttttgagacagggtctcattttgtcacccaggctggagtgcagtggtgctcactgcagccttgacctcctgggcttaagctgtcctcctgcttcaggcccccaagtagcaggaactacaggcgttcgacactacactcggttaattttttgtatttttttgtagagaccaggttttacctattggccaggctgatcttaaactcctggcctcaagccgtccacccactttgcccttccagagtgctgggattacaggcgtgagccatggtgcctggccctgatactagtttttctgtatgtgacagaatttccatttagccttcttttgatagcttttttttccctaacactgcctatattttaaatagttttaagccattatattatacaagaatgcatgtttttgaaaaattcaaatacagaagtttgtggagtaaaaggcaaaagatagtcctgatgacctcttctgatcctgctccttgcacacagatgctccaagttagcactttgtatacttccacgtagtttctgtgaatttacattgtgtttttctggcattccaatacctcctcgaattggtggtaatggtaatgagatgtcagttcagaagtcccaggctgctcatcatggttcacaatggaaagagatccttttcttgcaacagtggagtgttacatacctcgtccaggttcagcatgttttaaatggttgtttgggtataagaaataggttcagcagaagtcatcctttataaaaccctgtatcttatgtgctaaaaagtattcttccttttagcatctttcatttatctgatgttactaaatgcattaaggatagaagtgtgacttaaacatctgaatgatgtttagtttcaccattgcagtgtgtatacctttatgcatgtaaaggcagtgttgaaaaattgtgacaaccaggagactggggtttcagcacgatcaaaacagcacccatactagggtcaggctgttgggaattagatcatcactggggcctttcctattagagaggaaagaaaccctatctggagatgaattgcctttcaaatgagcaggaagtcttgtggcggttgtgtttaccaaaagactatatctggattgtaaaactgtactattgttattcctcagaaagctaaacagaattaccgtatgacccagtaattttactgctatctatgtaccctgaataattaaaaacagaggctcaaacagataacctgtatgtcagtattcatagcattattcatagtagccaaaaagtggaaaaaacccaagtgtctgtcaacagatgagtggataaacaaaatttggttaatctataaactggaatattcatctataaaaaggaatgaagttgtgatgcatggatacaacatggttgaaccttaatgttatactaagtgggctgggcgcagtggcttacgcttgtaatcccagcactttgggaggctgaggcaggcggatcacgaggtcaggagatcgacaccatcgtggcgaacacagtgaaaccccgtctctactaaaaatacaaaaaaattagccgggcatggtggcgggcacctgtagtcccagctactcaggaggctgaggcaggagaatggtgtgaacccaggaggcggagcttgctgtgagcagagatcgcaccactgcactccagcctgggcaacaaagcgaggctccatctcaaaaaaaaaggttatactaagtgaaataaactagaaccaaaaagacaaatagcgtatgattccacttacatgaaatacctagaataggcaaactcataaggacagacagtagattagaggttttcagggactgaggggaggggagaatggggagttatttcttaatgaatacagtttctttttgaggtggtgaaagttttggaaataatggtgatggttgcgcaatattgtgaatgtaattaatgccactaaattgtacacttaaaatggttaaaatggcaaatttcatgttatatatattttatcacaataaacagttataccactgttaaaatattaatcagtattttgagaaaaatgcttatagcttagaaggcaatactcacagtttttggggattcttgttaaattcctgtcacaaactttgagggcctgttataaatgaaaaggcacaagctgggcatggtggctcacgcctgtaatcccagcactttgggaggccaaggcgggtagatcacctgaggtcagcagtttgagaccagactggccaactaaaaatacaaaaattagccgggcgtggtgacgcgcgcccgtaatcccagctacttgggaggctgaggcaggagaattgcttgaaccctggaggcagaggttgcagtgagccaagattacgccactgcactccagcctggttgacagagtgagactctgtctcaaaaaaaaaaaaaaaaaaaagaaaagaaaaggcactgccttcaaggagttcataatctagtcaagatgttaagacatgcacacacatattttgaatggtacttggaaatataaatattatttggaaaataataaaatgcagatatcatgttataaagtttcagaggagtgagagattactttgacttgggtttgagggattgtggctggagtacttagtgatctgggaaggcttcatggaagaggtgagaagtggggtggggaagaataagggatattcgtgatggaacagtgtaagccaagacagcagagggaagacagaaaaagggcactattgggcagaagtgagtaaaagctgtgtctagagaggaagaaacattagtgggagaataaatagtaatagataaagcttgtgttcttcagtgtcaggctaagtctttaaattttattatgtagatgctggagaatcattaaaaaccttttgagtaggggctgtcattcagatagagttggctatctggatagagacagagtaaggattgagtggagcttggtaggaaccaggagacttggagattgctacagtagttaaggtggaaggtcaagagggtctggggtgtaagtggtggccttcaaagtggagaggaaagagaggtagaagacagtagaatccatagaacttagccactgatttcgatatggaggacttgaaaaggagtcgggttcttctgggtgttggggaagttggtggtgcattaacagaaataaataaggcaggaggatgaactggcttgagggaaaaaggttttgttacttgcttcgttgatcacatgcaatgcttagcatgttgctgccacttagtaggtcctcagtaaatatttgcagtttgactatatatttgagtttattattaaatcagtcattgaactcccagatctacatggcctacttttagattagattagacaaattaaatagattataaacttcctaaaagggaaggacaatgatttctgtctttgattctgaccctacatgttcttcccaactgctttagtttgacgattttcacagctacaggagaagttaaaagaatgatacagcaagcgcccacccttcaccgtgattcctcagcaaaattacaccatgtttgctctgtctctctcttatctctatatgataattttgtggagtcatttgaaagtgagcattttgatgcttccgtgtgtttagctttgcacacattgaatctgaggtggcctgacggtggagctgaggctggaactggttttggtagtccacattagatttgaaagtttgggtgatgttaaagtgcacaagattgctgagattggaggaggaaagaattgtgctctgaaggatgtcttcagatggaggatgggaaatgaagaggacttggagaaaggagtaggaggaaagccacaaggttgcaaaagtccctagagggagatcaaggaaattttctcttggggctctaaagtataagaacttaggtgtatgttttgtaggctgagaggaagaagcaaatatagagagaaaaagagtaaaaattgctagagagtccgggcacggtggcttacgcctgtagtcccagcactttgggaggaagaggcaggcggatcatgaggtcaggagattgagaccatcctggctaacatggtgaaaccccatctctattaaaaatccaaaaaattagccaggcgtggtggcacgcgcctgtagtcccagctactcaggaggctgaggcaggagaatcgcttgaacccgggagacaggggttgcagtgaaccaagattgcgccactgcactccagcctgggtgacagagcgagacgccatctcaaaataaataaataaataaataaataaattgctagagaggcagatgtaatgttttataacataattgtagagaaactgatggccctagagaacttaggccctaagtgggagaatgtatgtttagaaaggctggtagcctggaattttctagacgattagaagcatttttggtgcttgagtagcactctaggtatttgtatagaactgaaaagaagcagcatctttctggtgttatttggtttgtgttctttcccagcagactttaagttcctcgagagtagggattattatgtctttatatccctacagtgtccgagaaagggtaggtaaacaatacatatttgttaaaacacaaaaacctaatttggtcggatggtttaatagaacatcttcattaccctcttcagaaaatagtggaaattgctggggaaattgctgtcacattttacagctgtccattgctggcagtctttctgagttggcacccaagcagttttagcaattttgaccttcctgcaatcacagagaagctctggacgtcagtgtggcaaaaaagatgtgatctctgctgcaggctcgattgagaaaagatgtattggagaaaatataacacctttgaattgcttgttttgacttcatgtaaggtttatcatctatgtaatgtggcatagactcttagtctacagagttacaaatggtaaccttattataaagttaccttatgttaacaagtgagcaagggtctaggggtgctaaatacagtgggttcctagagatggtcccccaagtcctaaagctattccagatagttggttatgttagagttgctggcacccgcctgagacatctgacacatcccatgtcaccagtgaagtgaaactgggtttcataataagcccattcttattcagcctcttttatgcagccatgctctaaagtgaaacaaaagacctagtaactggtgtcagaatatgcttctaatcctctgggaaacctcctcctttataggctaaaagctcatcaaagtccctgcttgagaaccgtaatccaggaactttgctgtatgctaatggctcttttcttgaaacatatacacagtgattatggattgctttgtagagtccatgccacattacatagatgatcaacctttggaaggccaagttgatgtcccatcccactcaggaaatcttacaaagccaaaggttttcacatacagaacatatttaagttgtcactgggttttgctacagtgacagcaaaccattggggcagtgtgttgttcactaatacttttaacagagtagttaaaaactgaattctgtctgctctccaaagtacatgctgacccaaatatgacaaagtgaatgcaaagccctcttatatagcattcaaaggcagatttgccacaggtgccacatctgacttgtctgtagtgatctgagtcattattaaattttaaatagtaatacaacggagtagtcttagtagagtctactagcattgaaatgatgatcattatccatactgccagtacattggccatttgtatttattaaaattgatcgatggaaaattggtgtgggatggacctctagtaaattctacagaaaaaggcattgaggcacatttccaaacagatgagagtaaatagagtaacttgggatgatcttacttggagaaaagttttagatgtgatgcagctcaaaaagtcagcattattatgaagcaatgttgtacatgtgacagcagcatgagtagatcagatcgtaatcatttaaaacattagagtgtctgctgtgtgctaggcattgttctgtaggtgactaaaacagacctggcctctggcttgtgaaacctgaattttagtagacagtgcaaacagcagctaagcaaaaggattagtacaagttgtaatggctagtaggaaagaaattgacagagtgcagtgatggagaataattggggagggtgtgagggttacctagagaagccttacaaagacatttggtcaaagacctaaaagataggaaaggaaatggccttgtgaaaagtaccagaagacatctgggacagagggaaggtaaaaacaggccctgaggcggggacaagtcaggtgatgctgattatgtaaaccgtgctaagtagagagtttggatttttctcaataatgctttaaaagtcttttcccaccctccctgctgcatggaaaatagctgggaggaagatgctagtggaagaagggagaccagaaaggagggtattgctctgtttcaagctagctggtgcaggtggctaggattaaggtagtggcagtggagatatggtagaacactgggacctgttgttggattgcatgtgagagatgagggacaggaacaaaaatgactccaagtttctgtgtttttttgcaattggctagatgatagtgatgttttactgataggtagactcctaggcctagaatagggccgtagggcgcgtgtgtggtgggtggcaggggagatgagggcagggtggaaatgactcctttttggacttgatagatttgaaatctgttcccatgaggcatccaaatgaaggtgtcaaaaataagttagacataggtaattggagctctgagatacatacacatttgtaaaggagaccttaccaaacagaggctcttgggtgtcttgggaatgcctttctctctcctagaaaggaaaggcatcatgagaagagtgcccaggatgaagactcaggcatctggcatttagaagtgtacactaggaaaagccagcaaaggagacagaaggaaaatcaagagagtgtggtattagaaagcagtgagtggaaagttttgaggtagagtgatcaagtgggaaatggtgctgtgcagtagaaaaagatgaagaccagcaagtaaccactagattttacctcaggtttgttggtgaccttcacgtgtcaaacctggtttagaggagagacaatggaaaaggaggaatgattttcaagaatgaaaatgtgtttgtattactcttcctagttaaaatatttcattgtatttatccagaaaagtgatctggtgttatctactttctacactttagggcagaatttcttaacacagtatatataattttgtggggaggatggggaaagggcccaccattttcagtggattctcaaaggagttttttttttctgatctcccctctttcctcaccaaaaaaagttaacttctactttacgagattcaagtcctttgtgatctttaggttaacgttgtaccatgcatgttacaagtaaatagtgtcaggttcatgtattacatcttgatgaatctctttttcaagacttggtttgaaattactggataaattggaaaatcagtaaattgctgctgccatccttaaaaatattttacatgctttgatttgcatcgaccttttgtattctgttcaagctggagaatgcactagaatgagttggatatatgtatttacttttaacacagcataagttactcatcatatttaatgtttttcatcccctcccccatccccccacccccaacccccgccaccgcccttccagagacggagccttgctctgtcgcccaggctggagtgcagtggtgccttcttggctcactgttacctgtgcctcccgggttctagcgattctcctgtctcagtctcctgagtagctggggttacaggcatgtgccaccacgcccagctaatttttgtatttttagtggagatggggtttcaccatgttggccaggctagtcgaaaactcctgaccttgtgatccacctgccttggcctcccaaagtgctgggattacaggcatgagcctctgcgcccatcctgtttttcatccttttaatatgggctgttatgttaatgctttacattggatatacttagaactcttaaagcaatcatataagcattgtctttttaattgtccactgatcatgtcttaataatttgtttcagattatgccagatactcttggtcctgcttaccttgataattgagggtagaattaagaaagttttaggattaggaatcattcttctaattcagagagtaattagttggaatcacaaaagcattaggtgctgaactgccagagacaagcaacaaataatatgtggaaccacaactgttttggctacgtaggaattttgctccacaagtaatttaaattgttcctactaccacttacaacctttcctcctctatgggggtacatctcaatttttaagttaatatattagaattggtgttataaaaatttatttcttagcagactttgctacaacacatttatcctaaataaaaggagattgttgactttgcagagaaaaagaccctaaaagaaaacatttgttttattacaagcacccaggaggattttttataaacatgaaagataactttcctctaacctaagtaaatatttcagaaccaacgtatgttaagtgattatagtaatgtgtgtgcagagactggcagtaaagttagcagcgtcatatactacttgctagtatatcacactgctttggcctttttctgagtaaccctctctctggaagtcttcagaatgcctaacttcatccttcagggagactggtagcccccgaaaagacatttattttttgtagcttggtattctgagatgttctcacatccaaagtaaacactgtcaagtgatttggaccagtcctaaagtaaatcatatattgaggacacagttcttgttaaaactgaaatttgaagttgttgccattttctgcattcacactactggattctttgtagatgcggggatttctacttctacattttactgtaactatttacatttacctgtattgggaggaaattctatattgtagcaagttaaaacacatgattttggtaaaaaagtaaaaactgttaagatcttggagcccagacttatttgttatggagatttggagctaggagggacccgatgctcccttctctgtctctgtgtcctgtttattgtgaggtgtatattgataatgaatttgtgaagaaaggcattctttgatgacttagcagagaaaaaagtgatagtaattttatccattctgtctccagatgactggtactatgttttactttctcctcttttctccagagccactcttaaaatctttctgcagttaatggtttgttatagtccaattttcattgctttccaagatttgaactttctatctgaatgtaagtccccctccaaaagcagtcatctttcagttctgtagctcctctgatactcttcaagcccctcaaggagcattaggtttgaggatggtaacatttactcgttgtcctttgacctgaagatgcgtagaaagaaatgctatgttggatctcagtatacctaataacagtcttgcaggctgaatttgcattttcctttctggttgaaatcttgtcagtttactcatgcatttctgactttctcccattctggtgtgcttcctccccttcctgctcccttaagaaaaaaaaaatggttagccagttcggtgaagttttctcagaaatttcttgtggacagtgctaacttaagccggaaaacagtttgtgacacttgacttttcaaggaggagataagattttgtgtacccagactgtatatatcaattattatggggctaaactttgaaagtatgactagttccccaacaagtatatacgaaaccttgtaggattagtaattatatttcttgaattaattttaaaaatatgtaacatactacacacacatcatttgcaccatgagaattgtccatactaataagagatttttgtttgttccagttaaatcttactcctagttttgcaagtgtattcaggcctgcatggttgtcagtgactcaggtggggtgggcagggcagtctccaacctgccccacctgtgtttctctgcctgtttacttgtgaccttggctgagcagtacaaatcattgacaacactggcagtgctttggtctgtgcctgccctggcttattccattttttggccctttgattgaagatgcagttacaaccagtggctcctgactgtatttagtcattcgttctgatatttatcggccatttattgttgtgccaggtactgaagatacagcagcaaaaaagacactgtctctgtgctcatggagattttattcatatagagggaggtacaataaaagaaacaaatgtacaaaagtaatttcagaaaacagtaccaagaaattaaaatagagtaaaatggcttggtgagtgactgcgcaggttgggacattggttggtgccacattggggaaatgaccctgaatgatgacaaggacccaaccatgagaagggcattttaggctgaaggacagcagatagaaaggtgctgagtggggtaggccagtgtggctggacatagtgaatgagggtgagagtggtaggaaatgaggtaggcaggggtcagattttatttgaatttcagtagaaagccgtgggagagctttaaatggaggagtgaaatacgaggtatttggagaatacctcacgtaaaatttcctactcatgaaaagagagaaggcaggtgcagtggggcatgcctatattccccgctgttaggagactgaggctggaggatcactcaaggctgggagtttgaagctgtggtgtgtactatgattgcacctgtgagtggccactgtgctccagcctgggcaacatagtgagatcctcatttaaaaaatagtattctgttcagtgttttgaaaaaattgtattaaaaaatagaggttatgcagatactctgtaaaacttttttggcattatatgcagttttactgacctttatgtaacagttctattatatctagatatctgtgtatctaacaaatttagacattttgcaaaaactgaagacatgttaccaaaaattggtgcctcaaccagtgaaaggaagtatagcattactcagctggtcttgacgtaaaggttggatgaagtgtgaatgtttgtaatgcatacataatatttaaagctaacagaaacaacttcttagttgtctttgtagtgtgcttgccttggttcctggctgttcacctgaagtgaagacagcctgagtctggcagtagggaagcatcaagagtttggcttcctcctccttcagagcaacaacagcaaatgacacagcagggaaactaggagagttgggcagcttggaaacagggaacctcagcagtctgggaggcagcttgccagaactcctcccagccctcacttggttatctgtgatatctaaaagatttatctctacagtgtgaagccccaaatctgtgatatgactatggagggagaatgctttccaattttcttgatttggtagatacttttgtggagttgtcattttttcatagttttttgttatgatagctgaaatatttgttctgaaggggaggtctaaacacatgtaataaggctaatgaagagattggagtagcagtgtaatcattcctacacgtgtattttaaactttaggtactaaatccctttttgatatatatgctataaaaatgacttataaaatgaaatgtaattctagcatatcttaaactgttgccaggaggtttttgggttgcactgataagaaattacatgatttcttgcagaagggtcatttgtcttgctaaaggaccagtttctcatgactcctccctctccccactaataaacagctaagaaaagggcccttaggacattttttttcacttatccattataaaaagttattcacaattcttaaagggacaaaatttcaatgcagacataacatggctatttgctcaaagggaaaaaccaccaaataataaaaaaaatcaaaatacaaaaaaaaaatcctgtattttatattttgctttggggtgaattttggtaattctaaaatgatatgaatgcatgaatatatccagtattctgggtgttcattcactttatacagaataatgaaggaacagtagaaagcctgatttatgatattctggacagctttttagatttactatacaaattttagcttagtttctttttgcttcacactgtgtgcggtggagattttaaaaataggataaagctttaataataacagctaactttattaagtatgtcaatatgattgttattctcattttataaatgaggaaagagaaccttaaaatgcttaagtaccttgcccaaggtcactaggctcttaagtggagaagctggtatttaggccctggccttcaaagcctaaccattatactctactgcctcttatagtggctttatgaattatagaccttcttttgagttgttgatgttaaattttactcatatgcagagctgtatttaaatttaaaaagaggcttattttataacatagccactaatatttttcattggaattgccatctacctctacttgttctccagtgtagatttaattcttatattcttttgtttaaaaatctaaggtcctaactgcccttagaattaagtgcccaaaatcttatgtagtattcagatcccctacaacctgatcccagcttttatatttccatcttatttcctctctctgtaacttgctgttttcagtatgccccctaggatgttctctctcccagcttctttcctttttatttttcaaagctctgataaaaatgattcactccacacagctctcatctgtgtcccagggcactttaaatacatacctctttaaaacatttatcacattgagttacggtcatttgtgtttgtctctctgtcaagaccgagtttttaaaaaatatgattatttttatttcttgtacctaacaccagaagatgcctaaaaagtatgaatgattactgaaacaaattaaaatacagcatttagtagtagttgtataaatgttaccagttacttcatttagatgttaccatcaatcacagaaacatgtaggctgaagcaatgaaatcataaatacagtgttttaatcttccattgtgtaaaaagatcaatttctatattgtatgtaaatgtaatataacattttaaatataggtttaatttttgagaagatacacagtatacttagtgattaaaaagttaggtatttaaatctatgagaaaatgggatcattatttggatatttaccagtgctaatcgaagcagttgctggtaaaggcgttggagttgatgcatatagatagaagttacttttgcaataaaacattagagtcaccatcagaacagaagacttgaaaaattttatttgactcaaattacaaactgagcatttatgggtgtctgtgtgtgcatagcactgaattagatcatctggagatacaaaagtgtgatagatgctttcaatataaaataaacgttacatagctactgaacaagacattatataaaggttcgttaatgacctaagatgtaaatttgtttataatttttatcatagttcaatttcatctaaaccttatgtgatttcagtgttttcctcagatttgtctcacactctagtctggtgatttccaggcttgtgcctgtcccagcacacctaaggaagagggaaaatgtccatcaataagtaacaggggtttactttcagtggacagggtggatggaaggagagattagcaaatttggggtgaaaaataaaagccctccagtggttctgacaagctgtagctagaggggggtggcagttgcagaaggggcagtttctccgtcttgtattttttatttttttctttgattcttgaaaataagttcttatttttgataagatggaggattattattattattattttgagacagggcctcaaaaaaaaaaaaaaaaaagagagggcctcgctttgttgcctaggctggaatgcaatggtgtgatcatagctcactgcagccttgaactcctggggtcaagcgatcctcccacctcagcctcctaagtagctgggacaacaggtgcactccacaaagtccagcttttttttttttttaatagagacaggatctcactatgttgcccaggctggtctggaactcctaagctcagatgatcctcctgcctcagcctcccaaagtgctgggattacaggtgtgaatcaccacacccagacccagctgttttctaaatttttttggagaggtggggtcttgctgtgttgcctgggctagtctcaaactcctggtctcaagcagtccttctgcctcaacctcccaaagcacggggtttaccagtagcctgagcccccatacctgcccctctcctggaaaagtgctgaagtgggaaagtttacagatttagggagtccaaggaaaaggttgaggtcgagctaataagagaaggagaaaggaaagaggaactgagaaaggaaaggggtctagaagagcggttagaaatggggactttggttttcccctcaggcttagctcactactttctataaataagagatgtctgaaagagaagcagataaaaggagaaagccttcagcaaatttgtgagttgataagcatggattgattggctctgttggcctgggttcttgaggagtttgctgctatttcggaatttctgtagagaaaccctggcattgtcaggatatgggtatgccacatgtttcccttcctcccccttccctccactccttcttattacctagctagctacacctggaattttggttctagaataatttaaaagatactttgtcaagaaaatatctttggaaaaatcatgcatatattatttttccttttttctttttaactacttcctggttctttaggctcctctaattcttacatgcatgtgcttgatctctgggccatgcttgcttctagttaagtagcctttcaggatggtgtttaatttattctgagccctttataatatcccctgacaagagcatggagtggatagagggagtcttagtcaatatgtattataaatagatttagggttcacaaaggtcagcagccttcatctcttgccctacccccatcacacacaaaaataaaaatcacaaataataaaggattttaagagttataccagtcgggagtgggttcatttttttgtttttgtttttgtttgtttttgtttgtttttggcaagctgaagtcatctgttggatccaaaaatgcataaaaatcttcaggcttatagaaccaacagcatcaaaggaagagcagtgtgactcaatattggggtgggggcaggtttggggttttggttgtgtagaagctccttatgagagaacagtgtgatgcttggagctatggagaatccagccactgctttttctctcttccttaccttattactcttcttgattcacctggatgtggaaactgtccctgtttaagagtggccttgtcaatgctctctgtgtatcatgtgtacagtagggaatgtgtcaagccagatgagtggtctcattgaaacatcagcaaatcagtatatcgtagaatttagatcccccttggaggtggtggtgatagctaacttctgttgcggtcttaactgtgggtcaagttttgttctaaggactttgaacattagaaactcatttaaaacttaaaccattcctgttggtggtcatgtaatcccattttacagattatgaaatcaacattaaggttatgtgcagcttagtaagtggagaagccagaagaacccacgtgatctggcttcagggccgatactcaaccactgtactttggagagaattagtcattctgataccacttttgttattagctaagactctttatgttgcaggtaacagcagtctaattaattcatttaaataaaaagataatattatagggatatttgagtgtgtgtctgataacccaggaactgaaatgttctggatatcagaaacaacagaaaccaggaattctctccaactctcatctatgctctcactccaagtgcgctttattttttctcacatcgcagattgctcctggctgcccacagcctgcctgaagaacatgaccacaggcacccagagagaaacttacttttggccagttgtaaaactcttgggcgagggaccagttagtctaacttgattgagttttggatcagtcagctattttggtaattaaagtgaaagggtccagatgacactaatattgggagctagtttgacaaaatatttaacaaaatgaatactttttttttttttttttcgagacatggtcccactctgttgcccaggctggagtgcagtggtgtgatcacagctcactgcagccttgatgtcccaggctcaggtgatcccctcccaccttagcctcctaagtagctaggactacaggcgcgtgctaccacacccagctaagttttgtatttcttttttttttttctgtgagacagagtctcactctgttgcccaggctggaatgcagtggtgcgatctcagctcagtgcaacctctgccttccaggttcaagccattctcctgcctcagcctcccaaatgctggaattacaggtgcccgccactatgcctggataatttttgtattttttgtagaggcagggtttcaccatgttggccagactggtcttgaatgcctgactgagctcaggtgattcgcctgcctccgcctccgcctcccaaagtgctgaggttacagacatgagctaccatgcccagccaaatacttttttctaaaggaagaaaacttagtcatttatttagctttaataattggctttttgagtttgttcaatactttaagctctgtgagcatatggatcatgccagccatctagcacagggtttagaaaacagtaactgctcaaacttttgctgtgaatgaatgaaggagcaaatgaatgattttcctgaaagggaaataaaaacagaattcagtttctgatcattgtccagggaatggcttggacacaaatagttgacctgttggaagagaatatacatttttaataaaggagaagggactgtgtttttcctggagggaggagacctgtaaagaaaaatatagaggtgtggggggctgggcgcagtggctcacgcctgtaatcccagcactttgggaggccgaggtgggcagatcacctgagctcgggagtttgagaccagcctggtcaccatggcaaaaccccatctctactaaaagtacaaaaattagccaggcgtggtggtgggcacctgtaatcccagctactcaggaggctgaggcaggagaatcgcttgaacccgggaggtggaggttgcagtcagccgagagagaatcgcttgaactcagtgggtagaggttgcagtgagctgagagagaatcgcttgaagccgggaggcgaaggttacagtgagccaagatcttgccactgcgctccagcctggacaacagagcgagactttgtctcaaaaaaagaaaaatacagggatgtggtgactcacacctgtaatctcagcactttggttagctaaggcgggtggattgcttgagcccaggagtttgagaccagtctgagcaacatggtgaaacccccatctctacaaaacaaattttaaaaaataatccaggtgtggtggtgtgcctgtcatcccatgtacttgggaggctgaggcaggaagattgcttgagcccaggagattgatgctgcagtgagctgtgtttgtgccattgtactccagcctgggcgacaaagtgagaccctgtctcaaaaagtgggagaaaaagaaaaatataaagtattcaagttaattttaactatataacaccataccttttggtcaatttttcaatttttgtcccttttctcccatttttcctcagtctccatatatttgtctcttagcacttccttttattttccataacgtacctctcagtagagtataaaatggagatattttttatttttaaaatatgagttttgtgttgcttgttcctaaccttaaaaaatgattggtatatggtatgtgcctttcttgacagtgaactatttgatagtcatatatttaaaattaagaatttaatagaccttcccactagggaagcatttgtttcctaggcacctttggaaggtgctacattaatgaattagttttattattttagataaattgtttttccctatttttagaatattaatagagtcaggttggaagatacaaataaacactgattcagaacgccacatgagagtctgaaagccatgtcatagcagtagttaaacagagtattaaatgcagatgaacaagatgtcggaaagcaatggtaatgttagcaaagctagagagaagataatttcttatattttacagcaaatgttgttgtctgtgtaaagaaaattataggcatgactgtgaagaaatgaggtttatttaagatgccaaaagtggctgggcgtgatggcttatgcctgtaatcccatcgctttgggaggccaaggcagaaggatttcttggggctagaagttcaagacaaacctgagcaacacagcgagaccctatctctacagaaaatttaggaaattagctgggcatggtggcatgtgcctgtagtcccagctactcgagaggctgaggtgggaggatcacttgagcccgacaggttgacgctgcagtcagccgtgtttgtaccactgcactccagccctgtctcaaaaaaaaataaaaataaaaagatgccagaagttttgtatcagaaaatttcaacagtgcaaaaaagccttatggtaaaaaataaataaaaagaaataaaataaaacttcaagaggttaactcttggtccattatttaaaacattttttgaagtgtctttggacaaggccttttacagctcatttgtgatagtcatacagttttctttgctgtaataaaagcttggttttgagtctcaccattgagttcaaatcttaactctgcctcttgatggcactataatcttgggcagatcatttaacctctagcagctttattttctcatctataaatcagagctaataacccccatcaaattctccttcagaggacaaatgtttgtcaccatttagggtgatttttctaaaatatgtctaattgttctacttgcccacttaaaattcccccatctttctcacataacctctgtagcatgtcccattactctgtagcttttctgtgtttgcttctaaccttccttcctcctgtgctttttccaagttcttttccctgaacagcactgctagctgctcctggcagctttttatttaaaaaatgaaaaaaaggccaggtgccatggttcaagcctgtaatcttagtgctttggggagctgagatgggaggatttcttgaccccaggagtttgaggctgcagtgggctgtgattgcatcactgcactccttcctggatgacagagcgagaccccgtctctaaaaataaaaaaggaaaaaaaaacttacactgctctttttaatactaggaaagctctttgagattagaaattggctgatgttttttcttacagttttgttttataaattttttaacttaaaatattaatgtaatgaaagaaatcactttggaggaaatttaaaactaaaatgaattcatactgaattatgttttaagacttgtggtattccctgtaatgcataaaaagcaatgtgaggaatcactgctcaaattgataatgtttaaaatggagaataagagcatagaaaaaaaaatacgggactaattgtacaatattttaacatttttaggttttacatattgagttaacctgatcacctacttgaagcagtctagcattaactgttaaatgtttaatgaagtagttctcaaccttggctgctatctcagttacatgtaatgttttaaaaaaatgcaggccaggttgggtggctcatgcttgtaatctcagcactttgggaggttgaggcaggaggattgcttgagcccaggagtttaagagcagcctgggcagtatagcaagatcctgtctacaaaaaatttaaaaattagctagatgtgctggtgcgcacctgtggtcctagctactcaggaggctgaggtgggaagatcacttgagcccaggaggtcgaggctaagtgagctaggatcatgccagtacactccagcctgagccacagaacaagacctgcctcaaaacaaaaaccagaacaaaaaacagtcacaccagggccccatcctattggaatcatctctaggggaggttcccacacctgcattaaaacaaaactcagaagccaagggtaagaaccaaggaagtaatgtatacttttaaatgtatacttttaaagtaatgtatacgttttaaaatttgcatacagtgtacctctggtaatttccaggcttttatgacatataatcatcaattattcaaaataaaaagtgaatcaattttagaaactcccctcctcccccctttttttagacattagaagttaaatctcacggtttacctgtatcaatttgcagattattgtttgaaaaattctggtgaattgagactgcattaaatttctctggataatctacataaataatcctcaaaataaaaggttcatttcaacacgtaatagctttatatttaaaggcattaggaaagggggaggcagggagggaaagttagcatctgtttcctgtgagttttaagctatttctaataacttcttttcagctgctgcttttatgatctagtttatggcacagataagatatatatttcagaaaaaatgttttgagcttttgctgttgatgttaagattacgatttttctgttaaataggacatttggaacaagaactgtttaggatatagatgaaatacattgaaacagcaagaagttaaagcattttaaaaagccttgtgaataaatctttacaagagagtttttataactaaagttaataggaatatctaaaatgaatatccagctagtaaaattagccatccattcatgaatttaggaaataactgatttagaatgctatataaaaaaagagtttctcttttcacttagtcctcacaagttttcacctataatgtatttactcattaaacatcagatgtcttccacatgccatgtgctgtactggggaagacataaacaggagagactaggtccagactctgttggagcccttagtctaggggagtaagggattttaagtaagcaatagaagagatgtgtgtgttcctctgaaaactgcaaggtatttcagtgaggcagctcttttgttctttttccaaaagagtgacattggcttttcttggaagttttagagctgaaagggaacttagatctagttcagttcctcattttacaaatgaacacactcagatctagggaagtgaggtgactttcctaaaatggctcagctgaggactggtatggttgggatagaacatgggtcttctgattcttaaccattgtacactctctaccgtgtccctcaggggcatgtgaaagtaaatgacatatgacagacagaatcatgcccaggaatctattcattctgcacactatgattgatctagtttatgttctctttgtgctagatggtggcatcactcatgatgaagaagataaagctcttgttaagtagtttatggtctatcatgaaaagatgggcaatttgggaaatctgtggcttgttaacttgtttggcatattgagtaacatggcaggttctggagccagactgagttaaaatcctagctctcacataatagctatgtaatttggggaaggaacataaatctctactctgtttccttatctgtaagatagggataataatgcctacctcatagagtttttaggatttagaaatgtatataaagcacttggaacagtgcctggctcacagtaagcactaacactaacaaaaaagttatactattattttcacctcagttatacaggtgaggaagttgaaacataaaaaagttaagtaacttgcctgtgatcataaagctagaaagtttgggagccagaattaaaatacaggagtctcagtgctctgtttagatttaggacctgagccagggagtgtgttccaaacccagcactaatacttgagaagctctcaaaactgtaagtatccccaggatactggtgtctcaaaaagatagtaatgtgttaactgtaagctatttagtgatacatttgctttcttctgcagagaggagggactgaattttgggactgttgcctgcaccatcccagtccaacttgctatgtgtttttatttttagccattggctgattccaatttgaaattcagaggatttgtgatatattatgtgatatgttttaaaaattactagctccttgctgcattttataaagcgttggagatagtttttctttggttggctgattggttttggtgttttgttttttagaggactagcctacacctggtttgagtaagaaagttttgtttgagaagcagcgtttttaccaccttcaatcttttgaggaacttttggcatgtggaaaattaaatactacaaactttcaatagaaggtagacaggtaatatggagaactgagaattagaaatcttgaccatgctgttgggaatttcccttttctttctgcttgtccactaatctgcattgcttattaaaacaggttgatacttttaaggctctgcaaagaagttcttttcattggttagtatctaataagtgatagctggtacaggactttaaaaatatataataggggtttattttctttatttttattatttattttatttttttttgagacaaggtcttgttctgttgcccaggctatagtgcagtggcacaattacagcctactgcagtctcagcctcccgggctcaagtaatcctcctacctcagcctcctaagtagctgggactataaacgtgagccaccacacctggttaatttttgaacttcttggtagaaaatgtttcgccatgttgcccaagctagtcttgaacttctgggctcaagtgatcctccctcctaggccttccaaagtgctgggattacaggcatgaaccaccatgcctggactagcggtttcttttaaacagcatataattgggacttgcttgtttttccaatctgacaatctttgcttttaaattggaatggttagaccattaacatttaatgttattgttgacatgattggatttatttatttatttttattttttgagatggagtcttaccctgtcacccaggccggagtgcagtggcctgatctcagctcactgcaacctccgccctgcagggttcaggagatttctcctgcctcagcctcctaagtagctgggattacaggcatgcaccagcactcctggctaaattttgtatttttagtagaaatggagtttcaccatgttggccaggctgttcgcaaactcctgagctgaagggatctgcctgcctcggcctcccagagtgccgggattacaggtgtgagccactaccgtgccaggcctgatataattagatttaaattaattttcaatttatcctatttgtatttccttttttcatgcttgcttttgggttgagtttttttttttttaatgatactatattaattaatttctcttctgtattaccagctataactttttttgtttgttttttagtggttgctttagaatacatctttatagaatacatctttagcttatcacagactacgttcacgtgataattataccccttcacccacagcgacccctcaacaatccctctcccagcattagtgctgttattgtcatatattttattctgcatgttataaaccccaaaatatattgttactatttttgctttaaacattatcttttaagagatttaaaaaataatttagccgggtgcggtggctcatgcctgtaatcccagcactttgggaggctgaggcgggtggatcacgaggtcaggagatcgagaccatcctggctaacacggtgaaaccctgtctctactaaaaatacaaaaaaattagccgggcatggtgacatgcgcatgtagtctcagctacttgggaggctgaggtaggagaatcacttgaacccaagaggcagaggttgcagtgagccaagatcactccactgtactccagccttggcaacagagagagagtctgtctcaaaaaaagaaaataataataataataataataatttaaaattttatattttccacacatttattaccatttctggtgttctttttttctttgtatagtttcagatattcactcactgtcatctccttctgcctgagagacttcctttaacatttcttgcagtcaggtctgctggtgacaaattctttgttttattatgtctgaaaaaaatctttgtctttttttttggaaatgttcctgttggatataggattttaggctgacagttttgttttttacttaaagatgctatgtaactgtcttctgacttgcattgtttccagtgagaactctgtaatccttagtttgtttctccatataatgtgtcatctttttgtctggctacttttaagaattactctttatcactggttttacacagttagattatgatataccttttgatgtagtttttttattttttgtatttcttgtgcttggtgtttgttcagtttcttggctctatgagcttatagtttcatcatatttggaaagaaagtttgttttctgtgtttcatttgaataatttttatggctgacttcaagtttcttatttttcctttgcatagtctaacatgctgttaatttcagtatatgtttaatctcagttgttgtatttcttcatatctggaagtttgatttggatctttttataatttctatgagtccacttaccatggtcaggtatttatcattttaaatttatgattacagttataacaagcgtttactgtctttttgtccactaatttcattatctgggtcatttctggatcagtttctattgattggttttttaccttatattttcaagcccctgcacatgcgtgataattttttgttggataccaaacattgtgaattttgcctttttgagtgctgcctttttgtattcttaaaaatattcttgagctttgtcgtaaggtgcagttaagttggaacttagtctgatccttttgaggcctgcttttaagcttttaaggcctccttttgaagcctgcttttgagagtgaccagaacagctattaaggctaatttttaccattcactgaggcatcaccattctgagtattctgctggatggcccataagttaccagggtctttttctttctgactaatggcaatgcaaactattctcagccctgtgcgagctctggggagtgttctctctgttctctggtgattctttccctggcattgcgtagtgtcctctcatgcatgtgctaattcatgcttaggtaaatacttgacgggaccctctacagatctccggagttctgtctctgtgcagctctggtacttgtgaactctgaccacttaggttattccttcctgcaccacaggcgattgtaggtctcaatatatttagttttcctttctcagagatcactgccttgcactacctgatgtccagtgtatggaaactgctgttttatatattttgtcagtttttttgttgtttaagtggtagggcagatttagtatctgatataccatcttggttagaagctgaagtgactttacagcccatgatactttttgtaaataaagattagtcgttagaaaacaatactttcatgctgtttcagcttttatacatctataatgatattatttacttttagagatgcgggtgaactgtttgaaaagattgaaaagatataaagagttattggattctttacatcatgagcgaggaaaaaaattaagctcgtcttaaatggctatgtttcaattttatctgctataaatgggtaagagttagattttatttaaaattcatcttggcatttagagactgatactgtttctggccatatcagctgaactgtgttattagaatttttaattgttttagggttttttttttaagaatagatgattgatttttttctgtctctctactcttcttactcagaattagatgtgctttgagcacgtattaattctaatacgattaaaggtcaagccataccacaagaatatttatattatatgtgttgattagagttggacttgtaatggccgcattgttagagattgcatttctactttccatgaattctgttggatttgcagataaaatgttttctgtctaatagggagaaaatataaatatcatgcattcatctctcatactttttcatgtatcatgccattcacagttctaggattctggagccacatttgtagccaccattaaccaaaacaaaaacaatcccacatgactattacctttgaattcagtattgtactgtattattctgacacagaaatttgaaatccaatgggttggtgagtgaaaaagtcacatgcagctgacagtcacagtttttatatgactctcctagatctttttgttttgtggacgtatgtttgggggtagatggtttagagttctattaggagagagatgaaggtattctaggtgagtgttgagtggctgactgctgttagagggcaaaatgggataatcttttacaaaaaacttgaggtacatgatttagtactttgattatcctagtgattgttacactgaatcagaaaatgcatttaccttaaaacctttattgtaactaggtgaaagtaaatgtggtgtaacttttggtttgactataatgggcagtggaatctcagatgttaggatcaggtaagaagaaagattgaactatgtcatgacccagtaagtgaaggggtgtgtgtgtgtgtgtgtgtgtgtgtgtgtgtgtgtgtgtgtgtgtgtgtgtgttgttgttgttggcgacagggtctcaattcgtcgcctaggctgggatgcagtggtgcagtcacgactcactgcagcctcaacctcatgggctcaggcagtcctcccacctcgcctcctgagtagctgggatgacaggcacatgccacgattcccagctaatttttctatttttttgtggagacggagtcgtgccatgttgcccggcctgttgttcgtttttctttgaagaatatacctttttattttattatcatttgctataaatatcactaaactttgtcatcctaagtgagataataaggcaagatatttcaaggcctccttttgttatgtaagctgaattcatagcttgaggaaataagtcggagtctcatacctctgtgtcaacactgaacagcattttttgtgacgtaaaatctcattatcacaaattacaagtgcgctattcggtttttaaaaattttaattttggtttttgaagtcacacataagtttttatactttttgagggaataaagatttctaattgtacaacagtaaatggaataaacaataataactttgagtcttctggaatagatgttcaaaagatcaaattttccatatctctgtaatctaactataacctctgagggcaagggcttgttttatttgaataaagaaccctatagtagcatgattatggtagttatggtataactttataccataaaatatcccatgtgctattatactgtggcatagcatatatactatatatgttacagttacatataaaaatatatattatagtagtatatagtatgattatttggcttaaagctttttttttttttagcaggagcatagttcaaggacaatttttttcagattaaaatggactttctttgggaagccatctgtccccccagactaagttttgttgagagtagtgacagggacagaggcaagaccattaggttaccataatacctggacttagtttgtataatcgaggttaatgccagtcttgttgactgcaggacatacagttcctaacatattgcttagcatataatatgtgttaaatatttgttgacattcggaactgtgcacaatgttttatgagtcaggaccattgagttgcacaactgtggcacaccattcacataatgataatatagattttctcagttctgagtttgcttgctgcataaatgtcttaagtctttggcacctactgctgttagaatatagtggcatttgaacacacaattaagtatttagcttatgttacacataatcaactttcaataaatgagatctataataatttgcctactccactctcaccttccacagtcatttctcccctgcttcctattggttgttttgttttgaaccagcacccttccaactcccccagagcatcccacatcattagcttcacaagcatcttccataccagtgtcatctttaacaactgtgtggcagtttggacaattgacaatccaaatgaccctcagatgtattctagctattcttgactgccttctggagtcagtattttcagccaaacagtgaaaattaacaacaaactgtgtctaaaacttaaaacttaattcttctttcacccaaatgcttttcctgtgtttttatatttttatctctttaatgtatttttttctggttgcccgagttacagatattgccatctttatcctgcagttgtactgacttaacgatatcttcttgatatttcttccaccatgtgtaattttttatgctcttagggctcctttaatgaaggcaactcatatgtaaaatgggagtatgtaaaaataatttgtgggagagccatgtgggtggggtttgtgagtagtctctaaggcgcaggctacagctagctagcctagtgtttgtgagccctccccttcccccagtaaaggttgattcctttttctcctctttcctgcttgtttattttattctattttatcctcattttctacttctgccccaaaagcacccattctaatgcctttcactatattgtttgtgttcttgtaaaatgtatttagtgtttgtatttttaacttacataaatgatgcctaattctttcttacatttttctaagcacaatgttttaagctctctccctgttgctatgcaagcatctaattcattgcgttgaacagccacatagtattccaaggggtatactcattttatcttatagaagaccagatcgtttccagctctccatccccactaacagtgaacattctggtccgtaatcttttttggacctctgtaagaattaagcagaactgcaaggggatcatagggcttacttaaatttgatttgacttaagttgtaccagattgttccccagaatggctgtactcatctccatgcccaccagtagcagagcatgagaattcctgtgtcctcttaggtgcgttctgattttctaatttttgccaatcatactctacacttacatatggagaatatgttcatgaacatgtaggtcagtcttaggtgttatgcgtgggagatgggttgttgctctcccagatatgaagacgtgctccaataatactacactgtatttattaccgtagccctgtggtaaggtaaacagaccaatgaagctgacttggagcacccagagatggacatgtgtatatgtaggattttaatatataatatataatttatggcagcaccaaacactgaggacaagatgggattgttcatagatggtatagggaaattgactcaccacaaggaggtaaataaaaccggattcctacttaataccatatatgaaggtagactaggtagattaaaagctcacatgtgaaattttaaaactatacaatgaagaaagaaaatgcgacccacaggccaggaaggatttcctaagtgtagcttcaaaatcacaaatcttgacaataaactaaagcaaattttatgtgaaattaaaattttcttcttaatggacaggatattttcttctttttacctcaagatctgtgtgtctggcagaatgcattgcacactcttcaggagtggggaggctgaattggctatgcacatatatactctcttgatagaaggaagaaagcctctgtttaccaagttgcccccattttatttagcaatgaaattgtaagccacatgacaattccctttttctaagcatatgtaggagtagagtgtagatcagtgttttctgaatatattgtctgtatcagaattacttgaggcagttgttaaaaatggaaattcctcttttgtccatctccccactgttttggtttctctctctctctctctctctctctctctgtgtgtgtgtgtgtgtgtgtgtgtgtatgtgtgtgtatgtatatatataatttttctttttaaacaaaacctctctagggtggagtttggcaaagttatttagcagaagtccaagtagtaaatattctaggcgtcataggccatttgatctctgttagaaccgttcaactctacccatagtacaaaagcagccatatacaattcataaatgaaaaaatgtggttgtgttccaatacagctttattacggacaccgatttcaatttaataattcaatataaaatttattaatagttttcacgtgtcataaaatactagttttctttagatttttttaatcacttaaaaatgtgaaaacctttcttaactagtagaccaaacagaaacaggttgagggcctgatttggcccatgtgagtcatagtttgccaactcttgctccttaggcaactaaggttttcaaaccagtgccctagcttatctgatagttaactgtcattctctgtattatttggggaaaattcttacatcagtaacatgaattttcagtacctgtgagagaaagtagttcttaatggtcaggaagggataattaaataaatgtcttacataaatctagtttaaggtaaatgtaatgttgaaacatttggttttttaaattccttttaagcctattcaagagtgggtaatagagctgggtgcagtggcccattcctgtagtcctagctacttgggaggcttgaggtaggaggattgcttgaggctaggagtttgagttcagcctgggcaacatggcaaggccacagtctcttaaaaaaaagaatggggccaggtgcagtggcttgcacctgtaatcccagcactttgggaggccgaggtgggcagatcacctgaggtcaggagtttgaaaccagctggccaacatggtgaaaccccatctttactaaaaatacaaaatttatccgggtatggtggcgcatgcctgtggtcccagctactcgggaggctgaggcccggcaatcacttgaacccagggggcggaggctgcagtgagctgagatcgtgccactgcactgcagcctgggcgacagagcgagactccatctcatcaaaaaaaaaaaaaaaaaaaaaagggaatgggtaatagagatggaaaatggaatgtttaagctgtatttaataagtcttggagtataccatttgagatggaattgttaaagatgggacatagagaaacagtctttttaactgcctatagtaaaaatagctaggtgtttagctacttttttttttctttttaaatcgatttatcaagatgaataaatagctgctatcttgaaatattctaagggcaggggccaggtaggctgtgcgaggtcaatatgttaatcatgttattacacgttttaagaagataagctaattcttgaaactcaccaaagaggaattcattgtacaaaagaatatagtttatccctaaatttgatggaatggtctttgattgatgttataagaagaatagacttattttccctttggttcatcagtagggcgatcatataattactaataattacatcagggcagtaggcataaaccaagattgtcttgggcaaaccaggacatgtagtgatcttatacaccagtcacatatagtacttttaatataaagggtagataagtcttttaacttcctagatgaaaagaagacatccattaatgtcatgacatcagtagtacgtagtgaaaagagcattttcaaagaaaaaaggtgataaacattagtatgataactgtgactgaaatgaagcttatttttacacccttaagggtagaaataccctgtggtattaatagttttaaaaatatatttcatatctgtgtgtgtacatgtactttaaattttttttttttttttttttttttgagacagagtctcgctctgtcacccaggctggagtgcagtggtgcgatctcagctcactgcaagctccgtctcccaggttcatgccattctcttgcctcagcctcccgagtagctgggactacaggtgcccaccaccacactcggctaattttttctaatttttattagagacggggtttcaccgtgttagccaggatggtctcgatcttctgacctcgtgatccacccacctcggcctcccaaagtgctgggattacaggcatgagccaccatgctcagccttaaaattgttatttggaaataatgcacgtgatagacaactcaaaacagtagaaagggatatatagaaaaagtaagttttcccatttccagccccaaaggcaatagctgttatcagtttcttgtgcatcctgtgtgaattactttagatatacttaatctataataatagattatacacccctttcccctacctccttttttaaataaacacaaatggtaacttgctgtaaacactgttctgtaccttggttttttaacttcagatatcttggactttccccagtgttttcacaataaacctgtgcagtaatttccttatttacaaatgaagaaagtcaggctcagagtttaaagtaacttgctttaaggaaaaacgtatattaaatatctaggctgggcgtaatagctgatgcctgtaatcacagcactttgggaggccaaggcggatggatcacttgaggtcaggagtttgagaccagcctggccaacatgatgaaaccttgtctctcttaaaaatacaaaaattagctgggtgtggtggccacatgcttgtaattccaccttcttgggatgctgaggcaggagaatcacctgaactcggaagatggaggttgcagtgagctgagatcgtgcccctgcactccagcctgcgtagcagagtgagactctgtctcaaaaaaaaaaaacaaaaaacaaaaaactttagctaagcaggtacttagtaaatgttagtttccatcacgttctcttacccaaatatgtccttatgcttaataagcttggaggaagataatcacaattttagaaaaaaaaatacaatatacttaaatgcccacataatgtgatataatcagtaactaccctgacagttcagatatgggagaaatcaagtggtttggttggggaaaacttcatagaagaatatagagagattaggaaagaatttaaacagaaggccaaaagggagggcatctaagaaaggaagagggaatagcattagcaagaaagtcctaactggaatcgaagggggagaggtgttggtaagccaagggggcctaataagcagtgaagaccatgagttcatgtggtctttagtgagtggcttctttcacttagtacagtgttctcaaggttcatccatgttgtgtcatgtatcagtacttgatttctttttatggctgaataatacatatttcattgtagggatataccatgtttatccatatggtggacatttggttgtttccaccttcagctgttaaaataatgttgccatgaacattcatgtgcaagtttttgcatggctatattttattttatttttttaggaacctgggagtggttttgctgggtcagatgttaatgattatgtttaacattttgaggagctgcaaaactgttttcctaagtgcattgttttacattcccatctagccagttcccatcttgctattatccatggtttttattgtagttagcctagtgagtgtgaagtgttgtttcattgtgtctttgattttctttctttttaaaaaaatttttaaatttctttttgaattttactttaagttttgggatacatgtgcagaatgtgcaggtttgttacataggtatacatgtgccatggtgatttgctgcacctatcaacctgtcatctaggttttaagcccctcatacattaggtgtttgttctaatgctctccctccccttacccctcaccctctgacaggccctagtgtgtgatgtttccctccctgtgtccatgtgttttcattgctcatctcccacttatttgtgagaacatgcagtgtttggttttctgttcctgtgttaatttgcagaggatgatggtttccagcttcatccatgttgctgcaaataacatgaactgattcttttttatggctgcatagtattccatggtgtatatgtgccacgttttctttatccagtctatcattgatgggaatttgggttggttccaagcctttggtattgtaaatagtgctgcaataaacgtatgtgtgcagtgtctttatagtagaattatttataatcctttggatatatacccagtaatggaattgctgggtcaaatggtatttctggctctagatccttgaggaattgccacactgtctccaacaatggtgtgtctttgattttcatttttaaaaaatgacattcagaattgtatttttctaatagcaatgatgttgaacatctttttcatgtgattattgggtatcttcattggatcaaaattgacatattctcattggaaaaatgtcttttagatattttgcctgttttattaataaaattcaggctttttaatggctgaattttaaaagttcttatttatctatctaatatatcaatctattaagacaaggtttcactatattgcccaggctggtattgaactcctggcctcaagtgattctcctgcctcagcctcccaaagtgctgggattacacgtgtgagccactgtgcctggccattaaaaattatttttattccagataaaagtactttattagatacatgatttacaagtgttttctaccctgtctgtgggttgtctttttattttcttgatggtattgcttgcagtacaaaagtttgtggtttcaatgaagtccagtttacctatttttcttttgttgcatgtgttttggaattgtatttaagaaaccattatctactcctctttttattattattattatttttttttgagatagggtcttgttcagtcaccagagcagtggtgcaatcctagctcactgcagcctcaaactcctgagctcaggtgatggtcctgcctcagccaagtagctgggactacatgcatgcaccactgcatccggcacacctgattgttttttttttttttttttttgagatagggtctctttctgtcacccatgccagagctgtggcatgatcatggctgtctgcagcctcaggctcaagcagtcctcccacctcagcctctccagtagcagggactacagatgtgcgccaccacacccagcttttttttttttttaagagacagggttttgccgtgttgcccgttgcccagattggtcttgaattcctgggcccaagcagtttacctgcctcagcctcccaaagtgctgggattacaggcatgagccaccatgcccagcctattcctatattttcttctaagagtttcatacttttagtttttcgatttggatcagtaatccattttgagttaatttttgtgtgtggtgtgaagaagggttcagtttcatttttttgtttgtggctattcttttgttcccaacaccatttgataaaaaagactattctgtctccattgagctgatttggcactcttgtcaaaaatcaatttacctgtaaatgtaagagtttatttctgggctcttaattaggttccattgatctttgtatctatccttttgctggtactacgatgtcttaatttttgtggcttcatagtaagttttgaaattgagaaggaagtcctctagcttcgttctttttaaagattgtttggctattctatgttccttgcatttccatatgaattttaggatccgcttgtcaatttctgtttttcattttgtttttttttaaacagtccagctggggtttttacagggtttatgttgaatctgtacaccagtttgagaagtattcccatattaattttaggctgggtacagtggctcatgcctactatattcccagcactttgagagaccaaggtggaaagatcacttgaggccaggagtttgagatgagcctgattaacaaagtgagaccctcttctctataaagaataaaataagccagccatggtggtgcacatctgtagtgccagctagtcaagaggctgaggtgggaagatcagttgagcccaggagttcgaggctgcagtgattgcaccactgcacttcagcctgggtgacagagaccctgtctctaaaaaataaaaaaaaaattaaaattcagatctgtacagtttggatgtttgtcccctccaaatcctgtgttgaaatgtgatccccagcattggaggtggggcctggtgggaggtgtttgggtcacagggacagacccttcatgtatggcttggtgctgctctcacggtaatgagtgagttttcacttgctttgttcatgcaagatctcattgtttaaacaatgtctgggacctccccactctctcatgctccctttcctgtcatgtcacatgcctgctctcccttcatcttctgccatgagtggaagcttcctgaggcctcaccagaagcagatgctggcactatgcttcttgtacaacctggagaaccatgagctaaataaaccttttttctttataaattacctagccttagatactcctttatagcaacacaaaatggactaacacatgattcatgaacattaaatgtcttttcagttatttatatttcccttaatttatttcaatgatggtttttagtctgcagtgtacatattttatgcttatgttaaatttattcttatgtattttactcagatactattgtaaatttgaatttttaaaaattacattttctgattactcacgggtagtatatagcgatggttggtttttgtgtattaattttgtatcctacagctttgttcagcttgtttattggtcctaagagctttttagtggatttgagttttctctctacaagatcatgtcatctgcaaatacagatcgtgttacttcttttccaatctgaatactttttatttctcttttttctttttttgagacagggtctcactttgtcatccagactggagtgcagtggtgcaatctcaactcagtgcagccatgaccttctgggctcaagcgatcctcccacctcagcctccccagtagctgggacttacaggcacgtgccactgcacccagcacacccagctaggtttttgtatttttgtagagcaggggtctcaccatgttgcccaggctggtcacgaactcctgggttcaagtgatcctcccaccttggcgtcccagagtgctaggattatgggcatgagccaccatgcccagccttattttgttttgtttttttttttgttttgagatggagtttcactcttgttacccaggctggaatgcaatggcatgatctcggctcaccacaacttacgcctcctgagttcaagtgattctcctgcctcagcctcccaagtagctgggattacaggcatgcggcaccacacccagctaattttattttttgttggtcaggctggtctcgaactcccaacctcaggtgatctgcccaccttggcctcccagagtgctgggattacaggcgtgagccaccgcgcccagctgccttatttctttttcttgctgtaattcacctggctacaacttccagtaaaatattgaatagaagtagtaagggtatcaagttcttttgctctgaaaaaaatgaaaaataaaataagtagtagtgagggtggacatgtttgtcttgttcctcatcttagtcctcagaaatcattttcttgtcaccattaagtatggtgttggctgtgggtttatcattagtgtctgtttaagagccaagcattttaattttgatgaagcccagtttgtcagttttttcttgtgtgattcatgcttttgtctcctcagaaatctgcctacccaaagattacaaagatttttcttctgttgtttttttttaatataagttttatggttttagctgttaaatttaggtctcttcatttctgttcacaattcagtctttaaatgcatataggagagttggaggggagaggagacacttgtccctcttaacttgtttcttggtaatgagtgaattggtgaaaataactacatgtacacctgtagtcttgctttgtacaggttttgcatttggtagtctgccagtgctcaaaaattcctggtggtggtttttcagggataccacccagtgaccatctgtggtggtcatatgttatttgttcacccaacatccccctggggtaccaacactcctcattttataataattcgttttatccacatggttcaagtgggtctttttttaccctccagtggtgataggctgacccaagcccaggcccatcagaatgctttatcttggtcaggcatggtggctcatgcctgtaatcccagcactttgggagaccgaggtgcatggatcacctgaggtcaggagtttgagaccagtctggccaacatggcgaaaccccacgtctactaaaaatagaaaaattaaccgattgtggtagtgcatgcctatagtcccagctactcgggaggctgaggcaggagaatcgcttgaacctgagaggcagaggttgcagtgagccaaaattgtgcctgggcaacagagagagactcagtctcaaaaaaaaaaaaaaaaaaaagctttatgcatctacccacagtgattggttcagagagggtatttaacttaatctgaactgatgagagatataccaaagtatttgggagggatgtttttaaagcttacctcttttcctgagatatattatcttttccaagctatcctatgtggagagccagtctcaaaatgaagtcaacccaaaattgaggggttagtgagaaactcttaatgacactgtctgtcccttcgggtccatccttggcctgaagccttctcatggcctttttgatgatgtgggccagtttatcttttggcccaggctcttttgagtcaggtatctatacttgtaacagaaaaagccctaactaataagctattagtcttcttgaataaatttttaatatgtaggagttacaaatacattaggctctgtcttattaatggacagtaaaaggacaataacttttgtgtgtgctcttggaagtagcagctccttgtggctttaaagaaattctgttaaatacgtaggattatgatactgttttgtggaaggctgaatttaagtcctaaggttacatgagaattcactgagaagcatatctttaaatgtctgcttttaatgaagatatagattaattattcacttgacaaacttgttggtattttatgggagaattcagtgcatatagaggcttcaaaaggcagattgtccactgacaggttaggattctcaagtgtaattttttattactttagagccgtaattattttgtgagagacagtatctttgaattaaaatgagaaatgtttttcaacttagagattcaactcatttcagggatgtgtttaatccaaaaatagagagttcattatgtagtggtgaaattaaaacatttattaaaagcagtctttgggtttaagtaggtagatctcaaaagtgtctttttccttcttattggttaactaagggacacaaatacacaaccttctctaggaaacacttctaccattcttactagtttatgttttaatttttcaattttattaaattagtacatcttgatacgttaattttcatattgtttcatttcattataataccttcattagttatatgggattttactatgttaattttaacctttaaagtgaaaagactaactgttgattattggaaagcaaaaatatagctttagatttttgtgacagccgttattaatacatagttaagcagtcattatttctttggaagagttagcacttgttccttaaaaataattgtatgcatagaaatagtgctttaggccgggcgcggtggctcacacctgtaatcccagcactttgggaggccgaggtgggcggatcacgaggtcaggagatcgagaccatcctggctaacatgatgaaaccccgtctctactaaaaatacaaaaaaattagctgggcgtggtggtgggcgcctgtagtcccagctactcaggaggctgaggcaggagaatggcgtgaacccgggaggcggagcttgcagtgagccaagatcatgccactgcactccagcctgggcgacagagtaagactccgtctcaaaaaaataaaaataaaaaataaaaaaaagaagtagtgctttagggcttaaaggcacttacatagcttatttccttcaaggttcagttccgtgaggtgtggtatgtggaatagcattagctgtgttttccagatgaggaaactgaggactgaactggaatttgcatgctgttcagattttttaagttccctgtgtggtttttcttttcttttctttttttgagacagagtctcgctctgtagcccagagtgcagtggcatgatctcggctcactgcaacctccacctcctgggttcgagcaattctcctgcctcagcctcccgagtaactgggattacaggcgggtaccaccatgccttgctaattttttttgtatttttagtagagacagggtttcaccatattggccaggctggtctcaaactcctgaccttgtgatccacccaccttggcctcccaaaatgctgggattacaggcatgagcccagctgtggtttcttatatcatactgttaagtgtacttttaaagctttaaaaagcagtgttaaccctttcttaaaacagatttcagggaagacagacgtttaaaacattagccttctctccccatctggagtatggtttggaagtcattgctttgtagtaaggcattattttcctggtacattgccaaggaccaacaactgttaaatcaacaaactaagattttcttctagatttgtatcggattgtgactttgctttctccctttcaccacccattaatgcttagtaaagccactatggacctcacgtatctaaacccttccctgaaatgcatctctcttttcataccactccaatgggaactcctgttgatttgtttctgggccctgacagattagcaggaaaagaaagcgctttagaaaagtgagaggggagttcagaggttagaggggaatcagaaaattaatgtcatgattatcaagaatgtttccagaaggcagggctcatcagtccttgacaaaaaggctgatgaaaaaaatggagttgagtgcagccgatcacctcaataatcctagcagtttggcaagctgaggcaggaggatcacttaagtcccggattttgaggttgtagtgcgctgtgatcacaacactgcactcggcctgggtgacagagctaggctgtctcttaaaaaaaaaaaaaaaaaaagagagagaatgagaaatgccatttaattttgagcctggcaggtctttggtgacttttgagactagtttactgtggaatgttgaggtaaagtaggactgaatcacatgtagagggatctgtgtgtatttaggagaagcatcaggaaattggcactgaagggcaggagaaagctggcccagcagcctggaggggtagaggtgttcaggagtatgttttagagtctggtggttttttttttctttctgcataggaaagtttgaactttttgtaaccaagtgttctattcactgttaaagtaaaagaggaattaggtaaagaccacatgtttatcttagaaagaagcacacatttttgtgaaatgaaagaagagaggagtgaaaatagaaattttcatgtgggaagaattgaagttgaggtagcaaggaataccaagacaactgagaagtccttataaagaacacattcagtacttttaagatgttattttccaaaacatacacttttgggttgcctgtcagactggagatgtatgcctgtcgagtcacgttacactgaatttatttaggaaatagtctgacatacagaagtttcacttctcctgccacttgtgaaggatttgtctcattggtgtggtgtcagcctggtgagataggacttgcttgtggtttggaagctgtctgtgggcaactccaagagctgttgtgctctgcctctttatgaaccttctgtgcttatggaaatggttcccagcgtgtgctcctcaggaatgagtctgagtgacagaggtgccagtaggctatgagatggtagcaatgaccttagctagtcttttttgtttgttttgttttgagacagagtctcgctccgttgcccaggctggagtgcagtggtgcgatctcggctcactgcaacctctgtcacccaggttcaacctctgtcacccaggttcatgccaccgtgcctggctaatttttgtatttttattggagatggggtttcaccatattggcctggctgaccttagctagtctttcttaagaggctgggagcctgaggacagttgagaggtactgagctagttaaacctcaggcgctttccctgcgaaggctctatggcagataccacttggggctatagaagctgttacctacagtgtaaattctggatttcaatgcagagggcagacatagggctactaattttattttgttttgcaaggacattgaaaaaaagtcattgtttactgtcgtcagcattttataaaagggaggatactttttaatcacaaaatatgaagaagtttattatttgttttttgagatggagtctcgctctgtcatccaggctggagtgcaatggcatgatctcggctcactgcaacctctgcctcctgggttcaagcaattctcctgcctcagcctcccgagtagctgggattacaggcatgcaccaccacgcccagctgatttttgtattttttgtagagacaggatttcgccatgttggtcaggctggtcttgaactcctgacctcagatgatccacccaccttggcctcccaaagtgctaggattacaggagtgacccactgcgcccggccaggaactttatgacaatggaagacaaacctttatattgagtaaattaaaatttatgaaaaaaatgtaatgctttctcttattcttaccactcgtgtgtaagaacaactgacctgcagcactgaagctattcatttttgagaaacttgtcctaaatacttgtcctccctcctccccactttctcacaagtaaaagaaagggagcttgaaagctggcatgctatctgcttacatgtgagggagaggagggttgcccataggaaatttttatattgggcccatttctaagccaccctcacttgagctcgtctttaacaatttacctcatatcaaatacctcgtattttaatcatttattgttggacagtcccccaccccccaatttggctggtagttttatgagaaaaggcattaattatttaccatttttgtgtatcttactagaattttgccatattcattaaatggaactgattgctagtctaaacttactaccagttacctcactaaacactcctggccaaacaatatctagtgccagctctagttcagcctgcctttgcctgaggccagatccttctgctctgcccgtggaagctggttgagaggaagtgatgtttaatccttgacctacttttcatcttcccagagagtaatgtgcctgcagctgttctttcactctcttgttaaattcttgctttcttttactccttaagggaggtatgaggcatggaaattttcctccatctccaacactgctacctcctcacttcacctgagcacatgccccatgactctccatattacctgctcccacccttgtgactttgatatccatgtggatgacccatatctatctgcttaccagtgtctgcttaccaggttcttcatccagaaacattagcccaaatgaagcttcactcacctgagcaacagttggccatgccatagcaaatggagtggcctttgtaatacagagatttgagtccagtctttgccagttagcagctgaatggccttaaggttaattacttaaagtctctgggcctcagtttcctctaatgcaaaacagagatattctctccaaaatggtgttgaagaacttgctgtggctttgccttacccagttcattgagggtaaactgtcttccctggtttttaaagcccttaatgatttggcctcaacctgcccatccagcaggcaaaattctttggtacctagcatagtattgaacaaatactaagtatgaatatgtatttttattggtttattatattattataaagcatataaggatttatttcgtactctcattgtttcatgcctaacagtcccgactgctggagccactgaaattttcatttactttgttttgaagaagcagttcagaaccacgtcctgtgtgcaggttttgcacacagcagatgtgtaaggatgtcttgaaataagggatggttcttctgacattgctgaaggagaaaatcattttgctctaccagactgaaattcagagctcagccctttgctgccagcttgctctcacagctgtctgtccttggtttctgggtgctttcaccttggctagatgaagatgaacgttctgacccgctcaggtttctgtagggttgagactctgctgccactactgctcctttgatgctggtgactgcacctcactaaattagctgttcggctagacaaatctttagcgctctggttttacctttttagcaatgttttagctggtatgcttccttgtggctttgtggggctcattgttaatggaagcgcacattaacaaaacactaaaatggccaaacatcaacaatgactttagttaacaaaattctgagagaggtacaattagtagtcagaaatggactgtattaaagtggctatcctatgagtttatcttgatactatcttacctcatgcttacgtggtgttgaatgtgccttgtatctaaagctgtgggtcctggctcttaacaacaagcacaacccaaccaaggtatcaagtgaactgactaaaagtattcattttgcttaaatgtgtttctttcccatacacttacctctttatttgctataagccataaacatcgaaatggtgttttttaaagaatatgaagccttattttttaacttcttgaaataaaactaggtagtacctaaaatagcatgtacactatatttaaactattgcatataatagtaaatgaattcattagggatgtaactaatggtgaacattctttgaactaaaatgaaggtacatgatttgattgtttttcgaaatgttaatatataaacagacaaggagatatatatatgtaaagtcacattttatttatttagtaagtgatgactgcaccaaatgctacacagccatgcttggagtgatgcttgggatgtctatttaacaataccgcagggagactgcacaggccagaaaaagacagtttgcattcccttctgctccttaaaggtagaatgtagacatcttatttgtatatgtgttgatgccttcggaggatctgtggtttattgataactctttagtattgttactatgaagtagttatgatttccccagagacaattttgtttccattgccagtgctcttgtccaggttgttagacctcctatagcctctttaattaggctctctgcttcacttattgaaggctctaagtagcttcttgtttctgaattgtttgatgttttcagtgtttggagttacctatttctgaagacagtgactagttttctgttacctcactcctgatacggaagggagacagggaagtgctgggaggagaagggtgggtccctggcgagggctccacccccgggcctgtgcccacagacctaggtgaagacaggcactccagccttcacgtccaaatgttgcatttcccaagaccactttgacccgccacgcccccattctgtgcctataaaaaccccaagaccctagcaggaagacacacaagctggatgccgagagaaacacattggcgaaggaatacacaggtggatggacgtcgagaggaatgcactggtgtaggagcacactgggatgccagcaggccatcgactggtggaatgacacaaagtttggctggggcagttggagaagagttgggccaccaagcggccagactccaggggaaaaccatttcccttctggctgccccatctgctgagagctgcttccactcaataaaacctcgcactcattctccaagcccacatgtgatcctattcttctggtatgccaaagccaggatacagaaagccctctgtccttgccataaggcaggggtctaattgagctggttaacagaagccgcctatggacggctaaactaaaagagcatcctgtaacatatgcccactggggcttcagctgtaaacatttacccctagacactgccgtggggtcggcgcctcacagcccgcctgtctgtatgctcccctagaggtttgagcagcgggacactgaagaattgagccacacccccatcacacacccgcaagtgggacaagggaacctttcccatttcactgctgtgacagtgcaaagctattaaaatctgaattgcttagcaggcatgtaaggtcctctctgctctggtctcatttaatctttcaggttctatcttcaccttcatttctgcaggagaaacacatctctgtaccaaaagttcttcggtttggtcaccctttcccctgaaaaaaacgtattaagctctgtaagcataacttagataccattacactgtgaaaccttctcagttttccatagaatacatttctgtgttctgtctgttcctttgaaaacatttttttagtttgtattgtactatatgtggtgcagtgtgcaatgaactatatgtccctggcatatagttatccctgaattatgtggtgaatctataatattaagctaatatgttatgcttgatttctggggaccaagtagatgatcatttggaaaaatataccaccattgtgcatggcagaggaacttcatttggtaaagaattgtgtcacatggttataggttgtaagatactatctttttcctttccgtcttatctttcttattatttattttttgagacagagtcttgctctgtcacccaggttggcatgtagtggtgccatcacggcttactgcagcctcaaactcctgggctcaggcatttctcccacctcagccttccaagtagctggggctacaggcatgcaccaccacactcagctaatttttaaattttttgtagagacagggtttccctgtgttgcctaggctggtcttgaacttgcgacctcaagcaatcctcccaccttggcctcccaatagttttcatttttattgaaattatacactaacatagtttaaaggctttaatatttctttgtttgttaaaaaaaaaaaaaaactattcccagcattttgctctctagtggcaactacttgtacctccttgagccgagtactttgttgtttatatcctgtttttaggtatatactcatattactttatatttcagtttttaccaataactcttgattcatgacaatggatgatgacaacttagttctttcctacctagtcacactcttcctttatcctgttttgcttagatcaatgttgataaaatattcactgtttatattatgtgagcattattcacatgtggttacttttccttccttgcttgactacctccctccccaagttattctctcaccttttcccctctccctttctccctctgtgcccttccctacccactacatatatatacttgtcacaaattcaaccccagatgccttcacaattatctaaaagtcctcaaaagacattcagatgcataggttttatataaattttattttactttttatttttttgagacggagtttcgctcttgttgcgcaggctggagtgcagtggcgcgatctcaactcaccgcaacctccgccttctgggttcaagtgattctgctgcctcagcctcccaagtagctgagattacaggcatgcgccaccacgcctggctaattttctatttttagtagagatggggtttctccatgttggtcaggctggtctcaaactcccgatctcaggtcatccacccacctcagcctcccaaagtgctgggattacaggcgtgaaccaccgcgcccagcctgaattttatcttttttgaagaaatctctccccagagccatctgacctcttctggttttaacaggctacctgctaactctgtttatagctgtcataccggattctcgtgtcactgtcttttggggaattctctttactattctacatagaagttttgtttcctttatctttttcttgtttatgcccttattttgcagagtacatccctcagtaacttcctgaaaaaggattcttgggagataattttttagagacctcaagtatctgaaaagatctctattcttccctagcacttgattgatagtttgtctggtgtggaatttgtattggaaatcattttgaagacattgcttcagtgccagcttactcccactattgcttttgaaatctgaagcccgctgatttggggtttcttacacattacttttttttttctccctggaaacttgatgtgccaccttgtgtaggtcagttttcctccaatgtactgtgccttttcaatgtggaaactcatggcctggtaagttttaagttattttggacctcctctctgtttaccctttctggatcactctcactattcaaatctttgtccttcctatggtcctttaattgttgtatcttttctctcctatttgcagcctttcttctactttcttgggagatttcaactttatcttttattgagtttttgaaatcttttgtttgcttgcttttgtttttaattttcaaaagctactttttctcctctgaatgttattttgttttggctttattcttttttcataagtgcaatgtattctgtctctctggatattaataagtttattttgaaattctccctataatttctgttttctgtagttggctatcttctagtttgttttgatttttgatttttatgttagaaaagaaccatgttcctcagttatctgttccttagttagaaaggtctttcctctgagtcgctcatattccccagaagagactgcctggagggcgaaggccggcctgtgttctgggagctgagtggagaaagaaaactggggtcttactgtcctgcatgcataagctctttttcagtacagcacctctgccctcatccatgttaatgaccactggtgcagagaccctctgtttcaacttcttctgaaaataaatttcagactgtcaggatttctctttctgtgtaacaaattactgcaaatttagcagcccaaaacaatacacacatttagtatctcacagttactgtgggtcaggaatccaggcatagcttagctgagccctctgctcagggtctctcttggctgtagtcaaggagtcagctggcctgtgtcctcatctgtagctcttacaaggtcacatagttgttgacagaattcagttccttgcagctatgggactgaggcccaggcaactcctagaggccgctcatagttctctagcccttttcttaggtagtttatgtcataggagcttgcttcttcaaggctagcaggagactcttcagtcagttaagacttagtcctttttttgagatggagtttcactctgtcactcacctaggccggagtgcagtggtgcaatctcggctcactgcagcctcaacttcctagggctcaggtgatcctcccgccttagcctcccgagtaactgcgatgacaggtgcatgccaccatgcccggctgtgttttgtatttttttagagatgaggtctcacaatgttgcccatgctggtccctaactcctgggctcaagcagtctgcctgcctcggacttccaaagtgctggctcacacctgtgagcacttggctggaataggacatgtttgtaagtcagcacccttctctgtttggggataatgctttggacttcttggtattaaatgactgtttgaatcattttagaaaccaactgataccaacatgaagtagcatatgactctgccgtctgttaacttacaagccagtttcgtgcctgaccagtggccaccagtatttgcttaccagtcattctaggcttgttacgtttaggtagctgtgaaatgtcccacatcagccctccatctgtgggcctctttagctgctgctgctgctgcagcatctagccttttgaaagctattgtctactgctcagctagaagggtgtgtgtagacagcaggaccaaggattcgcctgggtgaaagagttggcaatgagaaagcaaccagaccctcccctccaagcccagccctgtatttgacatgcagggcataacctcactcattcagtctctcagccctatgcaaatataaacagccttcctcttgtctctccaggccagccggggccaagaaagaagccagtgattcccccaagtgcagtaaatagctctcctcacctcctgaccctgttatttcctggtagttctgagttgtggatcctgcagtggagagggagggaacaaagaagttgcagaggcctcagcttcacagagcattgagcagtgggtgatattgtatcctcaggcaggggttgacctcacatttcagtgcaggtcattctaatgactgctggacctcccagtgccactgtgaactagaatggaatagagtgaagtggatctgaattcctggactgtgggaccaacctaacttctgagctggagaaagtaggtctcatgttctatacctgcttttttttagctctagggggaaaaaagaattgtgcatctttcttgttctctttgcagcttaggggcataacgtttggactgtaattgaactgatgcttgtttccccaaaatgtctttggttttcattaaggtgggggattctctgcatttttggagttgtcacattatcgaaattcctctccacactaagtactgtgtgtggtatgcttttattttcacctaattgatttctgcaaataaagtgatttaatttttggtattaagaaatttaaataacaccttttggcagatcacaagattttcttgttcttatttaatcctggcttccatccaaatgtgaaagagaaatgaaataataaggtaggaaaggcagaccagtaattgtgattaaacaacttttgtgttgagtccaaagacaggtaactttattttaagcttcatgggtgtagtaaaaatatatcaccttaagaaaacctggattgccattagccagaactgacttccaggctttctgactttgtacaaacaaatcacttaatcctgaatccttctcctcatcttttttttttttctctttgtttgtttttaaatgtatttctttattttgtattactttcttcttgtcttttttatattttatgtattttattttcctcatctttaaaatggataaatgttacctttcctgattcaaagattctaggcaaagatcaaaagaagtcaaagtttgtgaaggaactttgaaaattatatatttctctgcaattgtgttagggtacttttctttctttgatttatgttggttcttggagtgatactttagatgtacaaatagtaggtcagaacaaacctgtatgtaataaattctggagaattgagttcaaactttggttttgcttatatttggataaattatcatcaactttgttgaggtgtaatttatacacaattaaattcacccatttcaaatcttccatgtgttttgactgtttagataaattgacaaataattatcttagataacagttggtatttctacattaaagaagggagaaagagcaccctcttttggcaaaagtttctcctgtgtgggctctccggtccccctgtctcatttcaaaatcagatttgcatcctgctgttggagtacacttgagccctttcatttatactggtgcaggttttgtagtctcttagagattcagtatgtcagtcccatgtctgagagcaaaggagaaggaagagggtaggaaagagcacctgaattgaatagagaggagggagcagagaaggcagaacagtgagatagtatccatttagtctgagtatttccaaattttccaataaaatgtcagtggaagcttttatcataaggccaaaatctgtccttcaatgtgaccacagagccacaggagacccaaaccccttgtagtcactgatgattttcattgggctatagatgggaatggcagcagtcataaatatttcctatgaatgagtgttctagatattttttacccaaagatgtagcatatcagtgggtcactattgaaaacatgtttggaatgaagcaggaaaataagtcaaaagatctcccctcagttcctaagcaactttgttgtaaaaataactgtgaaaactgggcttaaatgaaacacacattcgaatgcctggagtaagaattattgatagcccagacttagtatcccccccacctttccaagtccttaaagcattggctttctactcagaaacgctgcttaccctagggtgaccatagttacttttattttttatttttatttatttatttatttttagatggagtctccctctgttgcttaggctggagtgcagtgacacgatctcgctcactgcaacccccacctcctgggttcaagctattctcctgcctcagcctcctgagtagctgggactacaggcgcccactaacacacccggctaatttttgaatttttattagagatggggtttcaccatattggccaggctggtctcgatctcctgaccttgtgatccgcctgcctcagcctcccaaagtgctgggattatagccatgagtcaccatgcctggccacttttactttctcttattactttactttctacattaataggtagattagattccatctcttctacctttattttgtccttcagaatagaaattgggaagtaaacacagtgttgttttttttttttaatctcaataattggaatctgtttgaaggagaaaatcccctgcatctcatcctgcaagtataaccactattaagttcgggtatatttatatcttacaaaaatgtttgttttgcatactgttgtggaacttgtttctttcaatccttctggatttctttccttgcttagtatgtatacctcattcttatttaagagctgtacagtatactgtcatatggttgtactccaatgaacctatctcctgtcagtaagttagctcattccaaatttttttcatcatatataagtaagagtctccaaaatatccttatactatagtcacatgcacgtgtccagttatttccttagggtaagttccaagaagcagaatttctatatcaaagtgtttactggaaatttttgccattctgataggtaaaagtaccagagtgtttaacttgtatttctttgagtctaagtaagattgtgcatctgtttatttgccatatgtttattttccacttttgagaactgcctgtgtactttatccattattattatttaaattagtcaagatattagcccttaatcatgaactgaaaataccccctccaacctttttataaactttatggtatccttttttttttttaaggattttcaatttttatgtagtcagatctgttggtcttttcctgtgtgtgtgtgtgtgtgtgtgtgtgtgttaacttcagtgatgtctcagttttggtcattcctgcactcctgcctgccccctcaccccaaggtgacttgtgagatgagagttcaaatacaagtagtttatttccaggtacaaagaacaaagggaannnnnnnnnnnnnnnnnnnncggaacgagagatataacgtggaagagcaggcaggggaaggaaactaaacaaatacagagccgcgggggcggtgagtggagcggaaatgcataggtcaatgcagcaccgcgctgtgatcagagaggaaataggggcagaaacacctaaaaagccggggaaacgcgacgcactaggcaaagcactggtacaatcgcgacgagggtcgagtcgcacatgggggcacatcaacaaaggtgggcgccacacaggagaaaacgacgagcgcagaaacgctcccggagcaaagggccaaagtggaacaatcggagaacacgaagggttttagggagagcccgcttgtttggtaaggataaaatctttaaaggaatagagttgggggtgggctcagctggatggttcccaactgaagctttctaatgcagtacaaggggctaggactgaagtcatgtaagccttcctcactttaacatgtctggttttccacctgggctgggaaggcccacagctgagggctgtaacaccttgggcttcttggctaattctcattcttgatgtggtctcttcacacggtctctgcagtactaggcttcttatgtgatgtttagagtttccaaggcacatagaaagggagagacagacagctgcaggatgagatggggggccggggggaccatagctcctttttttaaaaaaaggagccagttgtgaagtcacacttatatcactttagacttaaatatcaccagcccatattcagagggaggggaattagactctgcctctttgagcagtttcaaacaatctgtggacggtgttgtaaaactgccacagggagttaatttacctctatttctgcctattgctatgggcagagcagctttaagcacagaggcgcagataggggtagctagaacttggccacagcacaccagaatcctaagggatgtgttggtgaggcactgacagcttctgctatagtttatcagtgagctcaggagttcaagtggcttctcttatttccaaaactataaaactgttcacttatattttcttcaagttcctatttaaaattctttttttattttatttttattttattttattgatcattcttgggtgtttctcgcagaggggtatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgattcttaacgagcatgctgccttcaagcatctgtttaacaaagcacatcttgcaccgcccttaatccatttaaccctgagtggacacagcacatgtttcagagggcacagggttgggggtaaggtcacagatcaacaggatcccaaggcagaagaatttttcttagtacagaacaaaatgaaaagtgtcccatgtctacctctttctacacagacacggcaaccatccgatttctcaatcttttccccgcctttcccctctttctattccacaaaaccgccattgtcatcatggcccgttctcaatgagctgttgggtacacctcccagacggggtggtggccgggcagaggggctcctcacttcccagtaggggcggccgggcagaggcgcccctcacctcccggactgggcggctggccgggcagaggagctcctcacttctcagtaggggcggcagggcagaagcgcccctcacctccccgacggggcggctggcccgggcggggggctgacccccccacacctccctcccggacagggcggctggccgggcagaggagctcctcacttctcagtagggggcgcgcagggcagaggcgcccctcacctcccggacggggcggctggcctggcgggggctgacccccacctccctcccggacggggtggctgccgggcggagacgctcctcacttcccagacggggtggctgccgggcggagaggctcctcacttctcagacggggcggttgccaggcggagggtctcctcacttctcagatggggcggccgggcagagacgctcctcacctcccagacggggtcgcggccgggcagaggcgctcctcacatcccagacggggcggcggggcagaggcgctccccacatctcagacgatgggcggccgggcagagacgctcctcacttcctagatgggatggcggccgggaagaggcgctcctcacttcctagatgggatggcggccgggcagagacgctcctcactttccagactgggcagccaggcagaggggctcctcacgtcccagacgatgggcggccaggcagagacgctcctcacttcccagacagggtggcggccgggcagaggctgcaatctcggcactttgggaggccaaggcaggcgggtgggaggtggaggttgtagccagccgagatcacgccactgcgctccagcctgggcaccattgagcactgagtgaaccagactccgtctgcaatcccggcacctcgggaggccgaggctgacaaatcactcgctgttaggagctggagaccagcccggccaacacagcgaaaccccgtctccaccaaaaaaatacgaaaaccagtcaggcgtggcggcgcgcgcctgcaatcacaggcactcggcaggctgaggcaggagaatcaggcagggaggttgcagtgagccgagatggcagcagtacagtccagcttcggctcggcatcagagggagaccgtggaaagaggggagggggagggggagagggagagggagaggcctatttaaaattcttagtttaacttttgttttttaatgtctgggagtaagaatcaagcacttattttaatggttaaccaattacaccaaaatactttaaaaataatctgcccagtggttctcaaactctttggtttcaggaccccattacactcttaaaatttatttcaggccccagcagcttttgattatatggttaacagttatggatttttaccatattcacaattaaaacaattatttaaaacatctatgattgattttaaaataacaaaaaacatattaatataaataacattttaaatgaaaactgtttttcaaaattaaacagcctaggctgggcgcagtggctcgtgcctgtaattccagcactttgggaggccaaggcaggtggatcatgaggtcaggagatcgagaccatcctggctaacatggtgacaccccgtctctactaaaaatacaaaaattagtcgggcgtggtggcgcatgcctgtagtcccagctactcaggaggctgaggcaggagaattgcttgaacctgggaggcagaggttgcagtgagcctagatcacgccactgcactccagcctgggcaacagagcgagactccatctcaaaaaaaaaaaaattaacctagaagactggtactatttcacatatttgcagatgactttaatgtctgacttcttagcagacaggtagattttcatacctgcttctgcattcaggctgtggccctctcacacctggtgtagattcaggaaaatctcacagtacaaatgtgagaaaatgggagtaaaaatggtaagtcatgttttagatttatgaaaatagttttgactttatggggctcccttgaaagggtcttgggagaactgcctagtttttccctgatgatgtaaatgctaccttcagctgaaggcatctttatccttcaaattcacatgagctctgtactgagggaaggtacagggagccggacctaggatgagagaccccatggccctgggagggtgcaggtggaggttgaggttgaagcagcagcaaaattgtcagaattaggcagtcgggcgcggtggctcacgcctgtaatcccagcactttggggaggctgaggcaggcagatcatgagatcaggagttcgagaccagcctgaccaacatggtgacaccccgtctctactaaaaatacaaaaattaggcaggcatggtggcgtgtgcctgtaatcccagctactcgggaggctgaggcaggagaatcacttgaacccgggaggcggaggttgcagtgagccaagatggcaccactgcactccagcctgggcgacagagcgagactccgtctcaagaaaaaaaaataagagaccggcaggagagtttcaggctgattgaccagtgcagggaggtgttctgattccttcataaatagggtaaccatataacatgcaagttggaacacttttgaaagcaaaagtgggcaacaaaaaactgaaaattattattaccagataaaggttttgccaaacaataaaataatagattcatatcacacagtgagcaaaaaatcactgtgcaagactgttcacacaactctgctttgtagcaagttattgaagtctgtttcttgaactctgtacttgtgtcacttcccatgcttcccactgacctagcagccccctgactgccccacctggagtttgagattggcagcagttgcagtgtggaagctgcataaggagctgagtgtaatgggagacctttagctaaaattaatttcgtaatcaaagatgtgtgccagaatcttttcttagaattgagtaaaacctgataagctcctttaagagaatcttggtatccttttaaaactttctttgtgacactcttgcttttggggatcagcactaaatgtgtggagggtagaggtgttaacaatacgttctcccctcaaaaagtctgaacaagatgctctgcttttcccccagctgactctcacttatgcacaatatagttaatcatcccaatagaagagtcagttgtgccctgtgaactgaagaaccaggactaataacccgttggtatttactcattcaaatagcagttttgtgtatggtagcataagcattgcaactgaagaatctggactccaccataaggcagattccagacacccaagctctggattctttagtgggaatagaggagtcatcaccacacacacacagcattggattctgtcctgactcgttttttctaacttcttgggcgaaagggcagattagaattgttccaactcaggcttgtataattcctgcagaaaagacctattgttggatccacctttatcctgacttacctacatgtttaatcttatagaggaaaatggctttcaagacacaagggatactgatcttactttaattctaatcactgccgtacccccaacccctgcttctttcaggcacttggcattgaactagttttgtcattttacttgcttgccacctacccccacgactaccctgacaggccagaagggaaagtgcggttccttagctcactgtactaataactcctcattcagccatccctagttaagagtgaccccctaatgtccacattttttaggtctgctcttcttttgtcatccctaccagagtaacttaaccctttacttacaagttacttggaagtagttttcttttaaaaacagtgtcatctaatttttttcaatattggaatgtaaatttccagatgtgctggactgtccctagagcagcagcatatacagtaagacctacgattgaatgactaactgggcaagattgagcttttgtgatgttttaattattttacctaatatggaaacactgttgtataatcccaaacagtagtacatatttgatcatctaattaaatattggtaactgttagtgtgccaagtcctgtagtatgtgtgggaaattactaccccctagagacttaaattcggatgtacaaaagattgtatccaaatgactatagcagtctgtgtaaatacccagacaaatctattctcttcctggtttggaacaaattttaaaaatgaactctatagcttccataggccacaaatcatccttgtgcgtcacaaaaagttatgtcaaaaattccttcggaagtttatctactttatgctagaggaagacagtaggcaccatttcctcagtgttgttgttacaagacttttggagggctttgttagaaggccattaaatggccacactgttggagatcttaagtgcctgggatagtctccttcccatagttaggaagatataccccctatttagccccaccgtgttccagtataacttccttgatacagtggataccactaatgtgaattttttttgagacggagtctcgctctgtcgcccaggctggagtgcagtggcgtgatctcatctcactgcagcctccgcctcccaggttcaagcgattctcctgcctcacccttctgagtagctgggattacaggcgctcgccaccacgcccagctaatttttgtgtttttagtagagacggggtttcactgtgttggccaggatggtctctatctctagacctcgtgatctgcccgctttggcctcccaaagtgctgggattacaggcgtgagccaactgtgcccagccaaatatgtgaattcttgtgtgtgggtactagtttttctggggagccctttaggttggctctaggtctgcaagttctttccaagggatagttaacctgaatggtacattcctcacagtaccagagcctcttcctttcctcttcccctcaccttaggtgaggaagccttctaacttagttattaggactatggcagtggtcgccctgctttttaatagcacttacaaaatcgtgtcactaccctgttagtttctttagtaaagttttctcatttttcaagttccttctgccactcgcttttaggttacaaaaggttactgttttatgaaggggtgctgagggtaagaatgtaccaagtagatctcatggagaaggcagctttcacccagtatctctggtagattgctaccttcatagcttatcttctctatgaatttcttagcaatagaagagtaaatcaggagtggatttttagtagtgtgtttgtcatagggaatgtagatgtaattggatttttttttcatataagcattttgtaaattcagttttgggttttttgttttttgtttcttgtttttgttttttgtcttaatagagctaggcattaccagggttgatgcatatttattactgcaaagagttgtagacaagggaggagggagctaaataatattaatggtaatttaaatctagaaaatcagaactgtggctcactactgtaatgtcagtgctttcagaggccaagcagaagtatcgcttgagcccaggagttcaagaccagtctgggtaacctagcaagaccctgtctctaaaaaaaatttaaaaattagccaggtgtggtgatgcacgcctgtaatcctagcaactcaggaggctgagatggaaggatcacttgagccagctgtgattgagccactgcactccagcttgagcaacagagtgagacactgtctcaaagaaagaaacagttggtattcattgctcttaataatcctctgtagctggcttctcaaactttaatgtgcataagaatcatttgttaacatgcacattgattgggtctgaggtggagtctgatgtctgcatttctaacaaactcccaggggatggatgccgatgttgcttgtccagaggcggcactttgaatatcagtctacagaacattcagggtatatgcaaattaacttttaataataacaacagcaaccatatatattgatccttttttggtgtaccaggcacagaaaaataaaataagactgggcactggagtctaacagctgggattcagattgaagctcttccctttactagcttaaccctgagcaaattttctctaaggcagggtttctcagccttggcactgttgacattgtaggctgagatcattctttgtgggggctgtctggtgcattgtaggatgtttagcaacatccctggcctctatccaccagatgccattagcacctccctcccgtttgtggcattcagaatgactgcaagcattgccaaacgtcagggggtggggtaggaggcaaaattacttccagttgagaaccactgctctaagactactgttgaaatatgggtgtttgggggggtttgtgatatgaatgatgtactttatgtaagtgacatagaagcttatcatgaagcttccacagacaaaaggagaataggcatgcagtagctaataagcagtccgtgccacatctggctttctgaggatgatgataaagcttattccaagtgccagttctttatttttacgaaacattagtcattgtactatgagataatatcaggaattacttgagatttttaaataggtagaactgagtttctaattcagttgatcccaagcctctgcccttttttgaaatacgctggcactgttgctaccctgcccctgcctctgccccttccttcattcttacttctgctgctgtccgcatgtctctttttcccccctactctttaaagttttatttcactaacttgaggtcaaatgtcacaactgtgttctggtcaatttactatccttgcttggcttccccaaatggtagtaccagaagatttgtggggtagggagaagagaccactttaagacgcactacatttactcatcttccacaaggcaacagagttgggcatctgattattcaacaaaacaaagcttcagtagcacccaggagggcagacaggcaaaccaggctgtagacacactgcatttgtcaaaatcagaccagagaaaacctactccccacagattaaaaggtagcgatagtcatcatttctttttctgttgccacaacgtttttcttcttttaattattatcatgtagttgtctcaagtccttcctttagtccagggttccccaaagcctgggccacagaccccgtactggtccctggcccattaggaaccacgcacataacagatgagcagtgggtgggcaggccggccagctgagcgaagctccatctgtatttacagccactgcccatggcttgcattactgcctgagctccgcctcctgtcagctcagatcagcaatggcattaggttctcataggcacacgcaaaccctattgtgaactgctcatgtgagggatctaggttgcgtgctccttatgagaatctaatgcctgatgatctgctactgtcacccatcacccccacatgggactgtctagttgcaggaaaacaagctcgggggctccccactgattctacattatggtgagttgtataattatttcattctatatcacaatgtaatactaatagaaatagagtgcacaataaatacaatgcacttgaatcatcccaaaccatcccaccccccatctgtggaaaaattgtcttccacaaaagcagcccctggtgcagaaaaggttgtggactgctgctttagtccatctcctatgattgcacaggtaagctgcaaatgccaaggacttgatgagctcagttcaccccttgccaacaatgtatcagttcctgagagaatgagttcctgaagtcttgctgttagcaactataagtagagggactgcttggttttctatatcctagttattttatgaagttaagttttagtttcttccatccttccacatctagagtccacaacaaatacaatgccatctgtgcatctggcatatgacttccacagtggccttactttgtcctaaacacctacatcccagaagtgaaaagggactgttttagaatttgccaagattaccttaattttctccgtgttaaatcttttggtaggtacagtatttacaaattcatgagctgcagcctgtataagacagttgtcttgctagcacagtacaaacccaggaaaacagtgtggaaagactgaaatgaaggccgactggacaggatagaagtgtggtctgatagtccatttcccaatttcccactgcaaataaatgtcccaaattgaaatgctttcttcttgctttagaacttctcttcgtaggtgatccagctataagactaaccatccttcccttctcttcactcagcgtctgtcctagcatctggggaggtgctctgatacctgtccgtgggcaccagggaggcctgggccgcggcggaggacagggcaccaggtgggtgctgtgtgccgggctgctctaacagtgctcgcccagcagtccgcaagtctgtttctagcacgcttatcttcctatcttcccagcctctcatcctttcactttttttctagggtatgacagcagataactaagccttctaaaattatgcctagaataatatctgaactatggtttatgtgtttgtaggcaagggtcctgtctcccaataaaaaatgtaaaaattcatttgatagaaagatacttttaaaaaattgattctggccaggcacagtggctcacgcctgtgaatctcagcactttgggaggcccaggtgggaggatcacttgagcccaagaatttgagaccagcctatgcaacctggtgagagcctgtctctatgaaaaatgtaaaaattaggctgggcgcagtggctcacgcctgtaatcccagcactttgggaggctgaggcgggcggatcacctgaggtcaggatttcgagaccagcctggccaacatggtgaaaccccatctctactaaaaatacaaaaattagctgggtgtggtggcggatgcctgtaatcccagctactcaggaggctgaggcaggagaattgcttgaacctgggaggcagaggttgcagtgagccaagatggcaccactgcactctagcctggatgacacaagcgaagctctgtcttaaaaataataataatggataaaattttttaaaaattagctgggcatggtggcatgtgcctttagtcccagctactagggaggctgaggtgggagaatcacttgagcccaggaagtcaaggctactgtgagctgagatcacattgtgctccagcctgggtgacacagcgagactgtgactcgaaaaatatcctaaatttcactttgcttcaggatgttctttaaaagaaatcaataatgtcatttgaaaattgaaatgcagatttggtttctgaccattgaaatggaagagcagcagagtagtctgtaataagtctgtactgagaatgggaatggggaaagactcacaaaaacatgattttaaaacaaaaagaaaacatgaatgttactttgtggagttaccctggaagattttaagtcagtccagggaacacaacagattctagtaagactgtgctaatgacagtctttgacagttggtttgttaatacctcaaatgatttgtagtacagtttatactgtgcagatgctgtttaagactgtatatgtgtaaagcaaaagttactaccagttgatagttttttactttgtatacttatcaatataatattgaggcataagatatgtagccacgctgtccagtggtcattagggggaaaatgtctccaggattgtaggaaaagctgtcagaagtgagtccttgttaattgcgtttattcaatggagagtttcctatcagttaacagacacagcttcctgtatgacagaagtgtcgtggctcatggccatccccgctcctattgtttacatacctgtgtgaagtcagaatcctttatagaaagaagaaaatattgtgttaaagtagaaattactcatttttcttaaaatctgtatcagagtaatatttattttgattagaagaaaaaactatgttatctttttctttttgccttgtatgtatttgcttatattttgaaaagtgcttttagttacaaataaaccttaaacctctgtgtagaaaaatgtgaaaggtataggcatggtctcttcacttcctcagttacatcctctcatgcagaggttctaatcacagttaaatttcaatgtcttcaaacacggataagtgggtttttttaaaaaggcacagtcttatacttatttctgtaaccccaatcatactttggttggctggttttaaaaaatcatgttacacaaaactgagatgacccagtttagagaatcccaattaaaataagtgctcaggtgaagacagggtagacttaatgcaaaattatgaaatgtacttttctgctcccattgtgtccggaattggtgggttcttggtctcactgacttcaagaatgaagccgcggaccctcacggtgagtgttaacagttcttaaagatggtgtatccggagtttgttccttctgatgttcggacgtgttcagagtttcttccttctggtgggttcgtggtctcgctggcttcaggagtgaagctgcagaccttcgtggtgagtgttacagcttttaaggcagcacgtctggagctgttcgttcctcccgtccggagttgtttattccttctggtgggttcgtggttttgctggcctcaggagtgaagctgcagaccttcgcggtgagtgttacagctcacaaaggcagtgcggacccaaagagtgagcagcagcaagatttattgcaaggagtgaaagaacaaagcttccacagtgtcaaagggggcctgagcaggttgccactgctggctctggcagcctgctttttattcctttatctggccccacccacatgttactgattggtgcattttacagagagctgattggttttacagagagctgattggtctgctttgacagggtgctgattggtgcgtttacaatctctgagctagacacaaaagttctccaagtccccactagattagctccacacagagcactgattggtgcatttacaaacctttagctagacacagaatgctgattggtacatttacaatcctccagctagacgtaaaagttctccaagtccccacttaactcaggagcccagttggctttgcctagtggatcctgtgccggggctgcgggcggagctgcccgccagtcccgcactgtgcgcccacactcctcaacccttgggcaggcgatgggaccgggagccgcggagcagggggtggtccccatcggggaggctcaggccacgtgggagcccactgcaggggtggaggggaggctcgggcctggcaggctgcacgtctcaagccctgccccacggggaggcagctgaggcctggcgagaatttgagcctgttgctggcaggctggcactgctgggggaccaggcgcaccctctgcagctgctggctggggtgctaagcccctcactgcctggggccagtggcgccggccggctgctccgagtgcggggctgccaagtccacgcccacccggaactctcgctgttccatgagcactgcgcgcagccccagttcccacccgcgcctctccctccacacctccctgcaaacagagggagccagctccagcctcagccagcacagagaggggctcccacagtgcagcagggggctgaagggctcctcaagcgcggccagagtgggcaccaaggctgaggaggcaccaagagcgagcgagggctgccagcatgctgtcacctctccccatcttttctttagtatcaatttcaaccctccttttcccaattcaggattttccatactctaatcatttggattaataatttaaattacataccattctatggtacacttcaaccagtatttaaaattaaagttgtatttcttgttgtggaaccaaaagtatcttctggaggagacaggagattattaaagggtgtacttaggtgacctgagggcaaacctggtcagtcattttatcgagaaataggtgggatgcttgaacagcctcaagtaaagctgagtcttactccctattcttctgacactggccttcttatagagttgttaatattgtcctccacccctggggatgggactgcctgcccactttgtagaccagcagatcctaacttttccaatgagaacttaggaaacaaataaaattgtacgcccctgcatcagaatttttctgttttattctctgattaagaaagtacacatgataaaaagctacctgaattcatccaatagcagctttaagtgactatctaaaacttgatattcagggctgagcatggtggctcacacctgtaatcccagcactttggcaggctgaggcggtcggatcacaaggtcaggagtttgagaccggtctagccaatatggtgaaaccccagctctactaaaaatacaaaaattagctgggcatggcggcgcacacctgtagtcccagctgctccagaggctgaggcaggagaatcgcttgaacccacgagggggaggttgcagtgagctgagatcatgccactgcactccaacctgggtgacagatctcaaaaaaaaaaaaaaaaaaagtttgatattcaggtaacaatgcttggtcttttccagtggattctcaagaccattcacagtaattcctgagggcccacaggttagggatccctcactactgcattttcttcagggtcaactacatttgatattatttcacttagcatttaattattttcatgttatattgcacctttattctccagttttgaagtttaatacaagtgtaatacgttttttgtcattatgtagttgtacttgatttcttttctgttttgtctacttttttctgaactttcaaaaaaattaacacctaaattgcaaacagattacagagagatagcaatcttaattggatttctggttatatcacaggtgataagctatcacaggtgacaaactgtaaaatgttcaaacttatgctcctaactggttgtcccactagtaacctgtagcagtggttcccaaatgcaaactacctgcttaaaggtcattgttgtgggtggggcacttaaatatatggattcttgggtcccctctagatattctcaatcatcgggcctggggtggggtctagaaatctttagtctttaaagttccatcgattattttgatgcacagtgaaatttgggaatcaccaattttctgtacaatccataaatctgcatgtagtgacatactggtaaacctttattttttttgtatactaaaggaccagcagaattgggcccatgccaacatgtcacctctagggcctagactgccctcacttttgtttttttctaggttggtttcttagcactaccaagttgaacatgaacagtacgactcctgcctctaggaggcagcttggaatattgtcagtactggattttagagagcctggcttctgtgaatgaactcttggccttggttcctcatctgtaaaaagattttagagtagccttttgcctttaagtgtttaccataaactagataaaagagcattcccctttatctgcaacccctgtattagtgttattttcatatatagtccacttttcattaactgcactccaggtgtcatagctgtatcagccagtgtctctagactttcttcagtttgctataacaaagtaccatgaattggatggcttataaacaacagaagtttatttctcacagttctggaggctagaaatatgagatcaaggtgctggcagcttcaggtctggtgaggatgcgtttcttggtttccagacaactgtcttcttgctgtatcctcatatggtagagaaaagttagagagcttttgaggttctctttaagaacactaatccttttcatgaggatttctaccccctaacccagtaccttcaaaggctccacctcctaataccgtcacattgaggattaggatttcaacataaaagtttcgaggggatgcaaacatgtaggcaggtaggcaaacttatgatgaccaagaaccggttctaacctcaggaaatgaagcaataatggtaatatcatttcactggagaagtttctgcctgtttccagagggagagggctgattaagagctctccctacattccaccttgtgaaaattgccatcagatatcgtgtaaaactatgaagtcatcttttttaaacacaaagtatgacttcatggtgtagacaatgtttaaaaaatctctggccgggtgcgatggctcacacctataatcccagcactctgggaggccgaggcgggcggatcacctgaggtcgggagttcaagaccagcctgaccaacatggtgaaaccccatctatactaaaaatacaaaattagccaggcataatggcgcatgcctgtagtcccagttactcaggaggctgaggcaagagaatcgcttgaacccgggaggcggaggttgcattgagccgagatcgtgccattgcactccagcctgggcaacaagagcaaaactccgccttaaaaaacaaacaaaaaaaacaaaacaaacaaaaaaactctctctgtatctaaaacaaactttttggtggcttacacttataatcccagcactctgggaggctgaggtaggaggattgcttgagcccaggagttcaagaccagcctgggcaacatagagagacccccatctacacaaattaaatagaaaacattagccaggtatggtggtgcatgcctgtagtctcggctactcaggtggctaaggtgggaggatcacttgagcctagaagtcaaggctacagtgacccgagatcatgccactcactgcattccagcctgggtagcagatcaagactctgtttcaaaaataaaaaataaaacaagtttttaatagtttttggtaatacccatcacaaagagatattaaagaattaataataatggtgatcactgccgtttaatgagagatacccatgggtgtgttgctctacagtttccttctttctctcacttaattctgaaaacattcctgtgaggtggacagtgtccgagctctttctgcctcttggccagtttgggccctgttcttcccattacccgctattcggttgcccatattttctccctccttttttgccatgtcatgttttcttccccaacttgtattctcctctgcttttcctttgtaataagctcattcccctaacctgttgcatctctcacaccaaatttcagaccaaaagaaaaacctgtgatgggtttggggaaagtataggcccatgggtaggctttttattccctccctcttcatctcttctgtctcttaaatgaaggcatcagactttgtaaccagttagcagagggcatcttgaaggagtttgtcttgttcagcatcaaaacccctgacatttaaccctctgcctagtacatgggcattcagtaagtgagtgaataaatccaattcacatcgtacatttatttaaaagagtagttttgctgggtgcggtggcactctagaagccaacacaatgctttagaatggtattgtggccaaattatggtgtacccaagtgtatgtaacagtgatttatgataacagctaacagggttggaggaatgtctcaagtattagtatttagagaacccaattatagaatacacattgaaatgaaaattgaataacctgtaactggatacttaccattctcctcccacctaacatggacatactttttacattataaaccatctattagattcttttaaaggtgagattatggagatagaagagcaaggaagagccagttagtgggtcagaaaatgaaacttctgtgcttaaaatggtcataagtgatgtagctgtgagcaaaaactgctcgcatttgtcactaatttcgcttctaggtgctgagatgtgtttcccattttaagtattgtttacactttcctacgtgtccaggagagttttgagaattgaggaaagtttcctgcttattcgtagctaggtaggcttagaatggttttaacattcttttatcatccagtttgcttgaccaatggctatgggtttgttgcagttctgcatccgtttctgtacttgttttgtaaagagaatccacacagtaaacaaaagagaggagagaggtaatctttccatctcttttaatacactgtaaaaattgggatagtgccaccatctgcttatttgttgacgtattattcacagtgctggtcccaaaggcgataacatctatgaatggagatcaaccattctagggcctccaggatccgtgtatgagggtggtgtattctttctcgatatcacttttacaccagaatatcccttcaagcctccaaaggtaagaaatctccctgtatgctcaaatttactaattcccacaagagagcaactgttgaggtttttctaaatttaatttttaatcacagaaactagatttatcttatgtcctaatagatctgagtattttaacatatacaaaacacttctttaggttgattttgccttatctggcagagaccattctaggattaagtgctttgttttgatggtgcttaaaattgtgctatttatagtaatattgtcagcaacctagaattaatcccctgttttccagcccatagagaaatgtttttgaacctttctcgaggttaaaaatggtgtcaagccaggtgcagtggtgtgcacctgtagtccagctacttgggaggattgtttgagcccaagagtttgagtccagtctgggcaacaaagcaagaccccaaaaaaaggcagggcaggtcagggggccaaacaactagagaatcagaatctcttcccaaagctttggattctgttgtgctccctgtcatgttttggtcttgttcctttacctccaggcctcagttttctttctaggacaggtgaggattgcccaagtcacccatctcctgtactcaatctatgattctcattcagtcagaaagaaaaccccgtcttggggattaggtagactgccagataaaagtacaactgcagcaacaagaagtaatcgaaagtcacttttttaaaaaattggtaaaattacaggtaatttttactttgtgttttggtatatttcacaaataaaaattaagagacccaaataacaccagcttatgtgacttgtgttctgctgtggtccttgcccattactggctctgcatccatggacactcgattatataatagtaaattctgtgatgtaggtagacaggatgtctataggacctgatgtaacggtcagaaaaaagcagaaatagacttctcttcaaattttgttcagccttttgggtgtagtcattgtttgctaagtatgttgtttaattatctttatgtacccattatgttgcacttcagtttttaagaggtatttatgattctcagtattttaaagcttactttgaggcagtgtagtactaccagctaacacaagaggtcagcaaacaattagctattcaaacttggaaatgttaatatttaaaagatttaaaattgctaaagatgaaattaggaagtactgaacttaccgtcagtggacataacattttaaatgaaattgacacagtccctgagatggtatcaatgaacactttctaatcaaatttattgtctatcttcttgacagctttaattaaaactgcttttagtcaccttcttaagggtcattcagttgaatatttagtaacaagtttgtttgctgtttaaatattgtctgtcacttgttttttttaggttacatttcggacaagaatctatcattgtaatattaacagtcaaggtgttatttgcttggacatattgaaagataattggagtccagcactaaccatttctaaagtcctcctttctatctgctcacttcttacagactgtaatcctggtaaggttcataattctttaccttgttttattcttccttacctgaaaaatacttgtttccaaaagctttcaaaggacaaaactaatttttctgcacaagtttgtgaatacaaaaactaatcggcttttcaaaagaaagttttaatcaagttcagtnnnnnnnnnnnnnnnnnnnnactgacgtaacctcgccttgggcttttagtttcaattattcttcctcctttttttttcctgttgcttaatttcccatagagttcttataaaacaaatcagacacttctaaatgtcgagtcatctgcctggcaagcctcacctgtgcctctggggttcagtgagcatgtgtcccatagctggtcactgagatggcactcaattttgaaaatggtagttgttaaatacttagtgactattgaattgtgacttttttgggacttcatttcatttaaaaaatatttttctgtagtcacagctactagggtggctgaggtgtcaggattgtttgaacccagaaggtcaaagctgcagtgagccatgagcatgtcactgcactgcattccagcctgggtggcaaagcgagaccctgtctcaaaaaatatatatatatacacatatgtatatatatacacacacacagacaaatatattttctaggtaaaccaaatataaatttattaaagatcctaagattcagagaaatactatacttaattggaggtccaggttttgcctggcaacctggctctttaaccagcgtaaaggttaatagtgttgcactgcaacagccccgaagacttcacagtattcacaatgccgttaactggtgacattgagctaagggtcacatgaacacagctggatgttcattgcagtctgaagccttgaccgttccagtctctactgaactcagcctaacacataagagtaaagaaactccaattgagtgttgtttgttgggagaaaaatggaatgaactaagataaagacagaccagtacactaaagcctaagcattccctcttcccccaacgttatgtttttttgaaattttgatggaaaaatatccagcatggtggagtggtgtttcgaagatgggtttgatcacacatactttgtcgtacgtatctacccaagctgtcactattcgctaaagtttaaaatgttcttttcctttctccaaagtaatctacattcttttcttccagccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaacactgctgtgttcatttacttttcttttgccttttggttgccattcgcagattcttctgaaatcgataggtatctgcttctaaaacaagctaaaaataatgcatatttagtaggtattagttagttacctatattaggatctgtactttacacagctgtagatgaggtatcctagaaaaggttaaataatctaccccatttaggcttcaaagacgaaccctactgcatctttttaaaagcattttctgacttgcagatgctgtagtagcaagtacatgagaaatgggttccgtcatggataaattggtaccctgccttagggggcattttggcagtacatgtcctgacccagcagttctgtttctgtatgtctctttcagagaaacttatctggatacacatacattcattacagaatttaaaaagaattggtaactgtttgtactaatatagactaagttgcattagtaggaaacaaagcaaactggaaggtacttatttaaaaatcattatgaaagcatttgtccatctatgtaacatgcatgggtgggaagctagattaatattcaataaccgggggaaaagggtaagggggtgagttagtgtctggtaatttttttttaccaaaaaatgaatttatgatgagaaattttgaagaattatactgtagcagcaatagctgatttgtaagtatcgtcttttatatgtagtagttcttcactagagctcatgaaaaaagtattccatttaagatgttacaaattacttgatgttttaatatgttctttgttgaatagcttattttacatttcagtcaaaatagttatttcacaggtgaaaccactaagtagcttacttcctaccttttaaattaataaagttacagtcagccacattgcttgagtcttgccaaaatctttagagaaacaacacaaactcagacatctaagtcagatcaaattagagcccaatatttttgatacttttattgtatatgactagttttctagaaaactattccagaagatacagtcttccttccagaaaatacagctttactgtccttaagtgcctaatcattttcaagaggaggagcaaacagtttgccctcaagtatctggtctatcaacaggggtctggctaaggaaaaaacggccttagagcgtgatgaacctacttaacactacctggtacctcaactcatgctaaacattctaatttgagcaaagctaaatcatgggtcttagtctgtttagcaaaatctccacaagatgaaatttagcttactaccccaaactgttcaatgttttgggtccaatttagacacaaaaaaatgttttataa

SEQ ID NO: 17029 - DNA, 47284 bp, Human
accttggcctcccaaagtgctgggattacaggcgtgagccaccgcgcccggcctaacttgtatttttagtagagacgggggttccaccacgttggccaggctggtctcgaactcctgacctcacgtgatccatctgcctcggcctcccaaattgctgagattacaggtgtgagccactgcgcctggccggtatgtgtttttttaatccctaaagcttggtagtttaatattaaattcaaattactgtagcctaggactcttttgaaaaatacttgacagcttcgtttttgacctatctcattaggctgagttctcttttatctttacaatacagatgtttaaaattaaaatacagatcggccgggcgcggtggctcacgcctgtaatcccagcactttgggaggccgagacgagcggatcacgaggtcaggagatccagaccatcctgtctaacacggtgtaaacctcgtctctaataacaatacaaaaaaaattagccgggcgtgatggcgggcgcctctagtcccagctactccggagactgaggcaggagaatgttgtgaacccgggaggcgggcttgcagcgagccgacatcgcgccactgcactccagcctgggctacagagcaagactccgtctcaaaaaaaagaaaaaagaaaattaaaatacagatctagatctggattttgttaggttttttttttttttaacaacctaaggttgttcagaaacatctattctatgtatgtgcttctttagtctgtaatttctaggcagattagttgcaccctgtctagactcctttcagaaaaatactaacaatatgtttttctctgtcttgggctccacatgggtgaattacaggaaagcttaacaggtactcagagcaacattttttcctacttcatgaagggcctaaatgcgaactcttaagtatttctcgtttgcttttgttcttttcccaggtttacctaatctgtaagtgtaagatgcagtcgatgaaaagtactatgggaattcttgagcaaatcagaccattcaaaaggaaaccacttcacgtaatggtgcataaggaagctagactcaccaaaataaccctgttaggtaagccggatacaccatggaatacggcaatcctctgtttaatttgcaaaccctttggcggggaggaggaaaggatggaaaaatttgggtgaaggctttatatgactagtcaaacaaacggtgagtcattgaaattttccagttaacaatcccttctgcctgggcagagcctgggccccagcgctttatgagccacactgcagttttaagccggaatatctcacggttttattgtttcttccacgaaatgattacataaaatgaaatcagctttgcaatctgcaccggctttgaaatgaagggcaaaatctggctgggggtgaggagaaagaaggtggaaagagaataaggtacggagactgtgaggcagagaacgcaggaaaggtggtgaaaagagagtacaagaattttcgggagctgagtgtatttttcttccccatgttatagatgctgtccgttttcccccagcctgtgtccagcaggccagagtggacccctcctatgggctaaaatactctcggtcttcggcccagcacagagctgcaccaaccagggcctgccgctgcccccccaccaggtgacaggtggggccgccgagcggccaccagacctccgcctcctcgcgttgcctgccgggagccggagccgcttccggttgcgccctgtccctgaacttcgactcccgtcggcccccgggaaaaccgcagcggggtagcgcgggcgctgccggaacttgtagttccacctcccgccgcgctaaatagccggaaacgggggcggccagaacagagaactaccgaggcgaaggtacgggtggcggcgaggggtcaatccgcgccgggggtggggttggctgtgaggccgtcggaggtggttgggtgggaggagatccgctcacacacacgaggaggagggttgagctgccgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttcccgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggggcccggcagcgccgccacccccagctggcggcgcccccaataaccacggagccggcagcggcgcgggaggccgtgcgggtaaaggcccgggacgcgggaggaagtccggccgggcgccggagcccacatggcgtaggggtgcggtccgggggcgcgcggccctggggcccggtcggcacgtggggcgctgacagtggcgccgtctgcctgggtggggcgccccgagcccgggagccggccttcgcggggcggcccgcggcggtggccgggcggggagcggacagcgggcagcgcgcccaaagacccggacccgagtgccgcccctccgcgcccctgccctgctctggagtccgcagttacccacttgagatgggaaccgtatggaacggagtgggggccgcggcggatccctgccacgaggcgcagaatgaggacagatggagccaggagtcatttgggtgggcgtttagagatcccaggagttggggaggacgaatggccgagttttcctttcaccttaggcccagccgagagagcgtcttctgctgcgttttctactattgaaactgtaattacggtttaaactgtccgtggcccccaaccgtcctgaaggaatcccaagatgcattgcagccttgtgatcgggcagaaacttggctatcaataccaagatctgttttacccttagcattgtgtacgcttctaaagtttacaaagtgccacaaagttaggattcctcacttaatgtgtgataggagactatattgatttgtgtctttttaaagtgaagcttacacttttatcctttgtcagcgacacgtttagagaattttcattgctgtaaaatcgttgaccttattcagattgcttggaataactcactgtgttcgtgcatcagtagttcagtctatttcttcagacacttgagcatttgttataatttaatagttctcacgtgtctttctgaccgtagctagtagacatacattttctaatccataaaatttcgagttaactttggtttttaaacatcttcccgtacttaggggttgcttaagtcgtaggtagcatgcttgcaggtgctgacgttgtaggaatatccggtgagtgaacttatgtattctcataatggtgcttattttgtggtaggtagcttgctttcaggtactgattttgtgggaatgtcaaatgagtgaacttaagtattctcttcctaatggtgcttattttaggaactatcagtgtttccttaaagagaaaatgaaaaaggaaggaaaaggctgaacgtcctttcatcatttagccaggacgttagtggggtgggtcatgacatccagcgcattttaagtgagaacatattgttgatttctctctttaaagttctgtattgtggtggttcttagataagtggacattataaaagtgctccaggagtttggtttctacagaaacttttgtcaccgtttgctctttcgtggtaaagggatagtgtctggagaaacactctgatgacgtatgtacgtcagcacggttgatttggtggttttgttgacagtggcatttatttgtgtgggtggttgatgttttcttttgaggagatcgagcactttcagggtggtacggctctagacaatgttttcctcttgaataaggaagcttagcttgtaattcttgacttacatcaagccattttgactgcctaacctagttcacttctcagctcctaaaagtgcccattccctaccttactttgcagattccgtttatccagccattttctttcttggctcttcctcctttctgtggagccaccagcaccactctgactagactcaggactccatttacagcctgtccagcgagtcatccggggataaccaaccttggtctagaatggtcactgttggtgactaggtattacctcttatgcgggctttctctcttcctgatagttgctaatttgtagttacacctaatctttttctctttgacagtgctagaaattggagatgcgaaaacctgtagggaagtagctgtcagtaagagaatccgtacagcatggtcaactttcttgtttttaatcaaaaaactattttggtgttaccgactttaccaattgcttgtaccaaaatgccagttcatgtttttaaaaaattatcctatgtaggatgtctatttggaaaagaactgattttctaagttgaggtccagggttatattgagactgttggattgcatgttccagactattaagtccataaaaagccagcatcggagaacaatcagtgcttataaaaagcagggggataaataggaaataacacctggattggaacttacaaagggggaaccaaaaagtttgcaaggtttttttgatagcgaggaagtggacaatagggctagcatgttctgttctttagttaagccatagccgaaatttgtgctgggtgtgtttttaaactgcatgccgggaaagctgttgaaggagcctggagagtcagaccttgggattcagtattgaccttggatctctttgaaaactaaagaatataggttccttaagaaataattaagtggaacccatttaagtgtaattaagtgtaattcatttaagcacagttctctagagccaagtaaattggccaagagattctccttaaaaagtgaggtccccaagtgaataaaaatatagaagacaaggcttaatgtatattagaacaagcattttatctgataggatgtatttaagttgcaatttgcacctagttttttttattgttagataagaaactggtttagtaattttagggttacttgaactttttagaacagccagagcttctaaagtaatgatgtggtgttctttgcatcatcccacctttaatgcttctcagaactcactgccattaagaaacaagcatggaataaaaccagcagccctcagtacttacttggaggaggcactgtctccaaaacttagcagattgtattgtggaacttgaattttaaagagaaacattctgttttgtagtgttccgtatttgctgaatgccttatttattggaagaggaggttttttttttgttttttttttttttgagacggagtcttgctctgttgcccaggctggagtgcaatggcacgatctcggctgactacaacctcctcctcccaggttcaagcaattctcctgcctcagcctcccgagtagctgggattacaggcacctgccatcatgcccagctattttgtgtgtgtgtgtttttgcagggatggggtttcaccatgttggctaggctggtcttgaactcttgacctcaggtgatctgcccgccttggcctcccaaagtgccgggattacaggtgtgaccccgcgcctggccttttttttttttttttttaaatgattgacatttaacttacacactgtaaaattcacccttttcaactgtacaagctgggcgcattggctcacacttataaacccaacactctgggaggctgaggtgagaggattgcctgaggcctccataaaacatagtgagactgagaccctgtctccacaaaaaaaaaaaaaaaaaaaaaaaaaaaaatacagctgggtgcagtggctcatgcctgtaatcccagcactttgggaggccgaggtggacggatcacctgaggtcaggagttcgagaccagcctggccaacgtggcgaaacctgtctctattaaaaatataaaaattagccaggcatggtggtgcgcgcccgtagtcccagctactggggaggctgaggcaggagaatcacttgaatctgggaggcggaggttgcagtgagccgagatcacaccactgcactctagcctgggcgacattgacactctgtctcaaaaaaaaaaaaaaaaaaatagctgggtgtggtggcacaaacctgtagtcccagctacttgggaggttgaggtgggaggatctcttgagcccaggagctggaggctgcagtgagctatgatggcaccattgcactcagcctgggtgaccaaatgagacactgtccaaaaagaaaagtaaagtgtacatacagttcagtggcttttaatatatttgtaaggttatgcaaccatcaccacttggcagatgctttttagaatattctcagttttaagctggaacatctcagaagtgacctcttcagggccaccagagtagagaggattccaaatcaaagtaatggttgtttaatccagaaaggcccttacactttattaatatgttaaattctatctgttgaggtagataataggtaagattctgtatttgagaatgtgtttttgagactgaagtgcctgcaagaacagtgctcatataaaggtgtttttaggcttcagtgggacagcagatggggtagaggagaggccccacagtatccctggagtatcacagtagtaaacactgcctttcgttacttctcctgccatggctgacctttttgtctcttgtttcatggttttacacgtatgaatggcttgagactgaggatttagggaagaagcgaaggcatcatctagggctgtgctgtgccaagttgagcagttgtttaaactgttagaatttttgactggtgtaaaaaccctctttggagcaggtattacgtagtgctgtcagtacatatcttattgcattcttctgttctttattttttaccttttctgaagttgcacagcgtgaaaagacagcaatttcagtttgaacaagttaaggaagtaatgtagacgacaaagtttaagccttgatttgcttgctttggtttgctggggaagaaatgtctgaaagtgttcagatagtattttctttctggttgaagagaaaggaatgaaaaagagatttgataaccttctgggttgagttagcagtattggaatggaatttttttccagaaatgcgaatttctggttttgctcagatatatgtactagcgactcattaacaaacatttaccagtccactgaatgaaagatgctatgctaggcacttgaaataacaccaagatgaataaattgtggtcctgaaggaatctagaaagggatcagatgcccagtgtactctagtggaagtcacagtgtggtaagtgagccctgcagagagtgtagagaaggctttcaaagccgagaacagcaatcccttacgtaaaacctctcagtcttgtcactctcataaaactaaagatttatctattatctgctcactgttctttgcgaatgccttgtgtgtatttttttttctggcctcctgggccagagttgcagccaaagcctgatcaccaaggttgtgtgtattttaaaaaactttttacttattattttttagagacgggatcttactttgtcacccaagctggagtataattgtgtgattatagctcatcgtaacttcaaatccctgggctcaagtgatctttcacctcagcttcctgagtagctaggactataggcacccaccacgacgcctggctaagtttttttgtttgtttttgttttttgagatggagtttcgctctgtcacaggctggagtgcagtggccctaactcggctcaccgtaacctctgcctccccaggttcaagcgattgttctgcctcagcttcccaagtagctgagattacaggtgcccgccaccacgcccagctaatttttgtatttttagtagagatgaggtttcaccatgttgcccaggctggtctcgaactcttgacctcaagtgatccacccgtctcggcctcccaaaatgctgggattacaggcgagagccactgtgcctggccaagttttgtatttttaagtttgtcgagagtgctgaaggtagagcactggttatctttttacagtacttgtctatttcgtattaaacagcagtgagttcagttactatgagtctggctagtgtgtctattggggcatgtttagaatttcatcattctacccttggttttaaaatatcttcgggagacaagaatttggctactagttgaaggatctgaggtcctcagaacaatcaagaaaactgacagtttttagctgttgattgttgattcatttcaaggcttagaagtttctgccttgttttcagtagagtttaacaaagtgagccgagactgtagatttatatggctccttcgtaaatggctttgttctaaggaaacctagttgttacagtactctaagttgaaccagtttcccatcataattctactttcaaagagagaagaacacttaataaggctttcccgagcacctgacctaacagtggtgacactcacttccaaaccacattcccactaggtaattgtatgtcgcttcacttgaaaaaaaaaaagcgcattctgcagaatgtcactgggtaatttcctggttgaatatttctgtagaactccagtatgttaccatactacttgtccattgcctttaggtggttaattttggtagcagaaaaatgtttcggttatttttttatttttgacatggagtctccctttgttgccccggctgcagtgcaatggcgtgatctcggctcactgcaacctccacctcccgggttcaagcgattctcctgcctcagtctcctgagtagctgggatgacaggtgcgcaccgccatgcctggctaatttttgtatttttttttttttttttttttttttttttttttgagacggagtctcgctctgtcgcccaggctggagtgcagtggcgggatctcggctcactgcaagctccgcctcccgggttcacgccattctcccgcctcagtctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatttttgtatttttagtagagacagggtttcaccatgttggccaggatggtcttggtggctactgacctcaagtgagccacccacctcggcctcccaaagtgctgggattacaggtgtgagccaccgcacccggctgtttctgttatttttgtacttttttgagggtatctgaaatggttttggtttgtgtattttaaatgttatttaaatggttttttgtttcttttttgtttttgagatgaatctctctatgtcgcccaggctggagtgcactggcacgatcttggctcactgcaacctctgccttcctggttcaagcgattctcctgcctcagcctcccaggtagctgggattacacgtgtgcaccaccatccccagctaatttttgtatttttagtagagacggggctttgccatgctggccaggctggtctcgcactcctgacctcaagtgatctgcccacttcagcctcccaaagtgctgggattacatgtgtgagccaccgcgcctggcctcaaattgtttttgaagtagttaggttgtagctcataagactgtctttcagggttgtttgaaaaacataatggaattttagttactctatgcaaagtctgatcaggttgataatgtggcattgcttttgtgtccgaataaagaggttcttagaatgttagcgctggatacgaccctagcagttgtacagcctcttcattttcagataaaggaactggagccttagaaatgctaagtaaatgcctaaggtcactcacagagttaatgacaccattgagtctagaatgcagatttgctacctgctagtttagtgcttgatctgccacatcatgctgtttaataacagggggcgggaagggcatgcctggagctaattactacaactagcgtgtagttttctgagagtggccctggcatttgcctaatgtttcattcttaaaggtttttgaaattattttggggctttgaagtgcttgctgtaataaatttattgagcatttaccaccccttatcagttatttagtcttcacaacattctcttgaggttaggtactgttgacccattttacagatgagaaaataaaggctcagtaaagctaaataacttaggtcagtcatatccatgagaggagtgaggcttggaatcgaggtcatttcaaagtttattctagtagtgactgctagtgctttccttgtgattttgtattaaagtagactgagactctccagaaactggacctgtgagcttggaccatggcatttctctgtgttctgtctcagtagtagcagaatgacatttgtcataagtaggcagtgctctgatttaaagcaatattttgaaattacttctttttacattttagcaagtgttgatgtaaaatactttaaaacagctctgttcaccactgtctgtaccgagcctttttatttttagagtgttaggtaattaaggcaaaaccatccacattgttttatgtgttctgtagacttctttctggtgtttgcttttactgtttttcagtattgtctacgggagaaaaaaagaaaaacctcagcttgcaaatttttgttcagagatgggatcgttctttgttgttggagggatttacattaaaaaaattcaagaaatattgtctcatgtgatcttaccagataagtgcctattattaagacttgttggctgctggatttattatcttagcctaattttctttctgagttaaatgaatcttgcttttttatcgttaccaccctggcataatccaatgggaatatagtatgaaccacatagttaatttaaaattttctttctttaattttgttttttgagacagggtctcacattgttgcccaggctggagttcattggcacaatcatagctcactgtggcctcaacctcctgggcttaagtgattcttctgcctcagcctcctaaatagctgggactacagttgtatgcctccacgcctggctcatttttacatttttttttgtagagacagagcatcactgtgttgccctggctggtcttgaactcttggcctcaagcaaccctcttagcttggcctcccaaagtgctgggtttataggcgggaaccaccacagctggcccaacatctcctgagtgtagtgtttccctaaccccttcttagaaagttggcacatttaaaattgttttcactctcttgagccctaatggaaatgcaatgaatgtacagatggaggctaggggtcctggtcagaaaagggaagtgaggccagttgtggtggctcatgcctgaacccaggaggtggaggttgcagtgagcccagattgtgccactgcactccagcctgggcgacagagtgagactccatttcaaaaagaaaaaagaaaagtgaaaaaatgaagtgatgtgactggaaggaaccagtgtgaaaatcaaaggaaaacacagtaattcagtaaaaattgattgtgtatttattctatacaatacatcatgccaacttgttgagactactgaagtagagaaaaaagtcatccacccacagttcattctggaagtctacaatctagggaacaagaactaagatacatgtgtacctataatttatttatttatttacttacttatttttgagacagagtctcgctcttgtcgcccaggctggagtgcagtgactcagtgatctcagctcactgcaacctccacctccccggttcaagccattctcccgccacagcctcctgagtagctgggattacaggtgtgtgccagcagacccagctaatttttaattttttagtagagacggggtttcaccacgttggccaggctggtctcaaattcctgacctcaagttatctgcccgccttggcctcccaaagtgctgggattacaggtacaggtgtgagccactgcacctggtccccatgtgtgcctctaatttaaagaggtgtcatgtcctaggggagtgatcattagcccttcagggtaggggatggacagggaatgggatagaaatgggggattaggtaggcaagtgtgtactacaattaaggagaatccttgagctagaactgttatccaaagtgtaatcgagaaccacatgtggctatttaaatttattaaaattaaatttaaaattcaattcctcagtcataatagccatgtttccagcgcttaataaccacatgtggctggtgactatcatgtcacagcacagatataaaacatttccatcactacagaaacttggacagaattttgtcacacatatttcttactttcatgcaatgtgagacacttctgtgacagatccgaagttgtatttttctttaatgaacacccatttggctaacaaaactacagtttcactcaggatgcctgtgttttgttgttattgtttgatacagggtcttactctgtcacccaggctggagtgcagtggtgtgatcaccgctcactgcagcctccacctcccaggttccagtgattctcctgcgtgggactacaggcctgtgccactatacccggctgatttttaaattttttgtaaggacgaagtctccttgtgtttcccaggctggtctcaaactcctggcctcaagtgatcctcctgccttgcttcccagagtgttggttttacaggcatgagccactacacccggcttgaagattagttttgtatctaaagcagtatgaatttaaattgctgatttatgaaatacatgcatcaagcactttttaagacttagccaaacatttgtgtttaaaacatgtaacttgaatcaaaacgtagctttttttttttacctgccatgatgtctgtggccttgactgacgtatgctgtgaggatatgctggccaagtaggattctccatattcaagtcctttgacccatgatcatagctttaaaaaaaaattgtacactcttttaaaaaattgaagcaaaatccacataacataaaactggctgggcgcagtggctcacgcttgtaatcccagcactttaggaggccaaggcgggcggatcacaaggtcaggagatcgagaccatcctggccaacatggtgaaaccccatctctactaaaaatacaaaaaattacccaggcgtggtggcgcgcgcctgtagtcccagctactcgggaggctgaggcaggggaatcgcttgaacccaggagtcggaggttgcagtgagccgagattgcaccactgcactccagcctggcaacagagcaagactcaaaataaataaataaaataaaataaaataaaatgagtcaggaatgatgttggtgttgaggttggcatacgtatcaaggacagtaactaccatggctcccgaagtgttgccaaaacctcagatgtgtggccttctggccaagcgtctgcgatttcaatgtttggagcattcatggtgtccctgggggttgcagctttgtatgagtttggtgtgggtgaaccaagaaagaaggcatatgcagatttctgcagaaattatgagattttgagcagatgaggaaggctggtatctttcagtttaaagtaatcttggaatataaagaatttcttcaggttgaattacctagaagtttgtcactgactcgtgttcctgaactacgacacatgaatatgtgggctaatagttcgtcttgataaacaattaacaaacaaataaataaagccattttaaagtgaacaattcagtggcatttagtacattcacactgtgttgtacaaccagcaattctatgtagttctaaaacatttccttttttttggagacagggtctcacaccgtggtccaggttggagtgcagtggtgcgatcttggttcactgcagcctccctccacctcccgggttcaagtgatcctcccacctcagcctcccaagtagctggcactacagacatgtgctaccacacccagctaatttttattttatttaatttttttgagacagagtctcactgttatgcccaggctggagtgcagtggtgcaatctcggctcactgcaacctccgcctcgcaggttcaagattgccagattctcctggctcagcctcctgagtatctgggattataggcacctgtcatcaccctggctaattcttgtattttagtagagacggggtttcaccatgttggccaggctggtctcaaactcctgacctcatgtggtccgtctgcctcagcctcccaaagtgctgggattatagtcatgagccaccgtgcctggcttgaaactggattgatagttaaaatttgattatggtgaagcaacacaaacaccacatattctatgattccattgacatgaagtattcagaagaggtaaatccacagagacagaaaacagacatactgttggctgccagaagctaggagagagtatgggcagtaactgctaaatgaatacgggtttccttttggggtgattaaaatgtcttggaagccgggcgcggtggctcacacgtgtaatcccagcactttgggaggctgaggtgggtggattgcttgagctcaggagttggagaccagtctggggaacctattgaaacaccatctctataaaaaatttaaggccaggtgtggtggctcatgactgtaatcccgggactttgggaggctgaggcaggcagatcacatgaggtcaggagtttgagaccagcctggcaacatcgtgaaacccccgtctctactaaaactacaaaaattagctgggtgtggtggcacacgcctatagtcccagctactcgggacttaaagcaggagaatcgcttgaacccaggaggtggaggttgcagtgagccgagactgcgatagtgcactccaacctgggcgacagagcgagactccatctcttaaaaaaaaaaaaaagatccagttccagtttatcatgtgtatcacaggcagtactggtgttctgctgttctctggtaaagtcttcacttcatgttttaaaatttgtggtaatgtaccaagtaccacagtcaagtcattaatcttcctttattataaattatactattagttttgcctcttttttttttttttttttttttgagacagagtcctgctctgtctgtttttgagacagagtcgtgtcacccaggctggagtgcagtggtgcgatctcggctcactgccagctccacctcccgggttcatgccattctcctgccttggcctcccgagtagctgggattacaggtgcccgccaccaagcccggctaattttttgtatttttagtagagacagggtttcaccatgttagccaggatggtctcgatctcctgaccttgtgatccacccgcctcggcctcccaaagtgctgggattataggcatgagccaccgtgcctggcttttttttttttaagatggagtttcgctcttgttgcccaggctggagtgcgatggtgcaatctcagctcactgcaacctctgcctcccgggtagcttcctgcctcagcctcccaagtagctgggattacaggcacaagacaccgtgcccggcaaatttttgtgtttttagtagagttggggtttcctcatattagtcagactggtctcaaactcctgacctcaggtgatccgcccgcctccacctccagaagtgctgggattacagatgtgagccaccatgcccagcctagtttttcctcttttttttttgagacagggtctcactctttcacccaggctagagtgcggtggtgcaatcttggctcactgcgacctctgctacctgggctcaagcgattctcctgcctcagtttcctgagtagctgggactacaagcatgagccaccatgtctagcctaattcatatatatatatatatatttttgtgtgtggagatggggtttcaccatgttgcccaggctggtctcaaacttagtttttccttgtaatttggggcatggcagttgcactcagtggtaaaccctgaaagctttcccacttagaaaaaattgttccatttttaaatagttaataaaggtgtgtttctaaacatagagataacactggaaaatttgaaactgtaatttcattccttgagagggttctaacttcctttactagcagctgtgaaccatgtaggatgtgagaaattacaccctaatcatctatttcctagccatgaacagttcaacctcggaaaattctaagcccaggctcattagtagccagtaaaatctggatgttatgtgagtcatgaataagaccagagtagaatgaacaagtaaaggtttactgtgtatgtatgaagatagggtagaaatatatcggttttatttttattttttgagacagggtgtcactctctcgcccaggctggagtgcagtggtgtagtcaggactcattgcaaccttgaccctcccaggctcagcccccggagcagctgggactgcaggcgcatgccgccattcccgacagttttttgttttttgttttttgttttgctttttttggtacaggtggggttttgccatgttgcccaggctggtctcaaactcttgccatcctcccaccttggactcccagaggtttaggactacaggtgtgagccaccatgcccaacccatttgcaacttacaatccattgtaagttgaggagccatctgtattgtaaatctaatagttggtgccaggaactaagtggtcaggtgtaagtactgttttgttttgaaaagctgttacagttagtgatacacttgagagtggtgaggaagcccaccacacccgtcattttcctgccttaagatacgcagtacatcataactgtgtgtccgtcagagcttagtttacttgtacactgattttcagcagggactatctgaggaaggggaagatggcacttgcataacttggaaatgcctgcagttgattctgatgtgcctgtatgttagatggtagtgattacaggatctgtttcctaaggcttttggtgggaatgagctagcagtcggcacttagggctcaataaaaattagttaaagcaaattgctaccccctccatcccccactccctacacaatatggatttgtgagtacttttatccttgtctggcccataatagatactcaatacatatatatatgtattcatttttattaatttttttttttttgagacggagtttcattcttgtccaagctggagtgcagtgacgtgatcttggctcactgcaacctccacctcccgggttcaagcgattctcctgccttggcctcccgagtagctgggattacaggtgtatgccacacccagctaattgttttgtattttcagtagagacagggttttgccatgttggccgggttggtcttgaactcccgaactcaaatgatccccccgcttccgcctcccaaagtgttgggattacaggtgtgagccaccgtgcctggctgatactcaatacatattgataggattgagttggagtagttacatagcagatggagacacatttgttgaatacgccaggagttctttaactgacactaaacaaattattctcccatttcctcccataaactcctcaacaatcctctcaggtagatggtatatcatttccacaatttcagtggaataagtgcatgcacagcttgtaataagccaggagttaaacctaggagtcagctcagttccaggctctgagaagtaccccatgcagtcacctccttcttagggtggcctgtgaacttgatactctcagtactacctggcttcctctgaaaactgagtaatttttccttaccttatccttaaacttttcttgaaaatggaaaagcaaaaaaaagttaatctgtattgtgttgaagtacagtttctgcctccttccaaaccaggttcaaatgcgtttcccccctgtttgttaatgtcctgctcatcccacagcttggggtcatcttagaccttttactctccctttctcccaactcctgtcaggtgtagcccccatcccctcctagttgtattgcttggttgtctccatggcatgctttcttgcagtggtgatgtgggtcttcctgcctgtggggtcttgcccactctagttcatgtagtttaagctgcaagaaaaagatcttcctaagtgacagtctgagcctgtcacttaaaaaaaaaaagaaaacaatttggttgtcctttacctatcagggacaggaaattactttactcaacatttgatgctattgaaggttgggcccaaaacactttctcttgactcttacaggtattgatcctttccgggcaatgattttacaggttacaaattcattattttttcatacttgctgtgcatgattcatatgatttaattctttagtatcgttttctgtcgtggagattctttaaagcaggggcacgttcatattggagtataatttaggtttgtctgtatctgacaaactaaaatccaaaaagcagacttagatatttggttattagtatgtatttctcctacatctcttccagtaatgtcataagtaaatttgcagtgtggcaactggaaactggattgttgcttggttttagagttctagtataggaaaaaactggcatcattggaatcaccttttctgcagatatttttaatggcttatatatgtttcaggactttatacacatgtcatttatcttataggtatctaatttattcagggattttgataacatgagtatggaatattaaaaagggctaatcacaggctggatgcggtggctcaagcctgtaatcccagcactttgggaggccgaggtgggcagaacacctgaggtcgtagttcaaaaccagcctgaccaacgtggcgaaaccccatctctactaaaaatacaaaattagccgggcatggtggcatgcacctgtgatcccaggtactcaggaggctgaggcaggagaatcgcttgaaccggggagatggaggttgcggtaagccaagatcgtgccattgcactccaactccagcctgggcaacaagagtgaaactcagtctcaaaaaaaaaaaaaaaaaaaaagggctaatcacagctttcttgggctgggttacctagagagaatcacgggaagtagatgtgtatttgttgagcacatctctaatttgatctgtgctgagctgcaaattactttgacagtatctgtgaagaaaaggtttataaagcaaatcaaaagaataagcatgtttttatgaatacattgaaactactgaaaatgtttcaaaattggctgtaattagtagaattttgaaaagtaggttaagcagagacttctaacttgaaggcctgagttagctgccattgatctggggttattgattgaggcttgtgtcgtgttattgaacttctgtttttactgcatattaaaagataagtgaaatggatggataagtatcaatttttaatagaacttctttctgttaaacagcacctgtggaatcctctcaagaggaacagtcattgtgtgaaggtaatgatgtactctttgaaagtctacttgagaaaacattaggttgtctatatggtgtgtaaagctagatactgtttggtaaatatatattatatttcaatctcttgtctaggttcaaattcagctgttagcatggaactttcagaacctattggtaagaaaatttctgaccatattaatacagtaatatgaaactctttcactctcaagatttaaggtgcattatgtaagttacgattattgtaatgcctacatttaagacacattgagtctttgctattagtatttagaaagtagaacaaactaggcactaacactgccttgataaacttaatgattgcaaataaaattgagtggaggaatggtcaagtcaatttaaatacctgtacctgttctgttttctttttttgagacggagtcttgctctgtcgcccaggctggagtgtagtggtgcaatcttgggtcactgcaacctccgcctcccaggttcaagcgcttctcctgcctcagcttcttgagtagctgggattacaggcgcacaccaccacaactggcaaatttttgtatttttagtagaggcggggtttcaccatgttgatcaggatggtctcgaactcctgacctcgtgatccacccacctcggcctccgaaagtgctgggattacaggtgtgagccaccatgctcggccacacgttctgttttcttggtgaaaaatgttcttcctttttataactttattcttaagggtttcacgttctcagcgtgattaaagttgatgccaaagttttattagtttaagaggaaaaagaaaatatttcctaaatcctttcatatttctcgtgtgtcacgattttaaactttcctttttttcttactatcagggtgtctcaacactggaataactaggctgttgggaatgttagaactcttgtttgcattttgtttgccattatgaaaatgaagctttgctaaaatagcaatctcagcctgtgagtcagtgccctctgatgtgataccagcagtgagtctgccttgaaagctgtcacccatttctgctatgaaagaggttttcctgcttatgtgtcactaggcattaggaaatggaactacatatgcaaacttccatttgttgttttaaagctagtgtattttaaagtatagattgtaagtctttttcagaatactaagttaaaatgtctttcttcagtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtaggtaagctgctctcatagcaattaaagttactggatacataaaacatagaacatcctttttagctacctggagatgtttagtgaaactgaagcaaattaattgaaaatgtcttgatttttaacttgctgattttttttagctggcaaaaaattgcaagtacttttttcctgaagtttaggcaaatgaataattctgtaacggcatagatgctggaagaaaaacttcagtatattgtacgtaacatataattagtctattgaccattgatggtagttcagcatagtattatatatcagtatcttagaaaatgtgcccttttttatgtgaacctcagttaacttgttaattttaatgggattgaccttaccagataattttgtgtgaagcaggaaatcaataatttggagtaacttctggatgcttgccaggttgctggtttagcaaaaaacaaaagaacaaatttatttaatttactcagatattctctaattatctggcctatccccagaattgtgagaaaaaaaatacagaattatgtgtctttcatttcagctatctctgccttccccccagatatgaaacactgtaccccttcttttagtagcaagaactcttttgaaagtgtaaaggagcggctgggcactgtggctggcgcctgtaatcccagcactttgggaggccaaggcgggcacatcacgaggtcaggagttcaagaccagcctggccaacatggtgaaaccccgtctctactaaaaatacaaaaattagccaggtgtggtggcatgagcctgtaatcccagctactccggaggctgaggcaggagaattgcttgaacccagaaggtggaggttgcagtgaggtgagatcgcaccactgcactccagctctgggcaacggagcaagattccgtctcgtggggaaaaaaaggtgtaaaggagcacatacctcatttgctgtaagtgaaaggaaaagcacctgaatctagttcacagttcttcagctgcttttgctcttggaaacttctcttggggaatttatagtctgttgccgctgtgctttcggagtaatctgttaaaaaattctttatcagtaaagtgtttttaagtggttttttttttttttttgagatggagtttcactcttgtcgcccaggctggagtgcaatggcgtgatttcagcttagtgcaacctctgcttcccgagttcacgcgattctcctgcctcagcttcccaagtagctgggattacaggcggccgccaccacgcctagctaatttttgtatttttagtagaaacggggtttcaccatgttggccaggctggtctcgaactcctgacctgaggtcatccgccctcgctggcctcccaaagtgctggaattacaggcgtgagccaccgagcccagccttgaggctcattttcaaaaggagaagggtaatgaactaggatttatgccccaaattcatatggaagatttaattatgtatgttaaagggtgctgttgtttgcatatttagccattggtttttggttttaacctatggtttgcatgttgatgttacttttagatgctggcaagtcaaccattggaggacaaataatgtaagtctgtatcttttgttaaataacagagttaaattgatgtaatgaattttaggcattgtaaaccttcatacagtcacacaaaggagataaaacaggtcccccaaagaaaaattaaaaataaaattactgggacacaatactgatgttaagaagtgatttttggcctggtgtggtggaacacacctataatcccagcattttgagaggctaaggtgggaggatcactggacttgaggtctggagtttgaaaccagcctgggcaagacaatgagactctgtctctactttaatttttttaaaagtagtagtttttgtaatgtgattattactagtgttaaatgtgtttctgaaagctttttacattttttaaaaataaaaaatgaacacagaactctagattatgggaaacttggtctcctttgcatataacatacatgggaataatgacaaccagctcttgaatctggtgaatgggggaactgttttttcctcattcatcagctccttaaatgtatatggatttaataaaagacaggtagactagctaaaatgctaagataattttttgatcgtattatagaaatttcctaggtatgaaatgaccgtggctggcctttagtaatgcattttagtattgacaaatcttgataactaaaaagtcctaaatttttaattgcttctctaaattagacccatttctttgaactgtgtcatcagaggacctagagggcttgccatcatcttgcctagttaaattttttttttttttttttttttttttttttttttttgagatagggtctcattctgtcaccaaggctggagtgcagtggcatgattttggctcactgcagcctcgacctcctggactcaagcaatccttccacctcagcctcccaagcaggtgggatcacaggtgcatgcaaccaagcctggctaatttttgtgtttttttgtagaggtggtgtttcatcatattgcccaggctggtcttgacctcttggggtcaagtggtctgcccacctctactgcctcccaaagtgctggcatacaggtgtgattaaccacacctggctaatcatcattggtaatcttgccagttacttttgaacatttccacaacagagactctaagacaggctgttaaacaggggtccttccccaggtctctgtggttgaagtgtcacagccatatgatgttatgtttcaggacagtgtatattttttgctgatgggctgtaagttttggtggcgtcacactgggtttctacatgcaaatgcttaggtgcactgcactatagatgtctacgtggagaacacagatgaaagctatagggaaaggagagctttgaattggattgagtcaaggaagtatgcattactaacgaactattttgaaattattatctcattttgacaagtaataagacttacttgcctagacaacattgttgcaatttttttttcttttctatagtacctacatttacatttacttgttattttatttttaaatttacttggctgggcatggtggctcatatctgtaatcctagcattttgggaggccaaggcggaaggatcatttgagcccaggcttcaagaagagccaggacaatatagtgagaccctcatttctataaaaaataaaaataaaactatatttattttaagagacagggtctcgctgtgttgcccaggccggagggtagtggctatttataggggggaggatgatagcgcactatagcttcaaattcctgtgctcaactgatcctcctacctcagcctcccaagtagctgggactacacgcttgcaccaccatgcccaccttatatttacttaaaaaaaacaaacaaaaacaaaaaacaaaacctactatattctgaaataattttagatttacggaatggttgcaaaaacagtacgggaagttcccttcattcatcctgccctgatgttgacatcttataaccatagtcattcatcaaaacttccttattactggtgaaattagtcatgattacttggttaaggtgtcatctgtcaagattgtccactataaggttattgttttcccttttcttttcttttttttttttttttttttttttttgagacagaatctctatcgcccaggctggagtgcagtgcagtggtgtgatcttggctcactgcaacctccgcctcctgggttcaaatgattctcctgcctcagcctcccaagtagctgggattacaggcatgcaccaccacgtctggctaatttttttgtatttttagtagagatgaggtttcaccatgttggtcaggctggtcttgaactcctgaccttgtgatccgcctgctttggcctcgcaaagtgctgggattataggcctgagccaccgtgcccggccattttttattttttgttttttttgtttttttttttttttttgagaaagggtctccctgttgtttaggctggagggcagttgtgtaatcatggctcactgcagcctcaacctcatggactcaggcagtcctcccaactcagcttcccaaagtgctgagattacaggcatgagccatcacacctggcctgattttttgttttttttagagacagggtcttgctcttaaacacaggctagagtgcagtggtggaatcatagcttactgtaacctcacactcctgggctcaggtgatcctctcacttcagcctcccaagtagctaggaatacaggcatgcatcaccacaccaggccaattttttaatatttatgtggagatggtctcactgtgttgcactggctggtctcaaactcctggcctcaagggatcctcccacctcagcctcccaaagtgctgggattacgggcatgagccatcacaccaggccactttgtctgttaattcgagactgtaaatatcctttttccacttacactttccataattttagcatccaccagtggttcctttactttaactattttctggccaggcgtggtggttctcatgccagtattcccagcactttgggaggctgaggctggcagatcacttgaggtcaggagttcgagaccagcctgaccatggtgaaacccagtctctactaaaaatacaaaaacttagccaggcatggtggcacacgcctgtaatcccagctacttgagaggctgagacaggagaatcgcttgaacccaggaggaggaagttgcagtgagctgagatcacgccactgcactccaccctaggcgacagagcgagaccctgtctcaaaaaaaaaaaaaaaatatggccaggcgtggtggctcacgcctgtaatcccagcactttgggaggctgcggcaggtggatcacccaaggtcaggagttcgagaccagcctggccaacgtaatgaaaccccatctttactacaagtacaaaaattagccgggtttggtggtgggtgcctgtaatcccagctactcaggaggctgaggcaggagaatcacttgaacccaggaggcagaggttgcagtgagccgagattgtgccattgcactccaggtggatgacaagagcgaaactctgtctcaaaaaaaaatatatatatatatatgtaatatatatgttttatataaaaatgtgtaatatattttatataaaaatatgttatatatgttatatatatattttatatttttttagacagacacacacatataaaataactattttctgacgttgaaattttcgacaattttcacgttttcctaattccactgagtaatttgtgagtaattgtttacttttttttttctttaaatgttttcaggtatttgactggaatggttgacaaaaggacgcttgaaaagtatgaaagagaagctaaagagaaaaacagagaaacttggtatagtaaacttttatgacacttataaattacttttaaggagacgatgcccacttagtgcttttggagcctgttaaaatataaattgttgaagtctaaaatcgtatcacaacaaaggaaatttcccctctcctcataatacacagtagatgagttcctaatgctttaataacttacacagagaaatttggaaacaatccatatatctggtgatagacttgttgaaaatactataaaccatccatttaattgggtgattttgcaaccactgaaaacttacatttacataatttatagtaaccatgaatagaacttgcgttgtggtggcagttggggggaagcaggaaacatccctgtacttaagatatgaccattatataaataaatgctggaaataaaatggaatggaattattgacagtggttgcctttgaatggtgagacagtcaacttttttgttttctaaccttgttacttttatttttaaaaagttagcaagccttacctcaatgggatattgacagtcatttttttaaaataaaattatattcctctaaaataagcgggagaaatgctagtcagtgttgttataaaaaattgaggacatgctgtgaagatgatgaggtaagctaaattaatgcccactattacggatggtttgaatttatatgaatttttgcctggcagtgtgatattgaagcaatttttagcaagtaaccattgctcccacatggtgcgttagtggctttcagttttcaaaaatatctgaggacagttattttttattttattaaaaagttttagtcctggcacagtggcttaagcctgtaatctcagcactttgggaggccgagacgggcggatcacgaggtcaggagatcgagaccatcctggctaacatggtgaaaccccgtctctactaaaaatacaaaaaattagctgggcaaggtggcaggcacctgtagtcccagctacttgggaggctgaggcaggagaatggcgtgaacccgggaggcggaggttgcagtgagccgagattgcaccactgcactccagcctgggcaacagagtgagacaccatgtcaaaaaaaaaaaaagaaaaaaggaaaacaacttttattgggccaggcgcggtgactcaagcctgtaatctcagcactttgggaggcaaggcaggcagatcacacctgaggtcaggagttcgagaccaccctggccaatatggtgaaaccctgtctctactaaaactacaaaaatggccgggcacagtgtctcacgcctgtaatcccagcgctttgggaggccgaggcaggcggatcacctgaggtcaggagttcgagaccagcctgaccaacatggagaaaccctgtctctactaaaaatacaaaattagctgggcatggtggcgcatgctctaatcccagctactgggggggctgaggcaggagaatcacttgaacctgggaggcggaggttgcggtgagccgagatggtgctgctgcactccagcctgggcaacaagagctaaactccatctcaaaaaatatatatacaaaaagtagccgggcgtggtggtgggcacctgtaatcccagctacttgggaggctgaggcaggagaatagctggaacctgggaagcagaggttgcagtgagccgagatggtgccactgcactccaacctggccagagcaagactcccatctccaaaaaaaaaaaaaaaaaaaaaaaaaaagaagaagaggggtgggggtgccgggcacgacctaggctctgttgcccaggctggagtgtagtggctccatctccactcactgcaagctccacctcctgggttcacaccattctcctgcttcagcctcccaagtagctgggactacaggcacccgccaccacgcctggctaattttttgtatttttagtagagacagggtttcaccgtgttagctacgatggtctcaatctcctgaccttgtgatctgcctgcctcagcctcctagaatgctgaaattacaggcgtgagccacagcatccatccaaaaaagttttattattaccctttaactctcaagacagccattatttgtgttgtattttgtgccatgtgagtataaaaatgaagtaataagggagctcattatcacttaacacacagtgatattggcatttgtagttagtctttctgtgtagtcaacttgccataaagttctagatggtataattgactgcgtttatataaaagctctaagggtttgaatcaaaataatacattctttcagttttattttatttatttatttttttgagacggagtctcactgtgtcaccaggctggagtgcagtggcgcgatctcagctcactgcaacctccgcctcctgggttcaagcgattctcctgcctcagcctcccgagtagctgggactacaggcgcccgccaccatgcccagctaatttttgtatttttagtagagatggggtctcaccatgttggccaggatggtctcaatctcttgacctcaggtgatccgcctgccttggcctcccaaagtgcttggattacaagcatgagccactgcacctagccctttttttttttttttgagagacagagtctccctctgttgcccagcctggagtgcgatggcacgatcttggctcactgcaacctctacctcccagcttcaagcgattgtcctgcctcagctttcgaaatagctgtgactacaggtgtgcaccactatgcccaacttttgtatttttagtagagatgaggtttcatcatattagccaggctagtctcgaactcctgacctcaggtgatctgccagcctcggcctcccaaagtgctgggattacaggcgtgagccactgcgcccagccctattctttcaatttctttgttttcttttgagacggagccttgctctgtcgcccaggctggagtgcaatggcacggtcttggctcgctgcaacctcctcctcccaggttcaagcgattctcctgcctcagtctcctaagtactacaggtgggctcctccacacccagctaatttttgtattttcggtagagacagggcttcaccatgttggtcaggctggtgtcgaacccctgaccttgtgatccgccgccttggcctcccaaagtgctcagattacagatgtgagccaccgcacccggctcaattttcatttcaccaatcttgttcgtgatttaggtgttgtgtgtcatccattatatctttaatggtgaagaatatcctaaaaactctgatgttcttaggaatattgttctttttttaaaaattatttcaggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaagaaagacatttccagtccatctgtatatttgttagtagccccgcttatatctttaaatttgaatttatcttctaaaagctcaaattcaggttgcagtgaaatataatgatgtacacggtcacagttttcatcatactaatctctcttcaagaaatcttcaaaatttgatttacttctgaaaatacgtttcaccttttctctcctgttgctattatctattaccatgtcagaacttagtctccattaaatgccaagcccaccgttaggcaccatgggtaaaaaatgaataggaaaccatctgtttcatacggtcttcagtcattttgcgcttttcacaatgtactggtagtagatcacaattttttttcctttgtagttacaatagctagaaagtaaatgttggaattttaaaatatgcaggtatactagattttgggaatgtgggggattggaagcatctagacattgtttgatttgtgacattcaaaagcaggtacgtcataactcgtttgcttctattttcttgcaaaaaaaaaaaaaaaaaactcgtgatataactgaaaggaaagatgttttactgccataagggtatgcctgaaggcgaaggagtaaactgtttcctttcttggaattaggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagaggtgagcgtagatgtctggtattttatgttagtgggattaaggatggttttgttattgtacgactttttctctagggtttttctaaaccttaatctgtttacttaggaaactagagttcttggtttacattataattgagttattttggttacattataattgcagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacatgtaagtaactgttttttcctttttttaaaaaggaaaaggatgttattacttaaattacttataaagacatatgctgagtaacatgttaacatatgcttttgagcatatatctttataagtaatttaagaaaatattaaatgtaaccttggctttaaaaatactaagatctttgcccatttttaaactgggttgtcattttgttactgagtcctaagagttctttttaatactggctaccagtcccttatcagctacaatatgattatagcaagtattttctcccactttatggattgccttttttcacttctcgatggtgtcctttgaagcacaaaaggttttatttttgaagttttttacatttagatatgtatttgattttgagttaacttttgtgtaagatgtaaggtctatgtgtaggtttgttttgtttttgtatattaattgtttacacacaatttgttgaaaagactattcttttttcattgaattgatttggctccctctttgaaaatcaaatgaccataaatacgagtttattcttgaactccgtgtttcttttttttggtttgtttttttgaaacaggttttcactctgttaaccaggctggagtgcagtggcatgatctcggctcactgcaacctctgcctcccagctcaagagatcctcccacctcagcctcccaagtcgtagggactgtaggcacatgccaccgcacccggctgatttttgtatttttagtagagacagattcaccatgttgcccaggctggtgtcgaactcctgggctcaagagatgcacctgcctttcggcctcccaaagtgctgggattataggcatgagccactgcacgcagccaatactgtatgtttaaaggggaaattattttatagaatcttggtttcatagctggaaaagtccataaaaagtaatatagtcaatttattacatgtaggctatttgctataaaatatttctctaaattttaataagtttatgaggaagccttatactgagcagttttataatagttttctgtggaataagtgagatgaaatggataataaagtggttgaatgggaagaatacatgagtagaatgaaaatattattagaagctgtttatagtcatgtaacttaacattttgatatttatgttgacttcctttaatggctttgttgttatgttctcagtggattaccgtttattccatatctggataatttgccgaacttcaatagatcagttgatggaccaatcaggctgccaattgtggataagtacaaggtacccaaaatgttaaagaaattgggtttcctgggaggggaaatcattgttgtgcattttgtttctagttttgaaaactttttttcttttcttttctttcttgttttttttttgacagaatcttgcactctgtcccccaggctggagtgcagtggcgcgatctcagctcactgcaagctctgcctccttggttcaagtgattctcctgcctcagcctcctgagtagctaggactacaggctcccgccaccacgcccagctaattttttgtatttttagtagagacggggtttcactgtgtcagccaggatggtctcgatctcctgaccttgtgatccacctgcctcggcctcccccaaggtgctgggattacaggcgtgagccaccgtacctggccttctttttttttttttttttgagacggagtctcactctgtcacccaggctagagtgcagtggtgtgatgtcagctcactgcaacctctgcctcccaggttcaagagattctccagcctcagcctcctgagtagctgggactacaggcgtgtgccaccgcatccagctaattgttttttgtatttttagtagagaccggttttcaccatgttggccaggctggtctcgaactcctaacctcaggtgatccgcccgccttggcttcccaaagtgctgggcttacaggcatgagccaccatgcccggtccaaaaactttattaacaacataacattgatgtctttttcttaatggctttatattagtggtatagatagaccataatttattcaacaagtttagtttattttagctgtttcccgatgagccagggatcatatcttagtgataaactcatagatgtaactgctgggctcaaaggattttcttattaaagttgatgcatattggtaaatagcatcgcaaaaatactgtgctaacttctgtcaccactagcagcatgagtgttagttttaccacagcctcaccagcactggatgttcgtcttaaaaaaaataaacttccttgtttttaactggatttccaacttgaatttttaagttttgcggtatcaatgtatgtaatgttttcccctcctcaaatacattattctttaattagctccgttctaaatttctttaacaagtattgctttttccaattttatatatgaggaaacaggcctagagatcaggagaacctgaatttgtacaaacagttcagatcttccaacataaacttctgtgttgttttctgcacctttttttttttttttgagatggagtctcgctgtttcaccaggctggagtgcagtggcatgatctcggctcactgcaacctccgcctcctgggttcaagcgattctcatgcctcagccttccgagtagctgggattataggcaggtaccaccacacccagctaatttttgtatttttagtagagacggggtttcaccatgttggccaggatgggctcgatttcctgatcttgtgatccacccgcttcggcctcccaaagtgctgggattacaggcgtgagccactgagcccagcctttttttttttttgagacagagtcttgctcttttacccaagctggagtcgagtggttcagtctcggctcactgtaacctctgcctcctgagttcaagcgattcttctgcttcagcctctggagtagctgggattacaggcattccaccgtgcctggcaatttttttttttttttttttttttttttgtatttttagtagagatggggtttcgccatattggccaggctggtctccaactcctgacctcaggtggtccacccacctccacctcccaaagtgttgggattataggcttgagccaccacatccagcttgtgccattttctttttaaattataggcatactgaattattaatatgatcatacatatgcttatgacacaaattattatagagtatttgttactgagtttaagatgaacctaagccttctacttaagcaaatgattttcctttatgaataagcagtgtagaatttcactttgggctattgagctgttatacagcaccaagaagtctgaaactggattttattttacatttgatcaggatatgggcactgtggtcctgggaaagctggaatcaggatctatttgtaaaggccagcagcttgtgatgatgccaaacaaggtaagaatcggttatgctgtttcctatctatttattgattttttttctttttctttaagagatagggtcttcttctgtcaccgaggcaggagtacagtggcgcattcatagcttattgcagcctcaaactttcaagcaatcctgccacctgagcctcccaagtagctgggactataggcttgtgccactctgcctggctaattttttttttttttaaataaaaattgagatggggtctcactatgttgaccagactagtctctaactcctggcctcaaacaatcctcccatcttggcctcccaaagtgctaggattacgggcgtgagccatcatgcctggcctcctttgtgtcatttttgactgttcagttgctgagatttgcagataacctgaggcagggcttctctaacagctccaaagatgttgcttatgcaggaccacagacttgagtcatcagtaccttcagatggagattttgctagatttcagtgagaatttatttaccatgctaactccaggcagagtaaattagaaaaagaatccattatcaaatgtaatatttagacataattggcaccttacaaattgtattatctggtttcttgatgccttgtgcattggagatgagaatatatagtatcttctaaaatgtttacattttaaagcctactttttcctattatctttgcaacttggaggctaacatatgagtgaaaataattctcaggttgagttcttagttagttgttgctgctgttgttgttttgagatggagtctcaccctgtcgccaggctggagtgcagtggcacattcttggctcactgcaacctccgcctcccgggtagctgggattacaggcatgcatcaccatatctggctaatttttgtggttttagtagagacagggtttcaccttgttggccaggctggtctcgaactcctaacctcgtgatttgcccgcctgggcctcccaaagtgctgggattacaggcttgagccaccacacccagcccttacttactcagttttgtctgtagagttgtcccaaaaattatggagatgagccaggcatggtggctaacacctagcactttcgaagtttgaggtggaccgattgcttgagcccaggagttggagaccacactgggcaacatagggagaccctgtctctgtgaaaaataaaattagccacttgtggtgatacgtgcctgtggtcgtagctatttgggaggttgaggcaggaggattgcttgagcccaggaagtcaaggttgctatgatttatgagctctgatcacaccactgcactccaggctgggcaacagaacgagacctttactaaaaaaaaaaaaaaaaaaaaagctatggaagtgtaaggcagcttggtggttgcaaggggctgaaggagggaaagtaaggagtgactgcttaacgggtgtaggatttcctttttgggacaatgaagttttagaattagatagtggtattgattgtacaacatggtgaatacactagatggcactgaattgcaaactaaaatggtttaaaagttgaatgttattacttatattttaccagaatagaaaaaagtatgattctctaaacataagtgaagttagtgcccagacatatttgcaagtgaggggccttagtaactagtatagagaaagtagctgttctctgtggaagctatcacttgatactaatcactaggcaggtatagaatgtcctagagttgagcaagcctcaaaaactcacttcagtttagtcctcctgaatctcagtggaacagagctagaatagtttaaaagacatagaggcagctggtgggtgggccatgcctgtaatcccagcactttgggaggccaaggtgggtggatcacgaggtcaggagttcgagaccagcttggccaacatagtgaaaccccgtctctactaaaaatacaaaaaattagccaagtgtgtcagcgggtgcctgtaatcctagctacccaggaggctgagacaggagaatcgcttgaacccgggaggcggaggttgcagtgagctgagatcacgccactgcacaccagcacaggcgacagtgcgagactccgtctcaaatatcaaataaaaaagaggccagacttttacaataaaaaattcatggggttggcaacctacggaatgagagaaaacatttgccaatcatgtatctaaatatggggttaatatctagaatatatgaagaactcctacaagtcaacagaaaacctgaacaacccaattcaaaaatgggcaaaggactgcaatagacatttttccagagaagatgtacaaacagccaaaaagtacatgaagaaatgcctagcactgctaactattagggaaataaaaatcaaatccacagggctggacatggtggcttatgcctataatccctgcactttcggaaaagctgaggcaggaggatcacttgagttttgagaccaggctgggtctctcactatgtgtgagatcccatctcaattaaaaacttttttttggaaagcagagtaacacgtgttggcaaggatgtggagaatttggaacccttgtgcactgttggtcatgtaaaattgtgccaagtgccgtgaaaaaatatagcagttcctcaaaaaattaaacatagatttcccacataatccagcaatactctttctgagtatatacccaaaagagtctcagatatctgtataaacatgttcatacatgtattattcacagtagccagaaggtggaagcaaccctggtgtccataaaggatgatggataaagaaagcgtgttacatacacgtaatagaatattgcacagccttaaaaaggaagttctgacacaggccacaacatgaatgaaccttgaggacattatgctatgtgaaataaaacagtcacaaaaagacaaataccgtatgattctacttaaatgaggtacctggaatagtcacatttgtcacctgaaagtaggatggtggttgccagggttcgggtgaacggggagtttcagttttgcaagataacaagatttcagagttctgaatattggttgtacaatattttaaatgtatttaatttaggtgtactattgaaatgtacacctaaaatggttatgatggtaaattttgttacatgtattttaccacagtaagtaattaatgggttaaattaaaaattggttattttttactttgatattttatgaaactgttctgagatacagattgttttttgttttttgttttgtttttttttttttttttgagacggagtctcgctctgtagcccaggctggagtgcagtggtgtgatctcggctcactgcgacctccacctcccaggtcccggttcaagcaatgcttctgcctcagcctcccaagtagctgggattacaggaacgtgccaccatgcccagctcatttttgtatttttaatggagacaggatttcaccgtgttggccaggctggtcttgaacttctgacctcgtgatccacctgccttggcctcccaaagtgctggggttacaggcgtgagccactgcgcccagccgatacagattgttttttaggtgagtgacttctaaactcttgtttctttcttttttttttgagacggagtctccttctgtggcccaggctggagtacagtggcgccatctcagctcactgcaacctccacctccagggttcaagcagttctctgcctcagcctcccgagtagctgggattacaggtgcctgccaccacgcctggctaatttttgtatttttagtcgagacagggtttcaccatcttggctaggctggccttgaactcctgaccttgtgatccacccaccttggcctcccaaagtgctgggattacaggtgtgagccactgtgcccggcctttttttttattattattattattattttttattttttggagatggagtttcgctcttattgcccaggctggagtatagtggcacgatctcggctcactgcatcctctgcctcctgggttcaagcgattctcctgcccaagcctcctgagtagctgggattacaggtgcctgccaccacgccaagctaattgttttttttcttttgtatttttagtagagacagggtttcaccatgttggccaggctggtctcaaactcctgatctcaggtgatcacccgcctcggcctcccaaaatgctgaggcgtgagccactgcacctggcctgcatagcattattgatgtagtaaatgtcactgatggtaaatttcccgtgtatctcctctcaggtcacttgttcttttgcttcaccttgctgccacagccagcactggcagtactgaggagcaatactggcatcagaactggaggctccataactattttatttttacattaaaaactttttttttttttttttttaaagacagggtctcgctgtgtcactcaggctacagtgcggtagtgtgatcatagctcactgcagccttaaaacacctgggctcaagcagtcctcatgcctcagccttccaagtagcggggctaaaggcatgtggactacccagctccgtggactattttgttagaaacaaagagtttaggccgggcacagtggctcacgcctgtaatctgagcactttgggaggccaaggtgggtggatcacctgaggtcaggagtttgagaccagcctggccaacatggtgaaacctcgtctctactaaaaatacaaaaaattagccaggcatggtggtgggtgcctgtaatcccagctacttgggaggctgaggcaggagaatggcttgaacccaggaggcagaggttgcagtgagccaagatcgcaccactgcactccagcctgggcaacaagagcaaaactctgtctcaaaataaaaaaataacaatgctatgcagccatcatcactatctaattccagaccatttcattacaccaaaaggaaatgatgtattcattaaatagttgatagacttttaaagcttagttcaataatttttaagtagtgcataattccgatatttggagattgataggtaatagaagacaggtttattaaatccttcatagaattccataataataaaaattatatccataaaactgaaatccaaatattaaattgtgttttcgattttgaaaaggtaaaaaaaggcaaatgctagtgtatacagtgttctagttggaaatgattagaatgtgatatttaaaaggtgacacgttaatactttaattggcagttatacttctaggatatgatttttgctgatcatatctaggctaagattttatgtcatacaaacataagtgtttacagtcaaatcttgcaactctttattgagcagacagacattcagatcattttatgttgcgtaatgcagtgaatgtgtcagaaaacctccagtcttgttttcttttaaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccaggtaaacaaattattgttgttgtcatagtgggttttaatgtctaaatgaaattagaatatcagtgccttttgtcctgattatttgtgacatgccagttaacccatcttagtgtagagaaggggaatggaaatattataagccacttatatatcataaccacaataggcacctcatacaaggtcttcaagctggtacaagtgcttactggataaggagtattctttgtaagttcctttttatgtttgatctcctgatgatacattctacagtatctaatattcactttgaccagagcacagttactgtggaagtcatggtttatgtgctcattgacagcacatagctttccagacaagaaatcacacaggtttccctgttattaacaatctaacctccctgggagaatgacagagtaagtgactggtgtgaataacagaattttttaaagttcttttctaaggtatgacaactaatcaagttagattttgatgccagatgtaaggttgtttactttactggaccttggatattgagaaatggataaagctggataagtttacatctaggtagcttctgagcggtaaaaattagcttagttccttggggaatataaggaaagtcttcccagataagaaagttggcctgctgtcttttgttttgtttggagatggggtcttgctctgtcacccaggctggagtgcagtggcgcgatcttggctcactgcaacctccacctccgggattcaagcgattgtcctgcctcagcctcctgagtagctgggatttaggcgcccaccaccacgcctggctgattgttttgtatttttagtagagacagggtttcaccatgttgtccaggctggtcctgaactcctggcctcaggtgatccccccggcccccctgccgcctcggcctcccaaagtgctgagattacaggcgtgaaccactgcgcccagccagcctgccgtattttgaaagttgaccagggacttgccaagaagataaatacaggataagatactgaaattcatgctttgaggtcaagcagcctgacccatcctgtgaacaaaattagtaagacaaacctatcacctctaacacaaaaatcacttaagttgatgtcctagtgagatggtaacactaattcttgggatttatatggcgcttgagaacattgaattcttatttaccctaaggctaaagataagaatgtgtgtgtttgtttgacagatagtgattatagagcacaaatccatcatctgcccaggctataatgcggtgctgcatattcatacctgtattgaggaggtggaaataacagtgagtttaagataattggtttatttctgttttaatactgttttatcttcataatttctaatcagcaacagtgatgcacttttatttctacacctgttcttaaagattattttatttggcattattctgattttctcatactcttttcttggttaggccttaatctgcttggtagacaaaaaatcaggagaaaaaagtaagacccgaccccgttttgtcaaacaagatcaagtatgcattgctcgcttaaggacagcaggaaccatctgccttgagacctttaaagacttccctcagatgggtcgtttcaccttaagagatgagggtaagagcttttaaactgacgtctagtagtatatccaggatacctagctttggtcatcttcatcatctcagtacagtacacattgcaacaggttcacagaaaacttcgattcacattcttattcgtatgagtgttttatgagttgaatgtattgaacagaattgaccacgtgctttagtagtaatgccaaatctagtaatgctctacgtgaagaatcttaattttgatgttttgtgagtagtggatttggagggctattttgtttactaagatatttctatgatgtaatcctttgtaatatgtctagcgattaaaaggaacatagagattgatttttttttttacacctaatttttcagaggtctaatctttgtgaccttttgtgtgcatccatttctgcctacctctgggtgacgcagaacaactaacattcccatcttggggtcatgaagttctttggcataaaaacaaaatgattgttatgaaacgtttccttatgagcttttaatattcctgtccttttcctttccctttccctttccctttcctcttccctttcctttcctttttttgagatggagtctcgatctgtcacccaggctggagtgcagtggcaccatcttggctcactgcaagctccacctcccaggttcacgccattctcctgcctcagcctcccgagtagctgggactataggtgctgccaccatgcccggctaattttttgtatttttgtagagacggggtttcaccacgttagccaggatggtcttgatctcctgacctcgtgatccgcccgccttggcctcccaaagtgctgggattacaggcgtgagccaccgtgcccggcccagctgttaatatttctaacttagataaccattttaagactatagaagactttacataaaactttatagttccattgaaatacagaatagtcatttcacatgttcattccaattccatttagcaaaaactactttgtatctacaaagtgtcaggaactgtgctaagccctggtgatgaatacagttcctgaactttacattggatgaaattttataaagacagtgtttattttactttaaaggcccagaactcttctggttgatagtaaaactggttattgggtttatcttattaatataacaaaatgatagttttagtttaccactcagaacctgataaaatcaggaagacagaagaaaagcaattaatgtagcaggaattcttaaccctagaattattttttcctaaaagctaacttggctttaaaaaaaaaaaaaaaaaaaaaaaaaaaaaagctaacttggcttttaggttttccacaagacccaatgggttttgtatcctttcagtccacaggattactaccagaaggacgtgttcactgcactgtagtcagtggtgattgctgtgccttttcacagttacttaaggataggttttgggatttttttttttagcagctttattgagatacaatttccataatatgaaattgacctgttttaagtatgtaattcaatgaattttagtatgtttacagaattgtacaaccatcaccatatactaatattagaacatttagaacacctaaaaagaaaccttacacctgttcataatcaccccttattcccacctccaccccaggcaaccatttttcaatttgtcttttatagacactccataaatagaattataaattatgtggtcctttgtctagtttattttacttagtgtgattttgaggttcaaccatgtaacatgttatttattcctttgtatcactgaatagtactccactgggtggatattccacaaatacggatattccctttttttatttttaatccaaagaggttttttggcccagtgtggtggctcacccctgtaatcccagcactttgggaggccgaggcaggcggatcacctgaggccaagagttcaagaccagcctggccaacatggtgaaaccctgcctctactaaaaatataaaaattagaatgggcatggtggcaagcacctatactcccagctactcaggaggctgaggcaggagaatcacttgaacccagaaggaggaggttgcagtcagctgaagtcgcaccactgcactccagcctgggtgacagagtaagactctgtctttatgcagtggctcatgcctgtaatcccagcactttgggaggctgaggcgggtggatcacctgaggtcaggagttcgagaccagcctggccaacatggtgaaatcccgtctcaactaaaaatacaaaaattagctgggcgtggtggcaggcatctgtatctcagctactggggaggatgaggcaggagaattgtttggggggtacggggggagataggtttttgatacagggaaccatctctttaccagcccccccaaataagaccctcttattaagactacctaaatagaagtatcatgggtttggcagtaaagctagttaattagtaacttacattgtaaaaaatatttttgtgatttaaaataataagttttaatatcttatatagacttgctgttaactactgaaagatttttttaaaatttcatttctaggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggcaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaa

SEQ ID NO: 17030 - DNA, 139049 bp, Human
  misc_feature (1)...(139049): n = A,T,C or G
tgcaaaactactctgattaatctcttgggataggaaaagggttaaagtaattaaattataagggaggctgaatacttttatggcatctcttatctacagttagggttttcgtgttaaaagaactctagagatgaaatggctcaacctcctcaatttatagagaggaaacaaagaccctgggaatttaaatggcttcatcctgtggtaaccgagttgcaggagattatttccaattcttcctgttagggtttgctcttacatggacttgccccagggtacttatttatattaactgttccatctattccaaagcacttacatatctacaaagaatagagagcaagataaaggtcgtggttgagaatatcaacttttgggttagagaaacctgaattccagtcccttcttcaccacttaccagctgtgtgaccttgacagattgtttaaaatattggtcaagttacttagtctttctttgcctcagtttccttatctataaagaggggatggcaaactcctgtcatgctcaaaatagaaaaaacaagccctcacagatttattattaatgacaaatgagacaatgtatgtaaacaattatcaccagcgaggtgcattctaaacattagtaactattaactattatgatataaattagaagtgggagggaaagttgaagggaagagatagtcctatacttggctatatagtaggccacaaatttggctccaagctttcttacaggcaacatagagaaagaaacatgattgattacatagttccagggaacttagatatatgactttcatatgtctggccaaaccagaacctccctccttcgctcccattatttgaatttccaaacacagtctctttctcccagacataaaagtataggttttcgagactcattgagttataataagggctgtgtaagtttgcctgagactttcttagcatttcccatatagccacttagctttttgatagcacctgcaggagagacccagctaagtgtcttcccctgggcaaatttcattctcaagaagcctaagaccttggaggaggccaggggtgaactttgggttagatgcctcattttcctcacccatatcaggtgctccttaatcacaggggcctgccttattcaccttcacgttttcattcatctcatctcacatgtggtggatgctcagtgtttgtgatttgcagtaagaaaggaacatgtgccaaagagttactggtatgagcgtccttccattctagggcctggttttaacagattatttctacatcaggcaaaacagatgtttcatccaactctgatgacagtgtgcaaagcttgaatctcaatattttacatgaaaaataatatccatgtgaactcttctgccctgggtactgatgtgcaacgacttgtgttattaaatgtcagaatgaaatagaactggttttctttaaagaaaaagaaaggagggaagtataattctagcacctcagatgtctttcggaataggtatattaatcaatttcctttcaagacacatacgtcattatacctcacgtaaagtcatggccaaaatctcctttcttgaagaggtaatatacactttgcttgggatatcacctacagagaaaatgtagaaatattatgctatcataaaaatatttctaaatctatatatttcaatatgtgaaatactctaaattttctttaggaaatatttagagttgcttatttttcannnnnnnnnnnnnnnnnnnncttttttttttcttttttttttctcttgttttcaattaagcactctgttttaatttacaagttaggaatcctttaaatgttaaacaggaacgtaaactaaaaggttgttttggataactgaggctcacacagagcaggctgaattgtttccatatgctgtatctaagtctggattcaaattgtggaatagcattttatgttatcaaaatgctaagtctttgtaaccgttttcttctttcctagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaaggtaaagacggatgatctgagcggggaagaaaagagtttatctcggttggtcggaagaccacaaatttgaagtaaccagcaaatgattgattttccttgcagatgtaacaccgggctcagatcattttataagaggcttacttgttttaacacgtgattcttaaaagaatgcctgtaaaagacaagttatgctaatcatatattgcattaactttatttacttttttttttagtgtatatccctttctctgctatttataacactcaaggatttaaggagcctaatatacagacgtatctctccggctgtccaataaaagcacaagttctggaagtggaacgcttcacatctacaacaagggtcagagcgtttatggactcacccttttttcttttgtcaatatatgtgaattagtacatagcctttcattttcctccctcttagctatgatcatgtttgtaggtttttgtttgtttgtttttatgtatctatcatttccaagtcattttcacctgtcaagtttttgcctccttcccatttaatcttcattcttatattcctctttcttcatttgagccaaagctctttcttttaaaaaggcatgtaaggcaaattaacagtttaataaattgcaaagtgcctctcttaatcttcttctctccccagttttctgtttcatttggactcttgatgcatatttattccaccttgcatggcaggtataagtcaacaagaattttagctttcctaatgtttatttagcatgaaaatgttggtgctacctggctcttaagaaaaaaagccgggatactggatcggccagtgccattacctcaaaatactgttgagagaattctgcagccatactctgcctctctgattggttcctagaaaaccatcctttagtcctcattcacgtgatatttcactgaacgctgaaaaggctttggagtaaaatgtcttcaacaatcaaagttatgccctttgaaatggattggactagaagaagctgttagggtagctacttttctctgttcctggctggattttgcagttgttaagtctccgggggaggacaattgctgcagggtggtgacctttgtcccttcaggctaagatctagccatggcagagtaaggccaccactgcctcctgcctcaggggaagcacagattaataaccagctgtcagggcatgctttgccttcccttcctccttgtcttttggaggtggcatgcgctgcattgctttctgggtggttttgcctggtgctgtgtcccagcctacctgcacatgtactgactcccagcttacactcattttggtgtcagcctctggtttaggctttccctgtgactcgggtccatgtctccctgatacaccactgagcacaactccctcagaaatgtctctaagatgagctttgttttcttatttcacctgccagcatttagattgaaagataataacatgtgggggtaaatgacagactctagaggcagactgcatggtttaattcatctttgccttgtgatcttgaatgagtgacttaacctctctgttcctgtttcctcttctgaataaagggtataacagtgcttacattataggtttattacaaagatttagtaataataatacatatgtattatattatacaagtatacactgtatactcattactgcagtcactttttccacccacccctccttaacactggtggttccttagggtgggtgggtggtatagacaaggctggaccttggaatgtgtttcacaagagaaggagagaaggcatgtcgtgccatttctgaagaacaaaaacagccaagatggtgctgttagtatacaatacgtctcacccctgccaattgcctggtgcacggcttatatttgtggactggacccctgaaggctaattagggcctttctcattgtctcctccacctagttcttcatttcaggtgtgtgtgtgcgtggatgcatacacgcacatatgttggaggaacagcgtttgtaggaatcgtctcgtgtgattgaaagtttgtcttatgtaattcatcaagtgaacatttagagaatattatttctgcaattggctgcttttgaaacaaatttacttaagtacttacacaaaataagtaggctggacttaagtatacttctctgttactagttaaatattgttcactgaaagcttttggaatttttgttgttatctaaaatatcaaacatttttatgtatcactgtaggtaccaagtattaatctttacactattgaattaacacatggggaatttaaatggcaagttaagaggaaattcaagcattttcaagaatttcacagagagctgctcaagtacaaagcctttatccgcatccccattcccactagaaggtaaccattttggaattaattatgccagtatacaagttgaatggaaagtgtattttgtctgggtgtggtagctcacacctgtaatctcaccactttgggaggctgaggcaggaggatcagttgaggtcatgagtttgagactagcctgtgtaacgtagcaagacctcctccctataaaaaaattaaaaatttagctggacgtggtggcacgtggtgatagttagtagttctacctactcaggaggctacaacaggaggattgcttgagcccaagagtttaaaactgcagtgagcatgattgtaccactgcactccatcctgggtgacagagtacatccaatctttaaaataaataaataaaaagtgtatttaattcacaatatcggctaactagtctattgttggtagatattttcaattaaatagtctcttaaaaatatgccgtctcatgaaagacatactaaagtcatagtcacagaataatctagtaggtgtttgcattctgtgtgtttgtgttttagacacacgtttaggaggcaaaacgtcagagaggagcctcgagagatgcccagtttgccccgttcatctgaaaacatgataagagaagaacaattccttggtagaagagtaagtttcttcactattctgtggttttaaacctaattttgcagtgctgtagaaacacagcatctactgaggggtgaagtaggcctggctacaactcctctcatccactcattgatccccaggctggtttagcttttctggaactagttaggcagtcccttctttccccaagccatacagtgcattttctcagaagaggaagagcgttcttggttaggccttgacattatgaagaagctgttctccctgctagaatctccttgggcttattgtgagtcaaagattgaactcattgttgtgggttttgagatctactcttttaaaataatattttccatacataagtttccgtgtttgtaatagcccatcttaaatatatgtaaaatctcattcctaaactatagatggagcagttagggcctgagaagagtctgacggagtacagacaggcacagcactgggacagaaaactccagaggaggggcacttctgcctgctctgcttccaagatgggtgctgcagagtgtggacaattaattttttttactagaaaatgaacaagtgtttgttaatttctgtcagttctgttttgtaatctgaaatgtttatgttccagagggaatgtttgatttctcctttgtagttgtcatcttgtttaaaatctttgtaggcatctggaccaaatattttccaagatacctagacatataaaattatatagttttggtttactgtgtgcacatgtatgaattcaactgaaaatgacacttagtgattcagcaaaagcatgctggattttacatcatggtcaatatgattgacatatgttgctccagtgccccaagcctatatccctctactcccctgctgcctccacacacagtttagcatatttaaaatcagtacattctactagaaagtcttttaacctttctccacctttgtttcctgaaaagctgtttaaaatttgtagtgtatctttcagtaagttcagtgttagaattgaaaaaaaaatgaaagtttttggtaatatcaacaaatgctttaaaacaacttatagcaagtcctgctataatagctatatacatataatagggcttgtcagcagtttatagaagacctaagcatatggaaagttaaacagtaagaagatatttaaataatagttcaagagaaatatggaaataacaccttaatgctattcaggattccttgctccatgattatattaataaataattgaataacttgtagaagttaagatgaaaatgatgatctcatcattgtcactactgtttaatttttaaaaataaatatgaccatgttaacacttatctaaaatatttgcattacagaaacaactggaagattacttgacaaagatactaaaaatgcccatgtatagaaactatcatgccacagtaagtactagtcagtgatttaagtttggagtaattttcactatagtaaattgtcagctaaattttggatcattttaataacacaagtgattgtatccacacctacattcgtccttgcattaaaataaattaagtgaatacaaagttgattttacagcaaggatccagtttacagtggtgtgacgctgttttaaaaagttgagtagaacttaatatgtctataacaatagatttaaatgaacttgaaatcctgctataggctagattatctagaaatcaaccttcttctcttctcaggtttccaggataatgccaaaaagcattttttagctacaaagagtaactgttgagtagtaagtgatgaaaacagttgagtggagttgaatgcctgaagattttgtggtgcgtagggcgattgccatctgattggtttgtcatgcctgttaaaggcatgtcttttcatgtgaaagtgagaagcatgagaaaagctaggaaagaaaaaacccttgaggaatccaagtaaagaaagaagaggcgatggggcttagatgcagccacagagattaagcttggggtatgcagctggcaagcagggagggagtgggttttctagtgtcagcaaacaagtagctctgcactattaaaggtggggtgtttttaaaggtttagccttcaattattcagaggcctggataactgagaatgcatggtttatcgtatgtatgtatgcatttgtatgaattgtatggttatgggggctgtatgcatctatattatatatgtgcagaactctagagttggtgcaattgtgatttgtccgctagtttagagaatggcatcacataaacacataaactgaaacagtaaagactttagtgtattttggagaggatgcaagagcatttggctctgcgagtttctcatgacaggagctgccttcctgctgccttgcagcacatggtttggagtctggtccaaatatacatccagctgtcccattacacacaggtgacctggatccaggtcactacctgcctccagcagcagcttgcactggggcattcaatggacttgagggagcttctatgtcttcataaacctggagaagggttttctcaggaaaacaggaatttgggttgcaccagaggatctcaagagaaggatgatgggaggcaggggtttcttttcttctaggactcaggaacttgtattgttgaaataacaatgaataaggatactactactattgttaataaaaatgatacctcctgttgtgttgtctgaaatccgacatgctattttctttaacagacaactatttaaatgtgtattagtatccatatgcaataattttccatttcttttacttttctgcctgcctgtgactttacttttactatttcttttggctgtaaccattcttggtgagttcattcttctcttttcatgtacttttctacatttgggattctactgttgactaaagaatgtttagatttaaaaagtgttctttttaatgacttttccagtcataaaaatattttcaaagttaggccatgttgtatttagaaatcccagagtgacctgtaaacatttcctttggaagggaaagcctcattagcaactgactgtgaatagattctcctctcattttcttttttttttcttttttgggatggagtcttgctctgtttcccatggctggagtgcagtggcatgatctcggctcactgcaaccgccgcctcccgggttcaagtgattcccctgcctcagcctcccaagtagctgggactacaggtgggattacagcaaatttttgtatttttagtagagacgaggtttcaccatgttggccaggatgatttcgatcccttgaccttgtgatccgcccgcctctgcctcccaaagtgctgagattacaggcgtgagccaccgtgcccagcctccctctcattttcgatggttactgagattattctctccaacagctgaattgttcaatatgattcaagcataggatacaatttgatatacattaattctctaacattctttttctttaaatgtagtctggcctaaagactagatctgtagacctctgcctcatatttgtgaaatgagattggaatttacgtgttttcttcaataattgtgagaaatactaaaaaagtatctgttaaaaaatgctttactgtctgtaaaaagcatattaaaagttattttaacatgtatataataaatttatacttttataagtataaaacaaacctattttaagttaattcaggtccataagcagatagaatcatggatcataggtcaagggactgaataggatatgttcttaatctctatagggccatccagatctgtatttggaataagtgtgtttaacaaatagctcaagtgattcttatcatcaggagtttgagaactaaactaaaatgctatgatcagcttagaaatgtcttggtaaagttagaccactttaaaaagtggagacagggctgggcgcagtggctcatgcctgcaatcccagcatttctgggaggccaaggcaggtggataacctgaggtcaggagttcgagaccagcctggacaacatggtgaaacctcatctctactaaaaatacaaacattagctaggcgtggtggtgggcgcctttaatcccagctacttgggaggctgagacagaagaatcgcttgaacccgggaggcggaggttgcagcgagccacagttgcgccactgcactccagcctgggttatagaggaagactctgccaaaaaaaaaaaagtggagatagatttattataaaggtgtttgtataataggattttccccaaaggaatttggtttagggttctaagcactgacattatttttcttaagtagcctctgaaattagacatggacagttctttcctctcacttttatacagccattggttgggtttgtgctcagaccttctctcccatgattatgaagacttcctctgcttttaattctttttttttttttccttcttgtggttctgcaaaggagagcatcctagtgttttagtgtagtcatgatcagacagttgcctcagagaccattggtgatttgttcagttttctttgctcatttgtaaaatggggacaaatgtatttcctctttaccctaagcataaatatgtaaaaaaatagcaatatctgagttgtgtaataacatacaaaaaaatctcaaacaagaattccttttgtattctgaaattgtattagtgctggctgtagtagagaactcactagctaggcattttaattagtaactggaaaatgcttatcttccagggaattaaaatcagaggaataaggagcaataaatgtacctttttcatacctgagattaaaatctagaaatggaacaaattgtacaatttccaagagaagggccctaaggtgataggatcgtatctctaccttgaagtaaatcatttaacttatgtgactcagatttcttatccccaagaaggtgattagcttgaaatccttgggtaaaacatcccacagatcaataatactgagttcacctctcccttgttttgtagaatgaactttaacttgaggggaagagtaggtaaagaataaacgtgcacacagtgttttcattccaacagggaaaagctatactaatttgaacagctgcatcttcaaattaagggaaatattttctttcttatgattgagtcttagcgttgagaaggactttaggcctttgcccagcctcccagtttccttcatagattagatgtcctctttgttccctgcctttcctggagtacctgagtctacaaggacattgcccaactcaatgctcttaccttccttgtatctgataatttcccacctggccatttacttgagtttttgctacctggtaaataaaaggagcctctgaaagtcacccttctcttacaatacaaggatgggtggaaggggcagtgtgtacgtgattgccaagtaattttcaggattttttgttacccctagggcttgttgcttgtctcttggcatggaaatatttttgcttctctgtttctctaacgtttttagtatccaattggtagatcatgttggaattttttacttgagaccactttccacctagtgccaagaacattattgcattgcaacattatttcaattgtattcatattttacaaattcctttgccaaaaaaacaaagacaaaaaggtattgattatacattactcaaaagatcaatggaataagccctgcgaaatgccgttaggctaaattgatctttaaattcttattcctgagaatcacttgcccaaatggataatggaattcttatcactgaagatgtactaagaagtttggacaacatcatctttgttaaatttcaatttttattagttaggtttgcctctcagttgaccctgacacatttactttcaatttgataactctgtattagaaaaacgtttattgccagatttttttttctgtataataggcctggttccttctggaaatctctctccagtcaaactttactaagccattaggataaattaaatttcatattaatgtgtaactttcaattttctacattattaatgtgtctacttagctgagattctttacgcttagcaattttgttatgatatactccaaaagttatgatttctgaatgatttcagagaatatttctgttgtcaactatttgatgataacagctatgtaaataagaaaatatccaggcattagattagtggcttccttgatttttgttttcatttcctattcttcccttcggttgttctgggactttgcataagttagttatgcctctgtagtagactatagtcttcaaatgtaaactaggactgacattatttgtctgctctccagagataaaagttatgactcaggattttaaaatattttggattttatggctggcaatctgtgaatcatttccaataacccataggattaccttttccaattaagaagcattttcacaaaccagataaaaatgcatgatactgaatcactgttttatataagaaatgaaatgtaaagaccttgaggtgttttttgtttgtttgtttgtttttgagacagtcctgctgtgttgcccaggctggagtgcaggggcacgatctccgctcactgcaacctctgcctcccgggttcaagtgattctcctgcctcagcctctgcctcctgagtagctgggattacgggcatgcaccaccacacctggctaatttttgtatttttagtagagatggggttttgccatgttggccaggctggtcttgaactcttgacctcaagtgatccacccacctcagccttccaaaatgctgggattacaggcgtgagccactatgcctgactgagaccttgactttttaaattctcaatttaaaaaatgctgtatgaagatacctttgacttaggattttaaaaagatatttaagtccttttgaattttaaagacctattttctgcaaataaccccaagaaaagagaaaaatgcaagcatttaaatgaaccttacaaggatggacgccttgagatatttgtaatttttttttacaagagtagtgttagatatgtccaatcacatataaaacttacatggaaaacttttgttttactaatcccatttacaaacctagatcaaatgcccctgcctctgtgatgtcatgtcagctgggaagtggttgccctccactattctataactctgtaactactttcacatgtatctagtgtggttcatcccacagaacttcattgagggtagtgttttccatatctggtctcccgtctgcttcctaatgctgggagagtatctttttagtctttgttggtctatcaaggctgctattgacatggcctaaggaactgatcttattgttggtcacttttcaaaacgatctgcaaatctgcatatgctaaacattatgtaatgttgatttgtttttcccttctatgcctccacatttacatctagctttcacctacctagaatatgcaaggaactcaatttgaattagataaatgttgaatgacattttgctcttccagcttggttttgagggcgctgactttggtctgacttcataatgagttaaccatactgagttaatcccttcttaactatgtgatcttggacaacttacttgacttctctaaaacagaggcctgcaaactagggcccgtggaccaaatcctgcccattgcccattgcctgtttttgtatgttctgtgaactaagaatagtttttatatttttaagtggttgaaaaaaaatcaaaagaataatattttgtgacacataaaattagattatcttcatattttatatccataaataaggttttattggaacacagccacagttattcgtttatgtatgcgtctatggctatttccgtgctacaacagcagagcgaagtagatgcaaaatggaatgtatgcccacaaagcccaaaatatttactgtctggctctttgcagaaaatatttgcttacccttacactaaacctcagtttcgtcttctgtacaatgggaaaagtagcacctgcttcaaaggggtttgagataatgcatgaaaaatggttagcataacaccaactcatagttagcactcagtaaacacagccacagttgttgttataatatttacagtttttaaccttctaatacagtgaaggtgggcctaaaattctcttcctcttcaactcattaaaaataattcttttcattatgcctgatgttcaaagccctccccattctcttttcagcctgtttaattttttattcttttccttcatcttattcactgtaacccaactgtacatcctataacctttttgaccttctgttctagccccccattcatctcccatttcacactgtgggcccaaatccagtccatcttccagatcctgcaccaatatcacttgcttctcacattcttttattgtttgagtgtacactgtgccacacaatatccatcccgtgcaacaaaaacaaacatgaaagaatattgagaataaactctctctctctctctctccaagcttcttgagcattttatctctatgtattaaggcacacatctctctcttcagatttagaagatctagtaggatgtgtcttcattgtttatatactcctaatctgcactcttttagtgcaatgccattattattgatctgtgtagtctgtggagcacaccaaacagtatatacacacagctatacctaatacatgttttttaatgcataaatttgaattgttttgcttgctaaagatggattttttgcttcttttcagacagagtttcttgatataagccagctgtctttcatccatgatttgggaccaaagggcatgtaagttgcaataaaccttaaaagagaagtatgaaaaattgatttgcattcacacttaacgtagcagcatgccatggtgatggagtcctcctggctttactgctagcttctcttctccccagtagttagagcaactgatggaattattcatacaaatcagagcatctcctgtgataaacaacggtagcaactgctccactgtctttgtcacgtgcttacagcacagattctttctaacccaacagtggaagtgttcaatacctatagcaagtctgatgtgtaggagaatacattaaaaatcaaatatataagatctccttttacaatcccttataaagttaaatgtttactactcattttgatgattattttaaaataatactatgtaaaatatgttttatagccagatgaaagtttataattttccttcacaatattagagcttgaaaacataaagagcttaactttcaagttctagttaagagcattgttagtagttgtttcaaaaaaagttttttttaaagtttagcctttgttattgctttttcttgtcaaatttttcagaattaagatatactgttttcaaaactagtagctgtgctctgcttcctttggcatggctcaactagctcaactagtttgctagaactgggtgtgaagagacacagagatgtcctggaatctgtgggtgagatgcaccatggtctcaacagcaggtggaccatccctgtgcaggcatgtggaaatgcatggagtcttttttagtttgtcacagtgtcacaatgttgaggagggaacactcaacatttttttatatttatatatatttattatactttaagttctagggtacatgtgcacaacgtgcgggtttgttacatatgtatacatgtgccatgttggtgtgctgcacccattaatgacgagttaacgggaacactcaacatttagagccaggagacaggatgcttaaggtcctgtgtagtgcacaacagaatcacactgccccgaatgctgaaggggctatatctcaccagtgtattttagggttcgcctctagggtacccggcctaacagggcactgagctagttgagagcgaggaggagagagtagggaggaaagtcatgtgagaatgagatggtttatttagtcccatgttgggaggctgtacgagctaagtgggagtgggaaatttgaaggtgatgggttaattttctgtctctttcagagaaggtatgataatgaaaagatctggaggacacagaataccaggcttgaattgctgtggtcagggaagagcctgctacagatggtcaaaaaggtaggaattagtgagttttgtgtatttgtttgttttaatacactgggtatttgggctagttttacataccagttttaaattataaatcctttaaaagcaatggcagaacaaatttttaattatattttaaaatccaaattccagcatccatttaaatattctacccaaagctgaacttgtaggcaaagtgtacagattatattcatgaaaacccaaggacaaagaacgcacaaattggccagccaaagaagacgtacaaatggccaataagtatacgaaaagatgctcaacgttattagtcattatggaaatgtaagtcaaatccacaatgagatacaatttcacacccataaggatggctataatcaaagagatggacaataacaaatggtggtgagggtgtagagaaactagaatattttctgtagagaaaccgcagatattgttaatggaaatgtaaaatggtgcagccactttggaaaacagtctggcagttctttaaactgttaaacatagttaccacatgtcccagcaattccagggattcacctaggagaactgaaaaaatatgtctacaatagaacttttctatagcagtattataatagcagtattatggataatagccttacaagtggaaacaattctaatgttcatcaattgatgaatggataaacaaaatgtggtattcctatagagtggaatattatccagccataaaaggaataaatcacatcaagttaaaaagcttctgcacagcaaaggaaacagtcaacaaagtgaagagataaaccacagaatgggagaaaatacctacaaactacctatctgataagggattaacaaccagaaagaactctataggaaaaaaatctaataatctgatttaaaaatggacaaaagatctgaatatacgtttcttgaaagaaaacataccaatggcaaacaggtgtatgaaaaggtgctcaatatcattgatcatcagagaaatgcaaatgaaaactacaatgagatatcatctcaccccagttaaaatggcttttatcaaaaagacaggcaataacatactggtgaggatgtggagaaaagggaaccctcatacactgttgatgggaatgtaaattagtacgacgactacggagaacagtttggaggttcctcaaaaaactcaaaatagagctaccatatgatctagcagttccacgtctaggtatatacccaaaagaaggaaatcagtatatcaaagatatatctgcacttccatctgtgttgaagcactattcacaatagccaagatttggaagcaacccaggtgttcatcaacagatgaatggataaagaaaatgtacatacacatgatggggtactatccagccatagaaaagaatgagatcccgtcattgcaacatggatggatctagaggtcattatgtttagttaaataagccaggcacagaaagacaatcttcacatgttctcagttactagtaggagctaaaaattaaaacaactgaactcatggagattttatcagaggctgggaaaggcagtgtggagggggatagtggggatggttaatggatacaaacaaataggataattaagatctagtatttgatagcacaacaggtgactatagtcaatactaatttaattgtatgttttacaataactataaaagagtatgagttgtttgtaacataaaggataatgcttgaggtgatggataccccatttatcctgatgttattattacacattatatgcttgtatcaaagtatctcatataccccataaatatataaacctactatgtacccacagaaattaaaaatacattaaaaaaagagaaatgaagaccattcatggtcatggagtttctttatggggtgatgaaaatattctgaaataagacggtagtgccggttgcacaactctgtcaatatgctaaaaaccatcgcattgtgaacttttaaaaggtacgttttatgatatgtgaattacatctgaataaaaatctaaaaattaaatggaaaaggatatgaagttctgatacatgctacaatgtggatgaaccttgaaaacaggataaatgaaaacatccagatacaaaaaggcacatgttttatcattcttatttataagaaattttcagaatagacaaatctgtagagacggaagtagataaagggtttccagggaatgggaaggaggttgctttctactaatttgatactggtatggggtttatttttgggccaatgaagatattttggaactagatagtggtgatggttatacaactttgtgaatataccaaaaatcaaactgaactgtacactttaacaaaaacttaagtaaaattgtgcagacttcagggatgataattttacacttatatttctgaaaaatgtttatcatggtaagcgtaatatagacagaaaacattattttatatcttacgtcttaccaactaaaaactccttgaggaacaatattctcatctgattcttatctgtatcccccaagtttggcacataatagacagtaactgttgcaataacaatgtactgggattttgaaaaactattaaaacactgaagaaatcaattataaatattttatatctgtatataatatttcccccaaattgaaaatgataaatgtgtttatgtttaaatgtggaattgagctatgtgtatattcaaaatatataaaattaatactggcatccacctttacacacaccgatttaagatatactaccaacaaaaaaataccattaagctgggcctttactttctgggatttgaagggacagaagaaattacaaggaaaagatcaggaagattaaactaaagaaaactgaaaattttttgtaagggaaaaaagttttttttctttttttttttctgagatggagtcttgatctgtcgctgggagagaagttttactaaaataagaagggaaataatatactaaaaaaagtatttgccttcaaatacacttctctaacttttagaaacttggggattccttctgaccactcctccctagtcgttaactttgcccaaatcagctgctacatgccaaccacagttttcagactgtaaccttaagcatttgtgattctttgaccaaaaattctgtaggctgtcagaacccacctgtctgtgtgcacagcagtctgggaagtgtcaacagctcccaggagcagccatcagccaagaacgatcggagtccagccccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcagctgactagggaggtgaaagatctctacaatgagaattacaaaatactgctcaaagaaatgagaggtgacacaaacaaatggaaaatattccatgttcatggataggaagaaacaatatcattaaaatggccatactgcctaaagcaatctacagattcaatgctattcccaccaaactaccaataacattcttcacaaaactagaaaaaactattttaaaattcaaatggaaccaacaaagagcctgaatagccaaggcaatgccaagcaaaaagaacaaagctggagacatcatgttacgtgactccaaactacactacagggcaacagtaaccaatacagtacagtactggtacgaaaacagacacatagaccaatggaacagaattatagagcccagaaataatactgcacacctacaaccatctgatcttcaacaaagctgacaaaaacaagcaatgggaaaaggacttcctccttaataaatgatgctgggataactggctagccatgtgcagaagattgaaactggaccccttagaaacttaaatgtaaaacctaaaactataaaaaccctggaagacaacctaggaaataccattctggacattggaacgggcaaatatttaatgatgaagacaccaaaagtaattgcaacaaaatcaaaaattggcgaatggaatctaattaaactaaagagcttctgcacagcaaaagaaactatcaacagagtagacagacaacctacagaatgggagaaaatatttgcaagctgtgcttctgacaaagacctaatagccagtatctataaggaatttaaacaaatttacaagcaaaaaaacaaaaaattccattaaaaagtgggcaaaggacatgaacagacacttttcaaaagaagacatacatatggccaagaaacatttgaaaaaatgcttaacatcactgatcattagagaaatgcaaatcaaaaccacaatgagatatcatctcacaccagccagaatggctattaaaaaacaaacaaacaaataaacagatgctgacgaggtttcagagaaaaggaaatgcttatatgctgctggttggagcgtaaattagttcagccattgtggaaagcagtgtgatgattccccaaagaactaagaacagtattaccatttaacccagcaattccattattggatatatacccagaggactataaccattctactgtaaagactcagtgcatgtgtattttcactgcagcacaatttacaatagcaaagacatggaatcaacctaaatacccatctgtagtagactggatagtacatgtacaccacagcatatgaaatcatgtactttgcagcaacatggatggagctggaggccattgtccttagcaaactaacacaggaacaggaaacccaataccacctgttctcacttataactgggagctaaataacgagaactcatggacacaaagacggcaacaacagatactagggcctacttgagggtggggggtgggaggagggaaaggatcagaaaaaaatgcctgtcaggtactatgcttagtacctgggtgacaaagcaatctgtacaccaaacccctgtgacacaagtttccctatgtaacaaacctgtatgtgtacctctgaacccaaagtaaaagttaaaagaaaaaaatatatctattgacaaaaaagaaaaagggaagaaatcagaggagtttttatgaatggcataataaagaagagctttcaataaaagcccagcatcaaattaccttgatatctaatgactagtaaaaagaacaactacaagacacagatgaaaaaaaaactgaagaggatcagaagaattaatactgttaaaatgaccatactatccaaagcaatctacagattcagtgcaaccctatcaaaatactaatgacattttcacagaaatagaaaaaacaatcctaaaattcacataaaacaacaaaagaccctgaacagccaaagcaatcctgagcaaaaaacaaaaacaaaaaacaaaccaaagctagaggcattacactacctgacttcaaaatatattacaaagctatagtaaccaaaacagtatggtattggtataaaaacagacacatgaccagtagaacagaatagagaactcagatattaatccatgtatctacagcctactgatttttccgagggcatcaagaacattctttggggaaagtgcacactcttcagtaaacagtgctgggaaaacggggttaccctttgatatcatagccttggtattcgtattgaggagtgttataagaactcttataaaatgtataatttctgtgtttgctttgaaaattgttattgggaatattattcattatgttgttcagttgtatcatgttaggtcccaaatgagaaactttgtttggaatttagttttggaggaaatccacttatttctttaatttattcatttgacaagaaaaactaggaagcttacacccacatgagtgtgtcatctctgtaattatatttacctttgtggttaggtattttaggtatttactttctgtgaccttgacgtttttccttttctgaaccataccacatatgttctttgctataagttatcctaaatccactctatgcccttttattaggaaggagataacttatgtattaaaaaaaaattaatgaaatgaaactatgtggaaatcaatgtaggtctgtctacattaaattccaagttataaagccattaaaacataatgcaattcccaatttcagtaaagatttattatagatatattttaaatactgagttcccatgctatatttacagtattacttagtttatattcagatgttccaaccttactattccataatgtggaagtgcctagagtgctttactttgtctggtatgcactattatgcccactttgttacttctcagttttcaaatgattcagtctatcactctacaattgcaggcaaataggaatacatgttgttatatgcagcctgatgaagttaccatttgcattcactgtaaatggatcccatctcctcagtcttgcccttcctgtcgtacatcctgtgagtgctacctgccaatattagggacattcctccagttttgccattagtgtttaaagagctaatgaattactgtgaattacttggtacactgtttcttagaaaaacgtaatagaaaggttttgttgggttttttttgtttgtttcatagcgattaaaaaaaataaatctcctgtgtagaaaatgtaattatgtctacagtctgccagagtgattacttaagacttgtcataatgattagttcttctcgttttatttactcaatgcaacttttaaaaatacttactaccttcttacagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggtacacatttcaaatatttaaaaaagatttctacaaaaatgccttaaaaacatttttttctcaaccttaagtaaaaaaggagtttaaaaagtgttagaaaattgtaatttagagctcatcctcaatcaatagtaatgaaaccacttttttccttgtatatattttaaagagtatcctgtgtgcaacagtctgaataaacaatcccatatgtagatgtttgcctatgttaacagaaattactactcaatttgccagtttactaaacagatagattagagcaatagttcacatttttaaaataaatgaaacttttactttataaatcaatattctttaattaacaaaacaccaaaagagtgatttgttttataaaaattgttacacacatattttaagaaagatatcttctttttctctgagacaggctctcactctgtcacccagactggagtgcagtggtgcaatctctgctcactgcaaccttcactcactgaaactctatctttcaggttcaagcgattctcccacttcagcctcctgagtagctgggactacaggcgcctgccaccacccccgactaaagtttgtattttttgatagagacggggtttcaccatgtttgccaggctggtctcgaactcctgacctcaagtgatctgtctgcctcggccttccacagtgctgggataacaggcctgagccactccgcctggccaagaaagatatcttgaaaggacactcatgtacatttattatagattttattagtgagtacatgtgtatgtgatctttctggaagattgtagttataccatgtatgtgtgtctttatacatatatatccatttgtctctgtatagttcattcaccatcatgtatatgaatatatatgcatttctccctgtgcacatagttaccaacatagcttcatattcccttactgatttacatgtttgtgtgtgtatgtgtgtgtgtgtataaaaagatgctgaccttcctgatgatattctatgagaatggaacatttaagattgtgactggaaatataatggtgctgccattacaccttcctcctgcattcctgttttacagtgagccacagaagtctggccacagttctcactggtcccttactttattggccacttcatctgcatttcccaccctcacttacccgtatgtcattgccaaatgaggccattcacatccaggtttcattaccttccttcctggtgtaagatcccccccatgattttatcaaataaggccaaattcccccacttatttttgaagggcatttattttcctgcctttatttgaaattcctccctaatacgccttgcaggttctatgaaggcagcatttttttcttgcctctttccctttgcttttcttatgtccatgtttggaatagttcttgttttcccccttgatactgactcacatcctgtgataatgtcttatcttgttactcatctcttctgtaaagtcttctcataactgtttttccgaggctttttagctcaattggagtagtgcttgcaggataggtcaagcccaggcacctcctgtgccctctcgtctccatccctagaaacccgtgtctccaccacacgcgatggggatgcttcactcctctcagctccaccacgtctctcctcccctgtctccacagcccagcagcagcagcctctccctgtcttcatgactttcagacaaaagccagcatctacctctgacatattgaggaaagcaggttggacatggctaatctttataaataattcttttagaatctgtgaacacagcccccttccctgcgtctcatcaggatcattgcatttcctcaaaaaagcaacctccctcctcacgcatagtcttcttacattggtatgatggtagatttctgcctacatggcagggatacagctggctccaacactctgttttccttcaaacttcaaatttggataacttatttttccctcttagtagtaggcagaattctgacacttggcattaagaaaaaactttctgtaatccactctgaattttttttttttttttttttttttagcatttataactctgtaagagtttaggatagtttagttatgagtgacagaaaaatctaaagcaaactggcttataccaaagagaactaatcagccatgttgagcatgactgattcccttgtggtagcaagatggccacctcccacactcacaccaaattctgtggaagcaagagagtcccttcctggcattcctgagcaagtaagtcctcacatttgcttaggaatgcctgaaaggatactcatgtccatttgttaataggaatcgatgaacaaatgtacatgagtatccttttttttctggtatcaatatgtttaattgattattattgcaaaagaacagttttcctggccaggtgcggtggctcacgcctataatcccagcactttgggaggccgaggtgggcggatcacaaggtcaggagtttgagaccagcctggccaatattgtgaaaccctgtcgctactaaaaatacaaaaattagccaggcatgatggtgcgcgcctgtagtcccagctacttaggaggctgaggcaggagaatcgcttgaacccaggaggcggaagttggagtgagccgagattgagccactgcactccagcctggtgacaaagcaagactccatttcaaaaaaaaaaaaaaaaaaaaaaggctggcacagtggctcatgcctgtaatcccagcactttgggaggccgaggcaggccgatcccctgaggttgagagttcgagaccagcctaacatggagaaaccccgtctctactaaaaatacaaaattagccgggcgtggaggtgcaggcctgtaatcccagctacttgggaggctgaggcaggagaatcacttgaacccgggaggcggaggttgcagtgagccaagatagcgccattgcactccagcctgggcgacagagcgaaactccgtctcaaaaaaaaaaaaaaaaaaagaacagttttcctatgattagtgaaatagaaaactcacaatatagtcatgccagaaccaccttctggaaccagaaagatggaatatgccattttgcttagctttgttgaagagaagggatggctgtcatgaagcacaattgggatgatatttccagaagctgagggaatggatactagggagcacaaggggaagtgccctctagagcaggggtcgccaaccccctcggggtaccagtccgtgtcctgttcggaactgggccgcacagcaggaggtgagcagtgggcgagggagcattaccacctgagttccgccttctgtcagatcagccacagcatcagattctcacagaagctcgaaccctattgtggattgcacatgcgcgggatctcggctgcgcgctcctcacgagaatcatatcacttcctgatggcctgaggtggaacggtttcatctcgaaactactccccatcatccgtggaaaaattgccttccacaagcctgtccctggtaccaaaaaagttggggaccacgcctgtaatcccagaactttgggaggccgaggcgggcggatcacgaggtcaggagatcgagaccatcctggctaacacggtgaaaccccgtctctactaaaaatacaaaaaaattagccgggcgtggtggcgggtgcctgtagtcccagctactcgaggctgaggcaggagaatggcgtgaacccgggaggtggagcttgcagtgagcctagatcgcgccactgcactccagcctgggcgacagagcgagactccatctcaaaaaaaagaaaaaagaaaagttggggaccgctgctgtacgggagccaacagctctctaactaatacttaaaaatagaacctcaccttacccctctttctttatcctcctcatggcctagcacacagctctaggtctatggtaagtacctttatgcatgtttgcatgagtgaatgaataagtaacctgaacatttatttttgttatattgaatatatttttagaaatactaccaaaaaatgttaaatgcctgctttcttgatgttctttgcctcaaattttcagtttgtgtttggtatattaccaaataaaaaagagcatgagatagaacagagtgaccagtcttttcaatatttggctttttctttaaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtaagttattatttctctaagcctgtcaaggcagtcatagcatctaatattacactggcctaaattcacctggaatcagttttcaaaactgtgaaagattatgcattatacttaacaagggcttctctttttgtgataattatgggactacctgattatagattagtttttcaattgttgcttttaagatttttcacagtgagcttagctagctttagattttgaagtttgaattttaaagctaacttcatacatttctttaatgatgcaaatggaaggtttatttaagtcattacccctaatttaggaaaaagcatttacttgctagatatttcttttaaataaagtcatgcttagcatgtttttctacccgtggattggaagctagtttgttttcagtctcagaactgtatgtaagaaaaactgtatgtaagttcaacaggataggaaaattaatctggctccttatgatgatgaggctcaataaatttgttgttctctaagcagagaaaaatcaggctgcttacacttactgcccttcctaggcagcagaggaaacttggtattttcaatccttgttttccaggtccacaaagtcaatggtggttatgtgttatgtggagactctaggcagtggcttccatgttttgctttaccataagataagtttcttttcttttcttttttaataacaaaaaggaacaataaacttgtctttcaggtatgttaatgccaaaggatattttgaagatgtggcaaatgcaatggaagaggcaaatgaagagatttttatcacagactggtggttagtatttgtccctgggaatttttttctggaagtctctatgtttagaaatgtacagtggtatagtgctgttcaagaattacacattatgaaaatcagctgtatctgtggatggtttggccagggtctcaaccagttgactaagccttcagtgaaaggccttttcaaaaaccttggcctcaacaatattcataaaatacttagtttgaacaattaggttttatatttgcatttggaagcagacttccaagttttcatgtcagtaaagattatactgtaatgcaagtacagttatagaggtaatggtgtctttggatgtctttttctaattttggtatgtctgtcatgagggccagtgaatatacttcttctaaattgtccttttgatgttgaaatagttccacttgcctgttaccgtaaaaatatcctctgtaatgactaggcctggtcagctgttctagagatacatccggtttcaactttgtgaccaccttaaaaaaatatccataagagttgctatgcttattaaagtcaccagaagcctcatatcggaaactcatttaactcttgggaaatttactcctgtagttggtgtaggcattctagtctgacttcagttccaatcattcatctgcctggaaagttaaaacccattacacatgccaacactggctacgatggatatggaaatgtctaaaatgtgttttccttctaggaacttagtagtagttgcctgaattaccccttattttactctatccggttttcttccaaaaggtaccttataggaactgttaatatatcatcataatttattcccttctaattctaggttttgtgggcaatatcaatatctaattcaagaatgcaaacacatcttttgcttcggttgtctggaatctataattataaggcatgctttcttaacctttgccctgttgacatttggggctagataattctttgttgtagggggctgtcctatgcattgtagggtgtttagcggcatccactaggtaccagtagtaagttcccagttgtgaccaccataatatcttcatacattgctagatgttccctggttggggttgggagaggatgcaagatccttgtcggctgggaatcactgatctagaggggatagacagggtatgtggtggccagcatgctcatgcttgtggaggagcttaattctggtctttctattgttaccaaattttgtcttttcagtcagttactaggaggaaaaaatgtttcatgcttaggagctatttctttggttgaatattttatgaacacttgtgataataaatttgtgccagtgagtactatattctttaaaaaatatttctgaaagtttggtgaagatgtgagagagactaaaaataatttttctattgagcctagattttcatgctttatgtctgaacaccaaaatttttttaacttttaaattcaggggtacaactgcaggtttgttaaataggtaaacttgtagcatgggaatttgttgtatggattattttatcacccaggtattaagtcttgtacccactagttatttttcctgatcctctccctctaccttctgaaaggccctagtgtgtgttgttcccttgtatgtgtccatgtgttctcatcatttagctcccacttataagtgagaacatgtagtattcggttttttgttcctgtgttagttttctaaggataatggcctccagctccatccatgttgctgcaaaggacatgatctcattcttttttatggctgcatagtattctgtggtgtatatgtaccacattttcttcatccagtctaccattgatggtcatttaggttgattcaattaaacatataaagagatggaactctgaatgttttcctctctactttcagcaagagaatgaatcggggttacttatttttcacgactgcactaggataccattttattacaacacatcattagaaataaaaccttcacagtaacttccctcaaacaagtaaagaaaattcttgttgtacaagcatattgcaaaaaggagcattcagaaacttaaccaaacactagtatgcgtagatctgagagagtggggttatctaccagtctctgtatggagtcagtatgttaaatgtgtcagaaatagaattaataaaacaggagaatacaaaagaaaaacaatgaacagagatttttaaaagagggtgtttgtaaagggtagagaaacagaagagacaaaggttgggccggagacaaaggttataaagaaaataaatcagcattgcattactaactgactcacaaacaaagactattccaggtaaaagaatacatgttttaaaagtatttaagttggttttaaatgcaacattctttaagttggttttaatattgttagtgtttttcaaatgatgggttgagcctctttagtaattgtgtattaaaataatttggtaagttgtgaccagcatttaaaaaaaaaaagaatggcataggataggaaagggaagggaaaagaaagaaagggtacaatgtaagtggtaataagggctactaattttggaaacttttatatcagttgtagatagatagatagatagatagatagatagatagatagatagatagactgactgacccggtgttggtttgggtgtataatgtatttctttctgcagcttatggtccaaaagtttaaaagttttaaagccactgactttcaaaaatggttagtaacctttttctttaaagagcaagagagtaaatttgttttaggcttttcaaatcatgtatggtctctgaagcatattttttttacaactctttaaaaatataaaaaccattcttagctcacaggccatactaaaacagtctatgggcaacatttggcttgtgagctatagtttgttgacacctatcttagaagatagatttaatttaccacattttatcaatactaagagctaaatgtagtgttttccaaagttgtaccattttacattttcaccagcaatgtatgagagtttcaattcttccacataattgctagcacttgatgttgtcagtctttatttcaaagggtatacagtagtgttttattatgattttagcttgtatcagcaacatcgtttcatgttgagcaaattttcatgtgctatttggacattggtttaactgttcaaatcttttcccttttttttgagagggagattgtgttagtcttcttatttagttgtaggaggtatttgtacattctagttaaagtgattgttccatttcattctggcctccatgatttctgttgagaaattttccatctcttgaagacattgttcccctctaagtaatgtgttatttttcctctgagtggtttcaatattttccttctgtctttagttttcagcagtttggttatgatgtttgggtttatcctgtttggggttctctgagcttcctgaatctgtagttttatatcttttgctaaatttaagaaattgttagccattatttctttacacattttttctgaactttcctctttctctcctccttctgagtcttcagtgacacaaatagtatcttatttatttgccttcaaattcattgactctttccgctatgacagggtccccaacctccaagccaaactggtccccagcctgttaggaaccaggccatgcaacaggaggtgagccagagcttgtcgggggaggtagcgagcatgagcattactgcctgagctccgcctcctgtcagatcagccgtggcattagattctcgtgggaacatgaaccctattgtgaactacgcatgtgaggaatctaggctgcccgctccttatgagagtctaactggtgcctgctggcctatctgaggtgcaacagtttcatccagaaattatccttacccccagctcccacccatggaaaaaattgtcttccatgaatccggtttctggtgccaaaaaggttggggactgctgctctatgatctccattctggtattgagcctatcctgtgaggtttggggaatttattgtttgcttttgtttttctagtgtttttggtaatagtgtttttcactttgaaaatttttatttggttcttctttatatctttttctataagacttttttgtcttttcattcattttaagagtgttcacccttattagagcatttttataatatctgacatagccttaagtagataatttcaatatccatgtcgtcttggtattgacatctgctgattcccttttctgtacaagataaggtttttttttttttttttttcctggttctttgtgtgccaggtacttttaatgtattctagaacattttattattatgttataagactcttgagtcttgtttgaatcctgtggagaatgttagtatttttgttttagcaggcaatttaccaatttcagttcaggcttaaagttccaaccagccttttatgagtgttgttttaatgccggttttgttgttaatgcctttgtggtgctattcagatctgccccatatgtgtgccacctagtggcccttctgggacttcggtggtggtctattcctcagttcagttctcagcctctttggagtgatgtttaggatgaaatccatgcataggcagcttgggaatgagccaggaaatcagaaacaactttatggagctgcttttctgagctcctctccccaatttttagtttcccatggcttccctttttagtcttctagccagaaagatgggtttttatttactgtgctctgcaatgtgctttctctgatggcacccatgtccagagccaagccaggtgtatttacatctccattggagaggagatttcccctgcctcagaggttttagtaactttgggctttccactgcaaccctgtcactaccagagatcctttgctttctccccaagcctgaactagaggatttttgaagttctctctgtgccaatgcctgtttccaagttttccctccaagtcaaggaatcaaagggagaaaaatgttaaacttaccactggttaggtggtacttctttttctatattgaggcttccacttatttagctcttatgtaatttttctcagcaatattttgtatttttctatgtataggtctttacatattttgttaaattttttactgagtactttatgttttttgatattattgtaaattatattttaaaattcattttccatacagaactagaaatgcaattgatttttgtgtatttaccttatagcttgtgaccttgctaaattaatttattagtgctggtagcttttttgtagattgcttagggttgtcctatagatgattatgtgatctacgaataaagacagttttacttcttctgttctaatctgtatgctttatattttattttcttgccttgttgcattggctagtatcaccagtaaaatgttgaatgaaagtggtgagaatgccttgtttctaatcttaagaggaaagcatgcagttttgttatgttatgtgtgatgttagagatagatttttttataggtaccctttattacactacggaagtttttttctatttctaatttgttgggagtatttattgttaatggatattgaatttcatcatttcttctgcatttgttgaataataacgtttttctcctttttgttgttactgtggtgaattgcactgattgatttccaacttttaaaccaaccttatatcttaggataatcccacttgatcatgatgtagtattatttttctaagttgctgtgtttttggtaaatatttttacttctgtgatcataagggatgttctttagttttcttgcattgtctttatttggttttagtatcaggataatgctgacctcattaaataagatagtaagtgttcctcctttgtttactgaaagaatttaggtagtactagcatcatttctttcttaaatatttgataaaattcaaatatttaataaattctgtaaatgtttaataaattctgtaaagttggcaaagtctgtagttttccctgtaggaaagttttaattacaaattcagtttttcaatagctatgaagtcagtttcaatttctttttattttcattatgaaaatattttattcaaggaatatgtttattttatttaaattaccacaaatattggcatacagttatttttaatagttattattcatttaatataattataatgcctctaggccctatagtgattacctgtctttcactccttttttttttttgagacagggtcttcctttgttgcccaggctgaagtgcactgacatgatcgtggctcactgcagcttcaaccttctaggttcaagcaatcctcctacctcagccccccgagtagctggaactacagacatgagccaccatgtctggctaattttttaaattttttcgtagagacagggtcttgctatgttgcccaagctggtctcaaactcctgggcttatgcaatcctcccattttagcctcccaaagtgctgggtttatacatgtgagcccatcctttcaatcatttttttgtcatttatttttagccttgctagaagttcacaaattttattgatatttcaaagagtcaacatctagtttcattgaattttctctgtattttttcaggtttgtatttcatcaagttctactcttatatttattattcccccatcttcttactttgggtttaatgtcttctttttctatcttttaagaaaggaaagtctgatcattaatttttaattttttgtctttctcatgtaagcatttaaagtcattaaatcttctaagtggtacacttacttagaggtacgtcttaatatctccgcaatcaggatgcatcttatgctcttacagttatagttgtcatgatgttttctttcttagtggtacatgcagtaacgatgcatcctacagtcactggtgtcctagatccaatgaaatgtaatattaaacaataactttgtttacaagtaagtaaagattcttacataataatgcttggtaagttatagctgctttcttcttgccatgcagccatggtttatacttttatagcatgatataacaaaatctttttttctttttatgcattatcctcaaaattgagggctcctcaagagctatcttaagattcttcaaagtatcttgtagaatgcttagcatacaagggtacacatgtttgtggattaaatgaaataaatgatgataaatacttaattgcagagtatgacattaaaagtctcccccataccgaagctctttgagcccatatttaatgtacacatcaaaaaattgcaattgtatatatgttgttggctatctctcacttttggtgaactagcagtgcacagcaatgcattttactattttaaaacagatttccttttaatgcttctttgatcttttctgatcaattgctgtgctttatttgtttgtttgcttgtttggacatagattacctttgagtttgtttcctactctcaattaaatatgcaagacttacactgtccaaactcttccatttgtctgtttccttatttattttacccaataacgtttcctttagaaactttatctctgggtttttattttctttaactgaatgaaatagagcataaaattgatttcttttaatctctttagctccttaaagcactgttgatttcacatgcttagagggctgcctgggagggcaatactccagtgcagaattccataaggctttcatcctgacatagtctacctctgctgcctcaggtctagcagttcagtggagaaaggagtattttctactgcttcttttttctaactacagggaagttacatcatgtacatgtttaactcagaaactaactttagaacccagccccaggggaaaaatgactctattgtactcttagctgccttgtgaagcttagcttaccttagctgccttatgccttactgaaggagaagagcctaggaaaaatttcatatatcagccgaccttccttctcccctgtccagaaagccccaggttccctcagatgctgcttctttgtataggaagtcatgtgtctgtgtatctattagaatgcttttagtttggggtaacagaatgttcaactaaagagggcttaaacactgaggatgtatttttcacatttaatgttaagtctaaagttgggcaatcctgaggttggcagagtgatttagtgattctggggttatggtcttccccttagaatttcaatattgctgcacccctgtaagcatcatactcccatacaacatccatcccaaagctggaagtgtgggcagggctttctctgagagagagggagagagagcaaaagagagggagggagagagagcgaaagagagggagagggagagagagagagagagtgtgtgtgtgtgtgtgtgtttgtgtgtgtgtttcagggaggaaaaactttcccattaagcccctgtgtacctcctcatatatctcattgttcaggattgtgtcacgttgtgctctagctgcacaggagtctgggaaagcaagtatctagaatattcagtctgtggtgggagagaggctctgagagcagggaagaagttggagattggctgtgggtgggcaaccaacagtacctgtgtgcatatgtgagcatgtgggtatgagagacagttaaagaggggggagagagagagagagagagaaagaactaagattgatgttttgtatagctaaaggctatttttcccatacgaagttgttcctagactcatagtaaagctttggattacccatcacaatggaggatgataatggggttgaattgggctgaaattgcctttgcttcctatgacacaatcagaactttatattttgttttagttacttaaaatcttggtttcattgtttcaggctgagtccagaaatcttcctgaaacgcccagtggttgagggaaatcgttggaggttggactgcattcttaaacgaaaagcagtatgtactttcccagaaaatgctgatataattttttaactgtctgttgtctctgaaatgcttttcttttcaaagcctttcacacgtataacttttcactttagagtttgacaaaaagtaggataactaatgttttccagttcatttggttctattttattcctattgcttttgagtgcataaatattttagactaattcacagcatggattatgttagcatctctaattcttatttttgaatcagttatgggcagctaattttataggcaaaaaaattataataaaatttcatcattgaataataaatgatgaaatggagcatagcatttaattgtattcattattttgtcatttaagcaaaaggaaaactcatctggagaatggtttcagctagatggggctaatgtggtgtagaataatattaaagggggaggaatagtcacagttggtggtgttttttctctggttttggtaaagttcctggtaaaaatgtgaaactgtttcctgtggagttgaccctgtacattctgggtgaacattgaatgtgtgctttttaggtataaaaagtaaataactgaagcagcctaggctcactaatgactgcattcatatttctagtgatttttttaatgtaataggcccttaaaattaaatcagtttaaattaaaaatagatctgggatttattatttagcatgtccaaattaggaagtgctaactttttgctattatcagaaactgtcttaaccttttttttttttttttttgagatggggttttgttcttgttgcccaggctggagtgcaatggtgcagtctcggctcactgcaacctctgcctcccagctttaagcaattctcctgcctcagcctcccaaatagctgggattacaagtgcccaccaccatgcctggcttttttttttttttttttgtatttttgtatttttagtagagacggggtttcaccacattggccaggctggtcttgaactcctgacctcaggtgatctgcccacctcggcttcccaaagtgctgggattacaggcttgagccaccgctcccggccaacctttttttattctgtcattaaacatgctagcagaacgtgtggagcctaaataattggggttagcatttttctgtttctcatagctttcactcatttcttctttcctatcctctgcattccactttttatttccccattcactttccccttttctttctgtatcttttccccatgcatttacttgagtatttctggggatatccacaaatatagtcagacctcactgctaatattgaaagcaaaagaaattgataatatttatttgaaacacattctgccaaacaacatcattttgatggatagtctagtttgtttcatcaatagaattccagttacagaattggacattttgattctgaaaacattattcacatatttattaaataattcatcatacggttactgtctcctatgagccagcttctacggtaatcactaagaatgccaccatgaatcagatttgaaccttgccagtggcgaacttgctgagggactcatgtcttgggctcagtcctagccttaccagactactttctacctattgaatgggcagtaactttctctatgtttctctcaatgaaatggcatcttttccattttccctcaagattctattttagtacatttttccagccttgcgtagcaatctgtactaatactagtaaatttttgcttataatatttaatcagcacctcactgttttaggtttcaatcaatatgtatttattgaatgttttctatgtgcagggcatttggctaatcatatgaggatgtacataaataaaagccatgattcttaagttgaaggagcttataaaatctgcagaagtgtcagttgcatgcagaaacaatgccccgatttaatggcaagagggaaagcattgggctttcccaatggaaaaggtccagttggggagctccacacaacatgaaggatgtggggcatttaggatggacaaacatttttaaaagggaaagaagaactttctaggtgtagtagatgtaaacagcagtgccaaagactttgtcaggcacggtagggtggttcatcacatctgagtgttagcatagccggatgggggattaagctggaactgctagttgcagctgggatgcagaggctttgtgagccaagctagtggtttgactttatgggagacagtggggcagtactgtgcggggcagggcggtgtggggaagcaggggtggtctgatcaaaataatgtgtcggaccccgtctctactaaaaatacaaaacaattagccgggcatggtggcgggcgcctatagtcccagctacccgggaggctgaggcaggagaatggcgtgaacccgggaggcggagcttgcagtgagtcgagattgtgccactgcactccagcctgggcaacagagcaagactctgtttcaaaaaaaaaaaaaaaaaaaaaaaaaggtgtccggaaggtgactctgatagtggaagaaactgggaagagctgattcagaaagctaaagtttagatcacttgaagatacagtgtctacaagacatctaagttaacttgagaaagctagtaaatgcctcggtagggctcaggaggaagatcctgcaggcctggcttccacctcttgtttgctggcatgcgcttgtttactgcccttggcatacctgtctggttaccttttctgtgtctagtgtgacttctctttacttttttggcccttgaaccctggcgaggtccctcgtgaacaccatggccaaataaacgttattgcctgataacagtgcttcatttccatttcatccacttcttggagctggtaatttttaaactgtgggtagcgatatttaaaatttcctaaagaaatagtaatacaattaaagattgatttcttggtggtacatttagcggagttgctcttccttaatctcattccaccatattattactttgttcataaattttttaacactcggatcactccaaattgacattttatatgcacataaatatggcttcacataaataatttagtttctgaaagccacacactagctttgcaaagtatgaggttgaaacataatatttgttttttgcattaacaggtcccagaggtccacaaggtttattaaaatgaatgttttattttcttctatctgattgtgcagatattctgagaggaatttaggaactgtctctgccttatagccaacgtatggcaaacatctcttatgatggctgtttcttaagaaaaaatagaatattttatgtatctgattaataaccaagttgaacttctcctatttctttggccttctgatctgcaatgccatcatttaaaataataaaagccaatcttcagaggcagactgttcacaactcaaagaaatcagcatctcagggctttccacagttctgcacttgctatgctaagaggtgagataagctgcatcatacttatggcagccaaatccccacacgcaattttgtgtatctcaaccttagaagcttgtgatatttcctatgaaacttagactaatgggagaatttgtcttcaggttgattttctgtcctggatcacaaggcacaatgtagagttgcagtcagtgaccaataaaagggaaagttgtccagaactgagaaatgacaggaataatcacatctctacacagaaaatcaaatgagtcttatcaaagtggtgggcaacagtggcttgcagggaaggtatcttcagcttcaaaaatgtgcttcaaacaaaattggattttaaaaaaaggcacatgagcttttgtgctcttatatcccaatgctgcctgcttttaaacggtgaggaagtgatttctttatatcctttactttacatctttacattttcttaatatattgtattggggaagtccttggcaagtgacaaaaacattagtgagcatcctgggttgggggggtggggtgggctaaactgtcttcaggcagtggacaaacttggctgcatttagaaaatattttcactatgctcccttgagcaatcggaggaaaagttggctaagaaacaaagtcactgatttccactataaaaattttcttttcattgtcttcccatgtagtttgaatatctaaagctcctaaagatttctactgtttatagtgttatgtctgctctacttgacaaaaaactaattagaaaagaggacagaactttcatcttttaaaagtcatgttttatgaaatttattctatggaaactttgggtcagctgagttcaccagagataagaaacactgcattgcataggcaactccaggccatctgtttttctacttctcctattaataatttccgtccctttctttaagcaaaaagtaatttccccaagggtatttaaaggcactaggcactaaagcatgggatgttttgaaagtgtattttttaaattgcagaattaacatcatcaggtttttttttcctttggctttcattttgcagaaatatttcccacattttgtataagcctacactataacaacctggaaaatgccttcatccccaaggaatgattcattcgcctttgccctttatggctagagtttataatagtcaataccttgaccaaaagaagaagaatgcattgctttattatcacaggaatcttgtcactaattaactgtttattgtggctataggtgtaggtaaataattataaaccacatacaaatgaactttctatctttaattgcttcctcattggtcatttgtctttaagctaaaaagacaaagtctctaccctatttcctttagaattatttcaatgagaaaagacagtatagaagaaatgtcaggtattaataaatggagagtagtaatgtattccattagtgttaatatctctattatttcaaaaatccattagttatgcaggtgagtagaaaactgtaggattcaggccaagttcctaatttgcaactactactcttcatgagtaataatgtcttaagcctaagaagcagaatttcatctgcttaaaataaatgggtcatgatgaagaatgtcaggtgtaatgttctactatttaggttgaaattttgggttttaccctttgtattatatcttttagtgaaaggcttttttttttttgtaaccattattcagtgctgaattctaaaatattcaaataccaaaaatagaactgaacagtagaggagaaaaataaaataatattgtaattttcctttagagcccttcatcagtggttaattacagagcactctctggccagaccattaaaattaatctgttcactttctgcctatgcttttacttctttactgaaatatgtatttatattcttgattgtaatagtacttgcataattataataaataattagcaagtactaaaagccagctgttaaccagagaaatagtatgacatatatattcttcttgatcctgctttttttagagcaagaatgagtcttctcctagtactcaaatcttgttaatgcacaccagaatgtaaatctagtgtgcacctccagaaatacatacacctttaagatattactaacaccatgaaaaatagagtgttagtattttgaagtgttgtgttattataaggaatttagggtccaaaacgtgctttttagtattggcagaacaatattacagaaatgtttatgtgtttggtttgctctaagattttgtatcttgtgatgtgatctagaatctaaaaacattaactcctatgttatgttagatcgtatagcattacaaaaagttttagttcttgtaaagtaggtgtgttcaacccagtaagatatcttaaagatttttattcaaatttcccttataaacaatgactaatcaccatggaatcttaatataaactgtaacaaaattattttttattatggtttattaaatacacctgcatctgtaatattctagaaagtattatggaaaatttttacctttaatctctacgatattaaatgccaggtgtcatttagatacataatccagtatatatgcaaaatgtttcagaatgctttcagagctgctgggtgcaaacaatgcaaattaaaatggtgcaaactatacaaaaataaggaggattcaagcctaaaaagtaaaaaaagcaatccacaaggtgggggtgaataagccacagtttcctggaggtaatacattctgaactatacattggagggggatccatgagtgggcaagcagaaggagaggagcattccagtaaggggcagtttagcctagcctgaaagcctgtcaccaaccagaactagaatggaaaataccagtgtttttctatactattagctattggacctggtcttttggtttttgtttaaatctttttttcagatgagatgggtaatgtgcagacgtcgtaagaaggttcgagtgtggcacatctcacgcttgtgtgtgaacacacaatcatcatgctcatgaactacaaaaggattggacattgtctttttgattattaatattgttaaataattgtattatttgtatagcatgttagcatctacaaggcacttttgatttaatttgactcgattaaataggccacggtgaccttgtctattttcttttagatccaaggtctaaggaaggatgaatcaattgaatttgggtgtccattttatactaaagttttcaatgttttggatctttaatcagttattgattctttcttgatatgaccagttgtaagaatggaagggagatagatttttatttttaatatttgtgtctcaatatacgcacttatgtgtcacttccttgtattgcctttttcattaaaattttatcttacttgtttataaaagaagttagaaagtacagtgcaggccaggtgcagtggctcatgcctgtaatcccagcactttgagcggctgaggcgggtggatcacttgaggtcaggaatttgagaccagcctggccaacatggcgaaatcctgtctctactagaaatacaaaaattaactgggcgtggtggcatgcgactgtaatcccagctactcaggaggctgaggcatgagaattgcttgaacccgagaggtggaggttgcagtgagccgagattgcgccactgcactccaggctgggtgacagagtgagactctgaaaaaaaaaagaaagaaagtacagtgcaaaggaaaaagaaaatgaattgtaacttccctccagagatactcattcctccatcggttttctcctgtgacagcaacaaggagtgaggatcttcataatgctctacaaagaggtggaactcgctcttggcatcaatagtgaatacaccaagaggactttgatgcgtctacatcccaacataaaggtattcaggttcatcttgataaccaatgtttctttattattctataggattttttcaggtatgttttgttctgggcagtaataatctatagaatgcccaaatgtatatttgatcaaatagcattgtgtcctcagaaataaagcaaaatactgtactttcttatcttccctacattgatgggggtaagcagatctcacatttctgcttctctgactctgataattgaaagtgagagtttagacaagaacatgtttcctgcagttgttttgatattcacgagctctatcaagttctcacacttctcattatcctggaacctcttagatgtgatctccctgtgacatcccctgatcactgatagcagcaaagagatctcctctaggatttaaaatgccttaaaaaatcaatggcacctagtataaaatactaataaagtaaataaacatgaaaagcaatttgaaaaagttctttgatattttgccaatatctaaaacctatcaataaatataacccagtcattgaggtacatcaagacataatgaattaacaaacctccagcaggcttaaaatatgtaacaattgtatgtttcacttggttagaaaaaatgaaagtgttttctcccaaagaatgatttattaggttgcgtaatttatatatattatttattcattcaccaaatttctatcaagtacccactaaagatgtaattttgcaacaccaacaactgtgagggaagagctgttaaaggagcagagatttgtatgttactgaagttaaactggtataaatacaaattagaatgttacaactttaagatgttacatttaactgcaaagaaaatagcaatcaaatatatagctatttaacaaaaagaaatgagaaaggaatttaaacatgtcactacaaaaaatcaaccaaacaaaacaagacagtaatgcaggaaatgagagacaaaaaagctataagacatgtagtagaaaatagtagcaaaattacagaagtatcttacaaataattactttaaatgtaaatgtattgacccctctaatcaaaaaacagagattggtagactggattttaagaaaccatgatccaactatatggtatctacaagagactcactctagctgcaaagacacaaataggttgaaaatgaaaggatggaaagggtatttcacacaaatagtaaccaaaaaagagcaagagtggctaaactagtatcagacaaaatagactttaaatcaaaacatgcttacaagagacaaagaaggacattatatattaataaaaggttcaatacagcaagatataaaaattatacatatttatgtacctaataacagataatcgaaatatatgattgaaaggagaaaaagacagtctatgataatagttggagacttcaacatctcactctcagtaatggttagagcaaccagacagaagataagtaagaaaacagaggacttgaacgtacagtaaaccaactggatccaatgggcatacagaacattctacccaacaacagcaggatacacattcttctcaagtgcacttggggcattttccaggaccatctgttaggctgctaagtaagtcctaatagattttaaaaggtagatatacaaacatctgtctgaccacaagataatgttagaaattaataacagaaggacaactagaaagttcacaaatttgtggaaattaaataacacactgttaaacaagcaatgataaaacaaaaattcacaagggaaagagaaaatacttagagacaaatgaaaatgaaacaacataccaaaattatgggacacagagaaagcagtgcaaagggggaaatttacagctatacttgcaagaagaagaaagatctcaaaataacaacctaactttacagtttgaggaactagaaaaagaagaacaaactcaacctaaaactaccagaaggaaggaaataaagattggagcagtgggaaataaaaccagaggatagaaaaataatacagaaaatcaatgaaaccaagttggttttttgaaaagataaaatcaacaaacctttagcttggtgggctaagaaaaaaaaagactcaagttactaaaatcagaaatgaaagtagagacattactaccaattctacagaaataaaaatgattctaagatattactgtaagcaattcgataacctagaggaaatgtacaagttcctagaaataagaaaactaccaagactaaatcatgaagaaatagaaaacctaaatagacctttaactggtaaggagattgatcagtaattaaaaatctcccccagatgaaaagccagggacctggtgaattctaccaaacatttaatgaggaattaccaccaatctttctcaatctttttcaaaaattgaggagaagagaagactctctaactcattaccctgataccactgaattgtacacttaaaaatggttaagatggtaaattttatgttatgcttactttactacaatttttaaaaaatgtgttattaagaaaacagtaaggccaggtatggtggctcatgcatgtagtcccagcgctttgggaagctgaagtgggagggtggctggaagccaggagttcaaaaccagcattagcaacatagcaagacacccatatctacaaaaaacaaaaagattagccaggcatggtggtacacgcctatagtcccagctactcaggaggctgaggcagaaggatcgtttgagctcaggaattcaaggctgcagtgagctatgatcacgtgtctacactccagcctcagtgagagtgagtctctgagaaagaaagaaaggaaggaaggaaggaaggaaggagggaaggaaggaaaagaggaaagtagttgccaaagcttttgtaatctttttacctaaaggtaaatgaaaataagataggtcagactgggataattttgaaagcaagaggttactaacttctcaaggtaccttttaaataaagagctgccaaaatatctatatgcctatattcatatgcttaatatttcaattcaatgactgataaaatatcaatataattcattacacatttttccagagataaatagtagttaaatatttttagctttttttttagtaccagatttaacataatccttacagggggaagggaaccagctttcaaattgagctgactgttttctaatgtattgccagacctcaagctaaatggcggctgccccaaaatatagtatatgggcgtgggagcttgaagagtaaataggagtcttttttttttctttttctttttgctaaatgctgagaataaaattattttctttggtgtatacgttgtacagtttggtatttgaattatagaaaatgcttttcagggagaacacagacctatttcattatgacaggaaggacatttcaaaagcatattatcagtggggattattccctctcaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccagtaagtatatttaacctttatggaaatgtataacacgaacataatttgtataagtttgtattagtagcatgactgattgattcattgaataagagatggtgtctccttggaggggaaaagaacattttaagtcaatcatgagacagacctggtttcaaacaccagcttccccacctagctagctgtaacttagcattgctgagtctgttcttctcttgtaagaaaagaaaacagattcagtggaattttggctgtcccatattcagctttgttttccattttaattaagatttattttttattcagaaataagattcataaacaaaaatatgtggcaattgagatttaggtagtaaaaagccttaagtatctgccacagtttttggaaagttcctacttaaagatatacaaaaacaggataggtcagtctggggtcatttagagggaatttgagccagaagtgaataacttcccaaagtgccttttaaatagagctgccaaaatatctgtatgtgtatatcaatctgcttgctatttcaactaaatggctgccagaatatgaatacacttattaaaaaaagtgtatatcaatctgcttgctatttcaactaaatggctgccagaatatgaatacacttattaaaaaatttgatgggcttcatcttatttactgctggaaaatagtgcaaaacttatgcaaaaatagcaatttagtgcataaggaacagggaaaatgattgacagaggaagccttgcttacttaatgtttattagaggaacaagttcaggagctcaacactgaatgtaacccatgtaattgtatttgagattaaaagtttaattggagtgaaatttcaagaatttggcctactgaaaaaagaccatagcagaactcctcatattcctttggtagtttttaaacagttcacaagaatccaccactaccctgtggctgacctcagacattattgcatgtctgttatagaacctccatcatttgtaaactttatacttcagctctacttgaattaaagaaccacactgcagcatgtcttatgcagtgtctttttttaaaaaaaaatttttctcagcctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagtaagtcatggccttgactagaatttatcttaactacccactgttcttccatagccagacactacatacctgtttttaaaatctgtctttctgtaatggagtagaatgagcaatgttgagaggtcgctatatcattctattcaacctcatgccatttggtggctttgtttgcctcattttagaacagatttattgttttatccacacaaaagtcataacgaccacgattaccacttctaatggtagcagaatgacaaagggtttctaaaatatgccaagccataaaagaaaaaggtattagatgtactttataaacttttcttagaagaaattacatttatcttcctatccagaaatatatcaagcttatttcgtcaaacatcagactttctacatcttgtaaatttactattcctttgaaatccatcttaaagccctacaattttctgttgcacagaatcttaagactgatgttatagccctgcctggttttaaaaatgatcagctttgctttccagtttagaaaatttgatatttgtatttttttgtaaaaaaattcttaatttctctaggttattttaatcactatagaagtcatcacaatttaatccatggtttaaaaccccacttcaaactctttcacccgtccagtgagtctgagcaaggactcactagacctcatgctggtaagtaatttgtgaagtggcagaactcccttaggcttgagctttggttgtgttgtctgctgcatgggcatagtgaatgtgtttccagattggctttctgtttgcaatttttatgctacgtatattattgagagcctgctctgtgcaaagcattctgtagtatccaagatccctactccctaagaacttatagcagcaaagacaaaacagacctaataagagaaaatgcatggcacatgcaattcaatagtgtcatggaagttctatggaaggagggaggaattcctctctgatgatgcagaaagactttttgaggaggggacatttgggttaggcctggaagtaatttaattggggtaggtgataggaagtcattgcaagtgagggaggtgagttgagcaaaggtgctggaatgggaaagcaccaactgctttcaaattgtgtaaaatgcattatttagctaaaatgcagtttttgatataagactaagaagatatatgacattcacatttgggagctggaattttatttggttaaaaatctttttttttttttttttttgagatagagtcttgctctgtcacccaggctgcagtgcagtagggccatcttggctcactgcaccctccgcctcccaggttttagcgattctcctgcctcagctcagcctcctgagtagctgggattataggcgtgcatgaccgtgcctggctaatttttgtacttttagtagaaatggggttttgccatgttggccaggcttgtgttgaacccctgacctcaagtgatccgtctgccttggcctccgaaagtgctgggattacaggtgtgagccaccgctcctggccagttaaaaatcttgaaggcctttgggtggatgtgtcatgctgtgtgaattttcagaaattacaatctgatagcctttggtaagaagatactccagatactcgaggaattaatgaatgactaataagtttaacttgtggtgggaataaagaaggatttggccgctggtcagatatggggataagtaatcatcataataaatgacactagtaagatcataagctaacatttattttgcacagactctatccatcactgccctgagtagttgcagtgcttggtagtgatattgtcatctcctttttacagatgaagaaactcagggttagagatgatacatgacctgcccaatggagttccaatttatcatcctcccagtgcccataattaagacctgtgatttagcagaaataaagattactatgttatgcttttttggctagaacctaaggccagggctctcatgtcctgtttagcagatgagagttacagtctagctcacatgcctgaatgtgagtcacctgtggcttgcaggtgctaatgaacctgaaaaattatgctagactttgagtaatgattcccagcattctttcatctagggcaggggtgtccaatcttttggcttccgtggaccacattggaagaagaattgtcttgggccacacataaaatatactaacactaatgatagctgatgagctaaaaaaagttgcaaaaaaaaattacaatgtttaagaaagtttgtgaattcgtgttgggccacattcaaagccatcccgggccgcatgtggcccacaggctgtgggttggacaagcttggtccagctacgctgcattttaaaaaatgcaataatcaactacacacaatgaactaaaacttcagtgtaactgttaaataaatttgtgtctataaatcataacagcatcgatatatatttaagaatggagaagaggccaggtgcagtgactcacacctgtaatcccagcaatttgggaggctgaagcaggaggattgcttgagcccaggaattcaagaccatcttcggcaacgcagtgaaaccccctctctacaaaaattagctgagtgtggtggcatgcatctgttgtcccagcttttctggcagctgaggtgggagaattgctggagcctggaaggcagaggttgcagtgagctgagatcatgccactgcagtccagcctgggtgacagagggagaccctctctcacacacacaaaaacaatttttaaatttttgaaaaataaaaatggagaagaacaaatatggggagacatatatttatttagcatacacctagtactgggtgtatgtgtggattcagggacaactcccagtaattcctgtgcatgacaaagcttcaaagtcctgggaagtaggaggcctctgggaaatctaggaagccaggtcaagagtgcatgcagtggccgatattagaggtaaagggttggaaacagctccaggtagtgccttatcgtttcaatgtgtaactttgctgctttattactgaagttaaaaatgaagtggaggaaaggaggttgccaacccatgaagattatggatctgaattatgactgatagtgttgctggcaataggattgacagcaagtggaaaagatgtgagtgaggtgctgagtccagtaagtaactcacgcctaccccaggttgacagaggtgatatccacagtggtgatctgagacactgatcatacatgtgtatggtgttgctgatgaaaagtacccttgacatctgtttacaacccctcactgataaactgaatatatgtctagtgtagcattgttgagagacagagagagagatagagagagagaacaacctaaacgtcaaagagtagggaaatggtgaagaacataatgaatggtaacaaatggttcatctcttttatggaattgggcaatgattacaactgtagttggggatacaaaaataaacatagaagatttatttatttaattaaataagtgtttattgagtttctgttatatgccaatcactattctgggtgctagagatgtggtgaataaaacagatgaagtgcaattaactagttggagggtaaggatgggaactgtgtatacaaatagagagtcaaacacatttcaggtggtgataattatcacggagaatagttgagcatgatccgggaggaagagcataggagaagagttactattttgtaaaggctcatcggagaatacatctctcatgaggttagttttcagctgacatcgaaagaaagagaagaatgaggataagaaactgagagagggtgtttccgacagaaggaatagcaagtatgaaaggccatgaggtagaggggttgggtgtgttccaggaatacggctgtagtgaagtgggctaggagaggatgataagaacaaaatcagagaggtgggctggggtgggttatgtgaggtcttgcagaccactgtaagattttgaccctgagtgagataggaagtcatcggatggtcttgagcgaagggtaggcgagggctgacttacattttccaaggatcattcttcagagcagaccagggtggcaaatggtgactctgcaggttgtgaatatattttgagggtcgagctgacagcatttgccgatgaactagatacaagatgtgagagatggagaggactccaaatctttggccccactggaaagatggaatttccatgaactgaaatgaggtggctatgggaagagcaaggaaaatttgaggacaattgccactgtatcaaaatatgttcgtgaaggcagctgacaaaggacattcaatgatgctatctttgttaggaagatggagcgtgaggtgatttatttttttcccacattgttggtactgttttcattttacttttatagtcaaatataaatacaaatttaattttttaaaatgaaaacagtttacctaaaaagaaaagccaaaggatcatggggtccttctagagcagtgctttccaaagtcgattccttggatcctggagtttttaaaaggctttgaggagaacattgaagtaggtgaaccccaggaccctcccacagctattggtacctcttcaaccagaacaatcccacttgtatctgttttaattattggagttccttctgaacttgttttcaaaaaagaaaagttctactaaaaaaatgaaggaagtttaaagagcaaggctctagatttaaatcatgtaataccttaaaaactcaggttgccttataaaacttgaaacccaaattaagcatggagtgactcttcgttagaaatttaaaactgaatatgaacttgagttaatgacttccttttcctgagaatgcaaagagagttagcctctctgcaatatcaatttcacttgaccgcatatgaccatgttgaattgggctccttgttgaattaaacctcctggtgtcatacagaaatcagtgtggagtgaacatcactatgggtttttatatagaaaaactgcactaaaaacgtggttaggaatcatatctgaaatatatgtttttcaaaatcactcagtcattttcaagattttttttcattcagaattatgttctaagagggagaattttgcttgatactatttttaaagtgttgaattttattccctttctttctttctttctttctttttctttctttctttctttctttctttctttctttctttctttctttctttctttctttctttttctttctgtattatactttaagttctgggatacacgtgcagaacatgcaggtttgttacataggtatacaagtgccacagtggtttgctgcacccatcaacctgtcatctacattaagtgtttctcctaatgctattcagcaactatgtgctgatcttttccttttaagcaatattaaataggtaagtgagggaaaaattatttttgcaatttagttgagacaggcttttcaaatttgaatgtctcgtcacaagggataatattaagctgtttctaaactgttcttaggaatgcaatggataggatgtgtaagattcatctagtgctgttaaatagcttgttatctaataggtgagcatgagttttaaatattttacaaacctaatattttagtaattcattgagggaagatactcctactgcaagagtcatcattgatccacagacgaaatacaggtctacaaacccttaaccacgattctaaattccaaaaaattttgaaaaccaaaatattttttaaaatataacttgttcagtgcctgtattggaactggccttgaacatatgtagaaattcggtaggtagagactaaaaaggtagaaaaacaggcattttaggtagatactacatcttaagacccagatataggaaatgcaaaagtatttatttcggcatctcagactgagtgtagaatgtggtaaatacatataggtctataatctctcatacaaaatccttggaatcagatttcagaaatcagaaagttctggattttagaaaggtaatacaatacctataccctctactatattacactcccagcaggatccaggaaatacctggaatgtaggcaaaccatttatgtttgtgcaacaccaagtgggatcaataaagataataaataacctcttgtcagttcaggtcagattttgctgacctgtgagttatgaaatgagctgtgaaaatcagctatgaaaaaacatttgaattgttagaacttttggagttttggaattgtggttaagggctgatttgtgcagattgagctggtgggatatatctgtagcagtttacggaggactttgaaaatcagactgagacattgcacctcttccattaaatgttggaaaatccctaggggcagggagcaattaagggtgaggctttatagcgtttatagtagagacacagggagtctgacaaggttgtgtcagtgagttcaagaacgaagtaaatgggagaaactttttccaaaagcagaatcagcagattttcatcatgatctgggaagccgtggggaggtgggtggagaagtcagcgaagaataaaggagccaaaggtgattccgaggtttgagcttgagttactacacacagacagcagaaatctcaaggaaagacttgattttatggaatgatgatgattttagtgttagacataattttaaagttctggagggaactaggtaaacaatgtcaagtgaggcactggaagtgaccttagatttggagtccaaaacagaagccatccttgcaggtgcacattttagaaattgtatagaaaaagacaggagaggccgggtgtggtggctcacgcctgtaatcccagcactttgggaggccgaggcaggcagatcacgaggtcaggagttcgagatgagcctggccaacatggtgaaaccctgtctctactatcaaatacaaaaattagcagggcatggtggtgtgcgcctgtaatcccagctactcgggaggctgaggcaggagaattgcttgaacacttggccctgggaggcagaggttgcagtgagccgagatcgtgccactgcactccagtctcaaaaaaaaaaaaaaaaaaaaaaaaaagaggaagaaaaagaaaacaaaaagacaggagaaagggggaaaccttgttagtgaggaggagctaggaaagaagaacaaggataggctggagaaatggtagaaaaatggagacctggaagccgagagatgagaatagaaggaggaggatgtggcacgaccagaggacaccaggcaaggaacaagaagtcccccttctcataaactttagtagccagaatctgagccactgacagaggaggatgcagaaaattggcctgacaaatctgtgccaaaagacaaggcaggtgcaattatgaaatcatttgggagccagatagcagcctaacgagacccccttggatcagcattgttgatgccataagtcctctcgaccacactcatgtaattctgagctactgttttcacaggaactagtatttggctctattgccttaatagttcatttgtactgaggaggaaccctaatttatgtggaatagtttttaggccatggctaaaaacaaaaacaaatttgaattatgagcaggttgaattcaattagtaccaagataatttcctgagactaagaatttcctttattttccttatcataactggttgttaggtgaaagataatttttaaatgagtgtatatgtgtttatgtaaagccttagcttagagttttgcagttgatgaaagcaaattgtatatgtgtattttatatttgaaatttgaaatattgtttatctcatttttcatcccttttgtttcttttctcaccctcttttcttcttttaacaaagtgctatgtaaacaataaagagcctatagatgagcaaacagacctacccgtactttggcctttcagtctcataaagcaggaaaataaatcactgggagaagtcaatagaagtctatttttaacatgatttcattttgctaatctatggcattttaaatcatttttcttctgtagaaaactttaatagcctttgaaaggttaatgattcagtttgagatagaatattagcattgtgtgtggtgattacataaaaacatttgttctgcaaatatttattgattgcctgggtgcttggagctactggcagtgagaagatttggttcccactcccaaagagtttatagactggtgaggcattgatgcgggcaggggagcatcctgatacaattgcgtcacagagtcagaggtgttggggcagttgttagtgggatgacagcagtgctagtgactgcctcttccttatggggagatggcaggtgatagctaatgtggctcttgaaggatgattaggatatcaggccaagagggagaaaggagcatttcaggtagaagtaataatgtgccaactgcatggagacatggcagtccacacctgttataatacagtgaaacacgtgatttgcatggggcctggggttgggtggggaaaaacaaggactagaaagatagattggcaccagtttgggaagagtcttctatgcacactaagcccttaggacttgagcttcctataggcagtatgtgaaccttccagggttttaagcaaagagtgcattttacaaagacagttctgggacagtgtgttggtggcaggaccagtgtagtcctctcactggctactgcaagcagtaccatttattcattcaacacatatttttgcattcagtgtctatttgttaaatgcctcttttgtgccaagtgctgcgtttgtgatttgtaattctgcatctttttacttcattgtctttgtatttagccgtaagtcaatggtctcggcacagttatttgtgaaatgctatagtagattgctgcttttgcacctatatcataagctttcatctgttgttaccatattttttataaatgccatctatgatttgaagtatataaatgttaaagcgcaacagattttagctgttatctaggccaaattcttcattttacgcataatggatttatgatctaaaaaactgaagctcagtgtcacttagctaattaattccagggctggaacatgggctatctgtaaatttgaggttcttgctttaatgcaaaagaattatgcatcaggtgtgcaccatgttggttgaggaaaaagaagtggcatggtgtctttattgcccctgcgtctcaggtttctccacctctcccctccccgcccttcccactctgcccctgaaagccccccaccagctttactgctctcatagtgccaccttgtgagttctttattcacagttaattctgtgatagttcttccagtgatctggtaggtggtggaaataagttactcaactgcctgagaaggtcaaatttcattgtttaatgatgaatcttgttgtagccctaactgcccactaaaagtaaacttgtaaggactgtaaaaccttgttagcccacagcctgtaatagaatggacagatgccaccctagttgtgtcttaagaaattaagaagcttttaggtgtttaataaatgagagttgagcctccctttctgggactcacctgaaccacagtctctgagggggtcttgctgcattcacagataccgggtccatccgtagtttacagacaggtgtgggagagctgcatggggaaaccagattctggcatggaaaggactactgcaatttcgtcttcaaagactgggttcaacttgataaaccttttgctggtgagtatcataatggtggggtgctggttatattttgtcttttacctttgaacatctcagcaagtatacatgtgcatgatctaaatgccttttgttttgcttccgttgatttttgaaaattttttaaaactttggagactagatttagtcattagcatgtgcttaaggacttttttttcagttataataagaaaagaacatgaaatagagctgaactgtctgaaaaatccagatttttataggcatattttgggggcaataatcagtaatttttcaggaaatggtaggctccctttgatcatcttctattctgcttatttcctgcatttccagcgttagaatggcatattttcaggttatcactgggtttatatgtttaagaggagatagagatggcattgcctgccattgtttcaacaggataaaaaataaaaaatataatatcaaatacacagccttagataatttgtaccaactcacatcttgccatgtctagtgattatctaatcctaagtgaaacggaaacatatgtggggaagtgcctgggagactatgtccctgaatgtgaaatctgtttcccttgattataaaaatgttgttctatgcaagccaagaaatatatacctagtgggcactaacccacgtttccttttagtttcatagttggagtcagagagactttgccccaacactgaagttaatgactgatccttgcctggtgcacccgggcagatttcattgacaggtactccacgccccggatgccctggcatgacattgcctctgcagtccacgggaaggcggctcgtgatgtggcacgtcacttcatccagcgctggaacttcacaaaagtacttggatgttgctatcatgatttatccacatgaagagaggcaggcctaactagagaagaggtttagaggaggctggtagcaagaagagactgttgtggccacaactgtgtcactgctctgctgttggctgcattgatgtccgggtgcctgggcatctgggcaaaaaaaaagggaaacattcccgaatgtccacaccatagacaattcagagtgcctagggacaggtgctgctgtgtgggtcctgattttaaccttgttaacatcttggacacagtgttgactaagcatttagtagcctgggctcggtagtcatttgcagggctgttatagggggataggagcctggtttagatgagagggcttgagctttaaagtcccatccagttggatgggactggaattgcactgggtttatattggtacaggattctgagagctggttctgagcaaaccaagaagtattaagaaggtggggccattttccttttatccagattgtgtcctcattacttgtaagaacttgacataacattcaaacctaacattcataagttaagtacgtatcattcaggccaggcacggtggcccacgactgtaatcctggcactttgggaggcctaggctggtggatcacctgaggtcaggagttcgagaccagcctgaccaacatggtgaaaacctgtctctactaaaatacaaaaattagctgggcatggtggtgggtgcctgtaatctcaactgctctggaggctgaggcaggaaaatcacttgaatccaggaggcggagtttgcagtgagctgagaggactccattgtactccagcctaggcaacagagcgagactctgtctcaaaaaaaaaaaaaaaaagtacatattcaggtgttattaaagtttcactttatttacttgaagggataatgagtcatgattccccttggtcatttggaaaaagaatttagttttatcaaccacttagagtctaactttgtttttcattcacataatgattataaaaatttagtggacattctaattgaaattttttaacaaaaatttaggggagatggatgaataaacaaatggggtgttacttttaacctgctatactggcaaagataaaagtctctgctgatacctgtagttaggtttggggtggtttttgtggtgtgctcatacatgctaccccagggaggataaatttgtacaacaccaataagtcttttttaaagtatgcaatctttgatccagaaaaactatttccgggtattcaaactaaagccataatccaataaggtaatttattttgatatggcttctaataattcaaataaaattagaaataacagaaatccttactaataggaatttattaaacaaatgattcttttataccattttactatgaagttattaaaaataatgatatcccactatattgctgtgacaagatatctagaacataatcagtaaaaaattagtttataaaacaatagtctcatttttgcaattataaagttctgtaactacagattatatttaacctgtctttacaaatataaaacaatatttcccctacaaaaggtaaaaacaggactgtgagaagtagaaaacaaacacaaataatctgtagcccttcacttagaaatgtccaccattaacatttttctttttctttttcaaattaacctgaatttcttttcttttctttttcttttttttttttttttttttgagatggagattcactcttgtcacccaggctgtagtgcaatgatgaaatctcgactcactgcaacctctgcctccgaggttcaagtgattctcctgcctcagcctcccgagtagctgggattacaggcgcccgccaccatgcttggctaatttttgtatttttagtagagatgggggtttcaccgtgttggccaggctgatctcgaactcctgacctcaagtgatccccgcttcttggcctcccaaagtgctgggattacaggcgtgagccactgcacctgggcatgaatttcttttataatcacaaagtagggagaatgaatcttttttctcatttgaatattttatcctttttctttattttagattatgaaatcaaaatatcggtccctttcttatccttttctgcttccaaagtctcaaacaacagcccatgagttgagatatcaagtgcctgggtctgtccatgctaacgtacaggtaagtaagttctggcttttctttttgacaaaatgctactgagtaaaattactgttattggaccaagggcctattacattggcttcagatttttcaatgactgcttttctaaagcaaaactaaatggatcttttaatacttgttattatatttcctatgttaaatggattcaattcagtctctttttaaaactcttataaatataataaatgcatgtccttagaaaaggccacagccaaggctattcctgtaattccttctgaagtgaccctagcaacatgatacccagtaaacctggacctgatactgcctaagcaccaggaatgtggctgaaacttagcagctaggaagctagttgtagttcagtctaattttagttcctgattaaccaaatgtcttctagaggcccttttaatggaataaggaatttgcttaatagagtcacaacagtttaccacatccagtttaaccatctcaaactacaaataagaaaattcagacctagtggggctctgaggcctatctagggccggccagctagttatcaacagaggtggagcttgaaatcctagtctggtccagtgttacccaatctgcttcctttaccaactacagctcaaatatcttgagatcatgtggggacagaagtaggatgggccacctttggcattgccttttgtttgaagtcatcaatatgggcatcagaagaattgtttaagtaaagtccagcagtctgctactgctacatatcatcagtagggaccatcagtagggacttatataatgcagacatggatcctagggaatgtgattatataaatgaagtgcctaaatcagttattttgcatcgtgtgcaattggaggtatgtgtatataagaaataagacatttcagactgtagatcaaataatagaactttttttaaaaaaggccaggtgtggtggctcccacctgtagtcctagcactttgggaggccgaggcgggtggatcacctgaggtcaggagttcgagaccagcctggccaaccctgtctctactaaaaataagaaattagctgggcgtggtagcgtgcgcctgtaatcctagctactcgggaggctgaggcaggagaatcgcttaaacccaggaggcagagtttgcagtgagccgagactacaccactgcagtccagcctgggtgacagagtaagagtccatctcaaaaaaaaaaagataagctgcttgagagaaatatcggcagcaaatattagtcatcccaggctaaaaagaaaactaatttaaactcagaggcatagagatagctatgatttatatgtaagttgatgaatattttatgaacctgtttaattttattctacgtagaggagaaaaaattaccaatgctagaatataaaataagaaacttgttattaggaaaataagaatttaagatttgaacttgcattattattgacgtggtggtcaatttttcaaagttagctgatgttaataagtatctgttgaaaatggattgctgggaattaagtatttttgtaatcaatgaaggaagttttagcatagcgttgcatatgcatatattttccacttcactgttggtaaagccctgactcacatagtctcatcctgctgcctggtgaggtcaatagagactctataaaatgcttctcttcgttcgctttttccgcatcactgatgttgtgtgagaaatgacactagagtgggtgtggtggctcacgcttggaatcccagcactttgggaggccaaggcaggaggagagcctaggagtccaagaccagcctgggcaacatagtgagaccccatctctacaaaaagttcttaaaaaattagccaggcatggtggcacatgcttgcggtcccagccacttaggaggctgaagcaggaggattgcttgagcccaggaggtggagactgcagtgagccataattgcacccctgcattccagcctgggcaacagagcgagactgactcaaaaaaaaaaaataaaaataaaaactaaaagaaaagaaatgagactagatctgataagctcatatgttaatccctcacatgttcaggtggcctggactcaagaatctacaaagccaaggatatttaacaagacttactcactcattcattcatttattcagccaacatatgtttactaagtgttgtccgtttgcatggtgaagtcatcaaagcacacttgggtgtcgagagggcagacagcaaaggagttctttgcctctggaaacttagttagctggggagagatagctgagatgaataattcagttacagtgcaaggtatggtctctgagtaaatgctggtgtgacagtaaggaccagcatgctgtaagagtttggaaatccagagggacagaactgggtgtccactctaaggaatagtcctgcttgctcagaagacaaaaggactgactgcagtaacccattcgctcttagagaggcactgatgaagttagacagcataaggccagggcgggggcggggtgggggctacacctggagtgctgtcctagtgaatttggacctggtcctagaagtgctagtgaactttggatgtttttttttttcgattgggcaagaagcatgatgcaggaatgttcaatgaagattaatggaggagagagttttccaaactgaatttacctgtgagatgctgataactattccacaaagatttccatggacagataaggttttgcagaattctttaatacaggactccttagcaccttttttatgctacagtgtattataaaaccaccaagaaggaatatgatgtgcgcatttcccaagcttatttgacagagaatctcttgttttatgcattcttatctgtttccatctttccaaacaaataccttgagaccaaatgtttatacacatgaagaacttattagactagagagataatgagagcaaggggacaagtgaagaggctattacagtaattctgacatataattaagtcctaaactagaaatgaagagaaggaacaaataggaggtatttttgaggaaagagacaaagggacatcacgactaggaactaactgaaaatttgggacagaggaaaaagttaaagatagtttagtgtcacaaagtctccaaagaaccataggaactgtgtcatgactgatgggccagggcactaattgagatcaccaaaggactcaggtagctcctgtagtacatctagttcttggtaatataaattttgcagcatgataatggatatataaaatgggtatataaaagtgtcgctaggcagtgctgctggaaatatccagctaaatataataacatgcattttcacgctaacaaatcataaaagcacacaaggtggtgtggtatgaagattgtatagcagcatgtggcctcagcatgccattacccctccctgagcccagttttgtcatctgaaagacttatgtttggtatgaatctgatctgagtcccttcagacatttaaagggaaaattttcattcattgtctttcatacaagaggtatcattcaaagtacaggtgttaatgactttctatttaatcctcctgctatagttatgatccctcacaaaataaaactcaaatggccaccacagatacacttcttaatttttaaagtagttagaatgacacttatcactaaatagaaatagaagccattgctcagaatttttaccttgatcattaaacttgtttctatggatctttgagagaaaaggaaaatatctaagtaaattaaaacatcataggtacatttagccacatggcagtgataaataggacaaaaattaaaaggaaggataagagttaagaaactaggacatcactgatgaactcttaaattccaagattataagattataatttattttattcctctggtcctgaaaacctgctatttctataattagctttttgccatctcagtgcctaaagtaaaatctcctacagactggctggagttaaggctgtaagtagggaatgaattgctcccttcaggaactcatgttccttgcagcttcaggcccttgcttagctttaggaccctcagccacccaggccttttctagacctgttctcagctttatatttgtaaatttgcattgattttattaaagaggcctcagggtatttggagtgtcatgatctcaagtcttctgttatttctatgtgtttggaacatttcatgtcctctcgtccagctcttttgaaataccaatacactgttgttaactatagtcaacctgctctgctattgaatactagaacttattccttctaactatgtttgtacccattaaccatcctctctttatctccaccctattccctgtacccgcctacacaaacccttcccagcttctagtttctatcattctactatctacttgcatgagattgactttttaagcttccacatatgagtgagaacaagattttaacatagttgactgttcataatgtaacttagaagccacaagcttatttaattgtgaagaaaaatataaggtagcaattaagggatagattctagagccagactgtgttaacatctcagctctgtgacatatgagctgtgtaacctcgggaaaattacttcactctgcagtatgtttcattcatttaaaaaacataaatgacagtatctgtctcacaggattgtggtgatggttaaattaatccatgcaaagcatttagaagagtataccagtttgagttccatcaaaaacagccttcaagctttcgctagtgtttcaaaagtttgcaacaggctgggcgcagtggctcaggcctgtaatcccagcacttacggaggccaaggcaggtggattacttgaggtcaggagttcgagaccagcctggccaatatggcaaaaccccgtcctactaaaaatacaaaaattagctgggcgttatggcgcatgcctgtaatcacagctacttgagaggctgaggcaggagaatcgcttgaacccaggaggcagaggttgcagtgagccgagattacaccactgcactccagcctaggcaacagagcaaaactcgtctaaaaaacaaaaacaaaaaaagtttgcaacaaagaagttaacatttctctgggtaggtcaccaagcttgttctagatagaaatttttatgccataaatctattggaatggggagaaagagtatttgacataataaagtaaataatagataaaattcaagttattctttcttctggagaagggcacctagttattaatttttttaatacagaaacattggtcacacgccactggcaattccagagggggagacacagccagccagggagaggggagctacggcaggcagtatggatgcctgcccaccagcacgaattgctgctcctgaaaaagttatctagacctgacagctgacttcagcagcttccactgtacttttaaaagaatcttggatgtttcccctcagtgctgggccttctcagaagcctgccaagagcactcagagaagacatggcaggaaaaggcatgggtagcaggaggaagtgggagagatggtcctgaaactgcttctacacagagaaggtgaaggaactagaataaactcagttccagaatggtcttaatggcatttaagatatattataaagacagaggatatttgacatgtctattaagctgaaagaaaatgctgaatgccgtgtcagcatcaacatggggtcaacacatgggaacaatcctttttaaagctcatagtagaaaccattccttggacagtcatgctgagaattcctgcctatatggaaataactctactggaataatgtcttcagtcctacttatgggaaaagaaggaaagaaggaagggagggaggaacaaagaaaggaaggaagaaagaatgagaaaggaggaaagggaaaaaggagagagggagagaggaaggaaaaaaaaagaaaattttcaagaaagtataaataacatccaaattataccactgaaaaaaaattgttttcacgcttggaataaatgtccaaaggatattcccaaggatctgttagatctgaaaggacagcaaaatgttttgtatcccagaatggtgtgagagaataaagtagataggtgaaaaataaagtgagcaggtgggggtaaaaggaatccaccttgtccatttccatggaagttatttaccatgggagttgttttccatgtatgggccaggccttcatggactaacacgtttgtgagtgttactgtgggtcttggctagaagagctgatatgaacagggcatttgctgtgtgcttggcactgtgctaaccctttgtgcattatctcatatacattcagcagtctgtaagctaaactcctgtgcagcctgtttctacagatgaggaaactgagactttgagaggttaaaataacggtaactagtgggggtctagtgcggtggctcatgcctgtaatcctagcactttgggaggccaaggtgggcagatcacctgacgtcaggagttcgaaaccagcgtggccaatgtattgaaaccctgtctccactaaaaatataaaaattagttcagcatggtggcatgggcctgtagtcccagctactcaggaggctgaggcaggagaattgcttgaacccgggaggcagaagttacagtgagcagagatcacgccattgtactccatcctgggcatcagagactccatctcaaaaccacaaacagtaagtggtggggatgacttgcttctaagcagtttggcttcagtgcctgaggttaattagctatggatactgtttccagtaagaccaggatggttgtaactgctggggctctagcagagcaaagtttcatgtcctgtttgcctttgggtatcaccttctgttgccacagccccaaatccatccctaactctccttttgcttctttctggctcccaagaacacccaactaatactgtgtttcctaggacttctttcaccttaagtcctattcttcaataattatcttttctttctgtccttcagcctcaaaattaacttttctcttttgttcaggaaaggaatcatcctatgtgaataactgcacactgtgatatgaatggctgacactcaactagaaaagtggctatgaaaagaaagagcttgataagatgagacaggttcttgaactaggtcaatttcttgatgctccttgcctgctgttctcagtacagtctggaagaaaaaggcccgacaatcagaggcttcccttctctccccaatgcataccacttgtgagcttctacacagttggcctctgcttgtgaaacatataaaaagtgcttttgtcctaaatagtctttgttccatgattgacttggaatctcagggaaataaaaaggaattcatatatgtgctgaatttatagggaataaaagcattatgatgagagaaaggaagggaatttgggacaaatactaagaaagatccaaaggttttccttcagaaagaaatttctgttatttaatccatacatttgacttgggcccataggatggaaggtgattagggattgtggttaaagagaaggctatattttaggttaaaaaataagacgtagcacgaagaaaatgactagtccaagttacagctttgaggttaaaccataaaatcagaaatatgccattttttatatattttaaaattatgtattcaaactcgtggtttgaaaagtatagattagatttgattcccagcacatttgggacggtaagataagctatatttttgcatgtgagggaacagtttgagggttatctcagttacattggtttaaaacagaaatgcaagacaagttggtgaagtcagtgaagaaaatgaagagagtaaatattaaaacaaaaggaaatctcagtggcaatggaaaaaggtgaaaaaataaaacaaaaggaaatcaatcaaaatgggtgataatggtttggctctgtgtttccacacaaatctcaccttgagttgtaataatcccccacatgtcatgggagggacccagtgggaggtaactgaatcatgagagtaggtctttcccgtgctgttcttgtgatagtgaataagtctcatgagatctgatggttttataaagggcagttcccccgcacatgccctcttccctgctgccatgtaagatgtcccttttctcttcctttgtgttctgccatgattgtgaggcctccccagccatgtggaactgtgagtccattaaaactctttcctttataaattatccagtctctggtaggtctttattagcagcatgagaacagacgaatacaatgggtttgacttatttgactgttgataaaacttcctaggccatcaagcatttaaagcagttaagttgatttttatataacctcagggttccctgcctgtagttcaatggtctaggcagagcaagaaggaaattcgtattttccatttttcttgtggtgatagggagattttaactaattagaatagtagtaaatgaataacaatcccaagtgattttcttcatgtgttgcttgaaagatatgtttcaagtttagccacaaatgatgacattttttaattaatgagtttttattgtaagtaaaggatacggggcttggactcaggcaatgggatagatgatgctgaagcccctcaggaggtaggaaacccctcatacttgatggttttgcaggtatcagggagccccctccgctttttcttattatgctctcccacaggctgatatataaaatggtcttttttttttttcttttgagacgcagtttcactattggtgcccaggctggagtgcaatgctatgatttcggctcactgcaacctccgcctcctgggttcaagcgattcgccatcctcagcctcccgagtagctgggattacaggcatgcaccaccaagcccggctaatttttgtatttttaatagagacggggtttcgccatgttggccaggctggtcttgaactgctgacctcagttgatctgcccacctcggcctccgaaagtgctgggattacaggtgtgagccaccgcccctggccataaaatggtcttcttttggcttgaagctttaatattttaaatacttaaatgcctacagatagagaaacatttaccattatccttcacagaaaaaatggcaaatatgtgaccttcaggcgtccccttccatgaaagccattgaggatcaatctcagaattcttccccagtgcacctgctttcaagaatcgcctcttaacccagctgtccaggaagccactctgaatctattagacttcatatgcaagctgacattgatgtaattctcctcatgtgtatcttatgtgaatgaatttattgaatcttatgtgaatgagttcattgagtcagagcaaattttgagagtgagaaaggaaagaaagtataaggtttttggattcgagggaaaaactcagatgttaccagcaagggtgggttataaactttgcctataactttttacagaggtggacatactgtatatagaatatctagtactaagtgccacataccattattatcactttgtgtttgttatgccatttttttcttcacagcagctttaggggatggggagaggtctcagttgtacagtggaggaaactgaacctccatgatatttaaattatatgtaaattctcttacaccttggacaagtcatttaaacatcatggagattccggccgggcgtggtggctcacgcctgtaatcccagcactttgggaggctgagacaggtggatcacttgaggtcaggagttcaagaccagcctggccaacatggcaaaaccccgtctctactaaaaataaaaaaaaatagctgggcatggtggcacacacctgtaatcccagctacttgggacgctgaggcaggagaatcacttgatcccaggagacagaggtttcagtgagctgagatcatgccactgcactccagcctgggcaacagaacaagactccgtctcaaaaaaaaaaaaaaaatcctggaggttcccttctttccagtgtaatctgcaattgtatacgttgcctccagagttgtatagaattacatcaggatagcatgagaatcttctcaaagtagcctgcattttcagtgctatgttccttagtaacaaaattaaacattaatttgagtggactaagaattaaaacttctatttcttcaacctttgttttttctacctgatgaataataatgcagctccttggagatgatgtaaaatcatgatatttttccagtgtggataatatttatctaaattttccttatgagttctcttctatgatatttaatatattcatgttgacaattaaattttgaaattttgttgcacatattcatctgataatttttttaatgctttgattggcgatattttgtaataaatacctcatattggataaagaaataacactactgaggatggcacagtcagcgatttttagtaagtgtgagttttggatttaatggccgtatagttgcaattttaaagttattgatttgaacaagaatttttccaggccttttatatacagcagacatagaactgattatgtattggatcgctttgtatattcctaatgagtatgggagcattctttttattttcaatatcagttgaccttataagggacagttttaatattcatttcaaaccagaaatagcaagtattatttttatactaattcttctgtgtgtcatgctattgtttaagcacctactatatgccaacatcatactgcaatgctagttagaatgttggaaaaaagtgatgaccaatggttgctgagtgttgagaacaccttctttccatgttctctcatcctttcttctgtgcacagccacagtctgctctgcagcatccctgacatgacctgccacagctcaaacacatcttctaatgctcattaatataacacttataaccacttaatagataccaggcctcctgctacacatttcacggtaattcacttaatcctctctatgaccctataaagtagaactccattttatagaacaaaaatctgaggcacaaagaggttaagaaacacgatcaacagccagtaaatagttgagccagactttgaacctagacagtcctgctctgcatcagtgtatataacctatattcaggtgtctgagcgagaagaagctcgagtaatacagcctggacaggtgagtgtctgcgtagagcgaggcaatgtgagcgatgagaaagaggcaaatctgagaaatcctccaaagaataaactgaagtagatgtgagattgaatatagacgctaaggagaagaggcatgccaaagactaatagaatgatggtatgcccctggccagtggggtatttgaaatgggaaatggtttagagaaaaaagtcaggagctccacttcgatgggtttaatctgaggtgatgggatcaatcccaaattgactggcatgccacacacatgtgatgaagtggcaaaacagtgtggcatagtagaaaaacttcggatatggaatgacaaaaagcaagttcaagctgtgatgctgatgctagtacctctgtgacaccatgcaagtttctttgcttctctgagccccagttctctttcctgtgattaatttcctttattatgccattagaaagtttagactaaagtggcgtgccatggaacagacagctattaaaggtagaatgaagatcacatgccaaatgacctaccttttagaatgtattaatctgaacaatatctatttaggggaaaaggaataatcacattgttaagtcagagctaggatggccataccatatggtccaaaccagtacccttttaagagtaaagatgggtgctctgaataaatgcaccagaacaacagggattctggtataattgagggactgtcataggaaaggaatacaaatggttaccatactcacagccatcagaagaggtacttctgaaatagtctttgtagaaaccacaatttgtggtttccagttttgaatgaaaataatcctggatgaaagagggtatattcaggatgtgatttccagctgaggaccttccttatggactacatccaaggaccagttgccccctttctcccctcttccttagcagcattccccaccccactactctcctttggttcacacatgacactcaagccactgtaatcattcagtcgtctggaagaaaaaggagtgacttcattgtattaatatatctgatgtcctctccattgctaatacttgttcatttctgattgctgccttgtagttgctccgctctgctgctgattggtctgctggtataaagtaccatgaagagtccatccacgccgcttacgtccatgtgatagagaacagcaggcactatatctatatcgaagtaagtcttgctcatgtaaattcgtgtgagaaactgccttcccttaaatatcatgcagagatttcagggtccccaaacttaggacccctcatattaataagtatattttgaggcgtgaaaagtgctggagaagctctggttcatatcacctgaattttgacctcccaagcatacctggaactggctctgcattgtcattaactcaagattctattgggagtctcacaaatctttgctgttaaaatgcatcatcaactcattgtaatagtattagacagaaataccccaacatggataggtaagttttgttttcgcttgggttggagggtttaagtgtgaagcaagttctatttcaggagagcacacacaggggtgagttgctaaaatagagaccactggatgccactggtttgggcatggcggagtagggagagtgcagggaaaagaacgtggaaaaggaagatgtgagaacattaagagcaggtaccaccttcttcaatcctgtgtgaactactattgattaggaagctttttttcatcccagaatttttagagcatatgagaaaatctggggacactgagtttagtttgggaacttaaattactcttcaaagtgaatataaaaatagttcagagaacttgaaaaaccctgagaaaataaaaagtcacaataatggaaaaaataaatcatagcataatttccttccttatttgagtcttttctttcccattgaattttttaaaggtagataggggaatgggttaactgaggaaaaccattctagccctgtttttcttccccttgggtcctggccctctcccgctctgcacagcaacaattcattagagacaagcagggaagaattggagctttatttgtttcatgagcctggctagagaaacctaagttaaatataatatattagctggctaaatgcagtgtggtatcctgaatggcatcatggaatagatataggacattagtggaaaatgagcgaactctgcataaagtctggagcttagtaatgctattagtattattaatttaaacaattataccatagagatggaaagatgtgaaggctggctcatctattgcccagaatcattttgcttcatctctttttagtagcattaacatcagcttttctggccgggcacggtggctcatgcctgtaatcccagcactttgagggggccaaggcgggtggatcacctgaggtcagcagctcgagaccagcctggccaacatggtgaaaccccgtctctactaaaaatacaaaaaaattagccgggcatggtggcgggcacctgtaatcccaactacttgggaggctgaggcaggagaatcacttgaacctgggaggcgaaggttgcagtgagccgagatcatgccattgcactcaagccttggtgacaaaagtgagactccatctcaaaaaaataaaaaaaataaaaaataaaataatcagcttttctttttaatgtgacaatagtattaaatgatgtcagtaacgccatgtaggtatacatagttgggacatagacctggttgacactcctctagtcaagataagcagtcagcattcatccgactcttccaaaaaaggagaagtaaaggacatgacatgtagccagtctgtgtttacagctgctgaggcatgctaagcttctttataatatgaattcagaaaaagaaacatggtttggttgccaatgagattttgattgtctgatgccctaaggggaatcacattctcaaaagactttctgcaccgtgtcttcctgtaagtttgtcttctggaggcattttacagatttatgcacttaagtataaaagcttatatagtcataaaaatgataatgccacaaagggatgataattacgagttgttacatatatatctctttaccttgagatgattagcaaatattactttgtgataattgtccttataaattacagatgtgttataacaatctattctatttgaacacataacattagtaatatttgcaccaaatttttcacattcctttatgcagcaacaaaatattttgcattgttatgataatgttgtaacttgttttctagtaacagttttaaagactattttgtagatatataaatagcagaagtacttagaggaaaaaaacattttttattttattaactggcttatatatatgcaacatacaaaagagagttgaggctacttaaaatagaagttcagagataataagagacccagacaaacaagacaaggtgaaagcagataccaggaaataatggagaaagggtggagaaaactagaccaggctttaccatctactctgttaaaaaagcaagcttagcatgagatagaatgtttgccaatatagaatttttaatcataagcatttatacaacatgtgaatctgaaaaaaactagtttccccattgattaaatttgcagtgttcctaagtattctgagaatgtaatttagaaaatcacctataaggaattctcatggtgaaataatatagtgtaactttccacttgattaagtgttacaggtgatatgacctggaatcagatgagaccctgagtgagatgaggcggctttttttctgtgtcgttgactttcttgatgtgatttcagtgatcagaacacatctgctgtgtgaaacattttaaaaaatatattacagtattgttcttacgtatattgctaagaaaataaagactaacatgattgtcttgtttatttctcatagaaccagtttttcataagctgtgctgatgacaaagttgtgttcaacaagataggcgatgccattgcccagaggatcctgaaagctcacaggtaacagcctttggctgagagttctcgctgcagatgttcttgtatttattactaaaatgactttgcaaagcccatttttaaagtactgtcatttcctagcagcttaaatttggttcagccagcaataggttattgatgcctttagtctgagtcagttgctaaagatttttgactgccctttctagggaatttgaattcttccaaggcacaaaaatttcttcctggccagtctgtttcccacacatgaggtttgtgatttgttttatttaatagcagactatgagctgtgttcgcttaaaaaagcaaaacagacataatattttgctatgggttatatttaaattcttgttaccgtatgtcatatttattcagctcatgggattttttttttaataattggtttgctgagatagaatttacatactgtataatccagccacttaaactatacaattcagtgatttttagtgtattcacagagttgcacaaccaccacctaatcaattttagaacattttcatccactcagaaagaaaccccattagcagtcattacccattccttctatttttagcctctggctaccactgatttttctttttctatagatttgcctaatctgggcattttgtataaatggagtcacacaatatggggtcttttatgactgatttgtcttagcataatgttcttgaagcttatctattattatagcatgtatcagtatttcatttctttttattgccagataatattccatgatgtggatataccacattgtatttatccattcattagttgatggacatttgggttgtttctactttttgcctattataaataatgctgctataaacatcctttactagtttttgtgcagatatatattttcatttctctaggggtagaattgtcaggttatagctaactctatgtttaacattttgaggaactgccagactgtcttccaaagcggctctgccattttatattcccatagtatatgagaggtccagtttctctgtatttgccaatacttattattatctctctctttgattatagtcattctagtaggtgtgaaataccatttaagaaatggtatttcattgtgattttcatttgaatttctctaatgactaatgatactgagcatctttgtgtgtgcttattggccatttgtgtattatctatggagaaatgtctactgaaatcccttgcccatttgttcactggggtatttgactttttatttttgagttgtaagaattctttatacattctagatacaagtctcatatcagatatatgattcctagtttctcccattcgatggcttgtctttttactttcttgctggtgtcatttgaaacagaaattttttttattttgataaaagctaacttatctatttttttccttgtatcgcttgtccttttggtatctaaggaatatagatagtgatatctaagaaatcactgcctgatctaggatcatgaagatttatgcctgttttctcctgggaattttatagtgttagctcctacatttagatatttgactcattttgttactttttatatatggggtgagttaggggcccaactttttattcttttgttgatggatatagagttgccctagcaccatttgttaaaaagactattctttccacattgaattgtcttggcaccagggacaatttcttcttatggctgatttcagctccatttaaaagtagcagaacaaacacataagcaaaaccattatatttcattactttaagtcattgaatgcacgcagtgaagaataagtgcatatgcatttgggaattaaaacactttttacttccagtgtcatgtggtactttgatatcttttttcacataatatttggggacttttatacttaaggacatattataacagtaactatcagcattttatgtgattcacagtttataactacattatctcactgaatcttcacaactacacttgagagtaggtcatgtatttgttgttgttattgttgttattattgctgttgttgctgttcccatttttaggattaaaaactgagattcaagaggttatgtgacttgtctaggccactaaccacaataggcaaaaaacagctttgagcctaaatctttggactttcaacccaatgcttcccctcacaccacatgactctagtgcattgatggttaggattaaaaacccattcagggcttccccaagctgaggcaaatgtgttgggcctgtagttcccttcccctattgaccagccattggatgcaggctgaccctagggagtggggatgaccttgagtgaggcaagtccctttcacctatggaggactccatacttttcatacctggaggacttcactgtgagtattccgtggcctacatgctcagtagctgatgggatggatgtcttgatcccatggtgaggggatctaggcagcacactacagcatccatcatatcctgcagtgtgtacagtggatctcacctgtgactacacatcaaaatcaccactgacttttgcaagattacagagagcttgactcacctccaggcttactggatcataatttcctggatcggggcctggccccggtattttatactgttccaaagatgtgtttttaagtgtttggaagcctgaaagaatatttttctttactgtagtaatttgtctttaaaaatctggacttctaaaataataaaattaggctgggcatggtggctcacgcctgtaatcccagcactttgggaggctgaggcgggtggatcacctgaggtcaggagtttgagaccagtctgaccagtgtggtgaaactctgtctctactaatagtacaaaaattagctgggcttggtggtgcatgactgtagtcccagctgttcaggtggctgcggtaggagaactgcttgaacccaggaggtggagattgcagtgagctgagatcatgccattgcactccagcctgggtgacagaccaagactctgtctcaaaataaataaataaataaataaataaataaaattatagtattttagggctacaagaaacttcaagatattttctgatagaacatttcctagtgatcttatgagctgctcctgaaaggaaaagggatctgtgactttaaaaattatggtaaagtagcacctgttgcagattgtatcttacacttggagtttgacagagcacattaaagactggcaatttcaagtttgctttgtgaaaaatgggaaattagttcatcaaatttcaaataaacctgtgtcatttagctctgatctctcaatagtctcatttttttgacagacacattttcaaaatggtacatatgtcacacatttagactttcagtggatacacacacacattctcaaaacatattttatgttcccctcacccctggcgtctctgcattcttgttaatctccctatgttaattgcaactgtaaaatatattttcacttaatttcaaatctgtgagcttgtgttctgtgagcttgtgttaggcaaggtaaaggcagaattaaaaagcttatcttgggcaggtgtggtggctcacacctgtaatcccagcactttgggaggcggaggcgggaggatttctaaaggctagaaatttgagaccacctgtctttacaaaaaaataaaaaattatccagatgttttggtgtgcctgtagttctagctacttggaggctgaggcaagaggattccttaagcctgagagtatgaggctgcagtgaactataatctcaccactacactccagcttaggagatagaatgaggcctcatctctaaaaaaataaataaataaaaaatgaaagaaacaacatattttgcaggttgccaccctggggtgaccccttttcactaattaggtgccatgatgtgccatcccaaacttacccctctctctccatagacttctctggtctctacttttctgagactcagaacttccctgccaaagtcacattcttagcaacaagtataattttggctatttgaaaaagaatagaatgcagcccaaagcagatggagggaaatgacagtccgcagtcagccaggcctcaccaaagaatacaggccctctgccaggtccctcctaccctggagaaatctgagtcttcaaattgccaactccctggactggtctaagtatttttctgccagcgttggaatccagcctcacaacaattcccctaagcaatttctcagttcctctcacttcctctggttccttctcaacagccataattctttatagaaataagttttgcaaagccttcatgttctgacatgacctagagcctcagactcatgtttaccccatgctgacctcagaacagccgggggaatcagaataaaaaaaaaacaaaaaacaaatcttcactctaataagtaaaactgtctcagagttgaagccagctgcccaacccacttgaaacctttctttgacagctcaaatgtgattggcgatcagagagaaaaaaaatcataatccacagtctaaaatttactgttttatgccatgtttgactaagccaaaagataggaccaactgatccaggtagacacatttttaaacactgtgtgccatgaatgaatggtttctgaggagattctcagatctttgcacatggaaacttgacatgcataatttttctgctttggtagaaagtcaggaagtgagaaagtgcattttatagtgttagcaacaaacagttgacacacacaatgaaaatagtcagttgacttaatgcttctatgttttaatattaaactgcattaaaaatatgctattaaactacattaaaacaacaattttgaacattgttcaaacttaccatgttcttttttttttttttttttttgagacagtcttgctctgtcacccaagctgaagtgcagtggtgtgatcttggcttactgcaacctccatctcccgggttcaagcaattctcctgcctcagcctcccgagtatctgggattacaggcacccgccaccacactcagctaatttttttgtatttttggtggagacggggtttcaccatgtcggccaggctagctttgaactcctaacctcaagtgatccgcccacctcggcctcccaaagtgcccctcatgcttcttataactgtagaagagctactgcttgcctgtaagtgggtggtatgggaaataccacactgggaaatctgaaattattgggggaccagatgtctggagacctggattctctccagctctgttatccacaggtatgtgaccttctgagtacgtcagtttgtccttctgacacgctgtttcttcaccaaccacgaataatattatctgttctacgtagcttatatgaatatatgtgaaagtagtttgtaagctgtaaagcaccagttcatgtaagaacttattatagcatttccatgatattcatcatctggaaatatgttgttcactgtaaattgaagcaaggataaagaggcatcatattcaaatcagctgtttcaaaattagtatttatgctagaaaaagaaatgttttaatttaaaagatgcttaaatgttccgtattttaaattattggacggctacttctggataagaaaaatttgttttggtttctcacgactggctgttgttcatcatgtgacttgtttaggcacacgattacaacactctgtctagaggtttgctgccagaaacctatagctgactcttcctgggaatcaatttttgatttccctgttattgatctgataacactctccccaaaatataaagtaaaacaaaatgtattctgaagcataatatgtgtttagtttagtattgttttaattttagatgctatttactttgttgttatttgaagatatgcaagccttctaattgaaatcagcaattgatataattgaataaaaatgttaccaaatagtttctgagtctttccacataatcagtgctatacctgtgttacctcattcagtctttgtatcaactttatgggattggttgtgtaattactcccattctacagatgaggcagctgaggcctagtgaaattagataacttagccaagtcatacagctatggttggataggagtaggactcaaaccatgtctgtaggacctcaacttgtgctttttaccagtaagctacaaagcttcccccatttcaagggatgtagaaattttcgaatggtaagcctcccagaaatctatgaaaaatactttattttgaaatataaaaaattgaatgagctgggcactgtggcttatgcctttgattctagcactttgggaggccgaggcaggaagatcacttgagttcaggagttcaagaccagtctgtgcaacatagtgagacctagtctctacaaaaaaaaaaaaaaaaaaaaaaaaaaaaatagctgagtgtgctggtacatgcctgtggtcccagccatccgggaagctgaggtgggaggatctcttagcctgggaggtgaaggctgcagtgcgccatgattgcaccactgcactccagcctgggtaacagagcaagaccctgtcacaaaaagaaaaaaaaaatcagatgaatgttttattttttaaaagcaatgtttgatagattaaaagttcttgggtttaaagaaaaatctatgtccataattaccatatcctataattttgtaccaaactgaaaagacatgttgggcttgtttcagaagccttgtcttaaagaaaattcaactgcagtacctttttttttttttttttttgagaaggagtctcactctgtcgccgaggctggagtgcagtggcgcgatcttggctcactgcaaactccacctcctgggttcacgccattctcctgcctcagcctcccgagtagctgggactacaggtgcctgccaccacgcctggctatttttttgtatttttagtagagacggggtttcactgtgttatccaggatggtctcgatctgctgacctcgtggtccgcccgccttggcctgccaaagtgctgggattacaggcatgagccaccgcgcctggccaaaacacattttatctaagtatgccaatcattggtttcacattttttcttgtgggataactcccaagctctgtacgatttctggagaagaggttaccttgggacacagatgacaacagatcgtggcaggagaccttttgatttaggtcatgtaaatgcttttattctattctaaaaattgtataaaatggtaacctcagcagatagagaaatgtaaagattagcacagggcaggggccagcactcattttgagcctgagcatgtgccctggaaaagagaggaaggaagaaggagacttaaaaatgacaatgaaaaccgtctgggccatagtgggaacagtttagtataaggttctatataacctcatttgggggccactcagggctaggcttgccaaagactatcaagcccagggtgaagtctaagtcaaacatgctggggaatccctcagcattcttatgtttgaaagcttgccattttcaaaagataaccaatgagaaaactgatgtgtgtttgtgcacaatatataatagttcataatctatgaagtcacatagaggataggtaaagtcagtgctaaatagggccagcatttctagtggactagtcatgattttagccagttctttcatgtgcagatgaggaaactgaagcccagaaggatcttctccttttaaaggatttgccaagcacaaaataaaaggggttatgtcccaaacgaccaagaagctacagatccaattccaacataattgataccaccatagtataaaattctctttacacacacacacacacacacacacaccctaagccctaaccacaattcttcctatttctgacagtattcactgctgcaaaatctacaacgagacgatttatagcagctcttgaagtttacagtaatgaaatacaaactataaatctcaaattctcaaaaaaataaagtgtcttgtcactagcgaagcatatcaagcttcctcggggccttcttgccagaccctgagacccagttgtgagcagatcaagcttctcctaactgtccttcatgctgaggagggactgtgggtgaaggaggaggggcttatgcagcagagaaaaacaagaaaaggaaagtagaggtacatcactgctgtgacccatctacatggtacattcgtactctgcttttaaaggtacaaacagctttatagcaatcacaaaaattttaaaattaatttttttttttttgagacggattctcgctctgtcgcccgggctgctggagtgcagtgccgcgattttggctcactgccaagctccgcctcccgggttcacgccattctcctgcctcagcctcccgagtagctgggactacaggcgcccgccaccacgcctggctaatacacacacactactattttctgttgaattgtaatttattttcttttcctagagttcatctgaatttctagctcaagcgcatttccacacaataggaggggttttagttttagttttggcacttcctgataaatgtggccaaattcagtgatttctcattatttcccttctatattcagcatcagggttctactcctgcctcctctccctccacatcccgtccttgatcttaatgctatggggccctggatctttggaaaggggcttccagacactgatgttgatctccctccggcctgttctggcatctgcttaacgtagcttggggacgtcagccttcacctttcaggcctgcctctctaccacttctcctctgctcctgccacatcgcatagctgctgaacgacatgctccacatttctctggagttcacctgaaagcaaggcacagatcctcctggctctcatatcctcacattgaaaagagagtggggtctatcctgtttttccccgaactcagcttgaggccaaaggactgattccttgccctgagtcttgctcttatttctctacactcctgcctcagcttagagaatctctccagttccccaaatctaaaagaagttgatgtttttgtgtcctgcttcccttgtgagagtgccaccccgggagcaatgcctgcttcgtttctccggtcacagagtgggggaagttaacacatttaaagggaaaaatgatttaatgttttatagcattggcctgccacatttttattctcttataacattgcattggggccattttaacacagtaccagaagtattgtgctactgagccttcatagcggtcatttttagtggctacaaggtgatcattccattgactggctcaacataatttaaccattcctttattattggacatttatttccaatttttagctattatacgtagcactgccataagagttagtgaattttgaagaaaaacttttaacaagaagcctgagaatgctgtttggtagaaattgctttgaactaatgtggatgaagtgattgctggcatgatgggtagttatccggggcttagtgcccactagccccaaaagcaagattgcttttaagatcataaatattttatacactaggggctcagattcttaccctaagctgaatgctatcatttccacaacccccatgttgtgaggattcagtatttccgaaggacgttggattcctcagcagctggaactcttgtcctctgtggattggatcaaggaggcagattggacacagtgtcccatggaatcttctgtgctttggcttacattcaaccacaattttgcgtttgaaattccagagcccttttttctacagcagtgaaaatctaaatagtttccactagtttgctgaacgcagtttaaaattttcatcattcaggaaatttatgagctaccatattgtaaaatagcaaagggcttgttatggagctaagagagtcctaaaaacaagaaaatgtgaatattctgattcctacaaactaaaatttgcaagaatgttttataatatttttataggacatttctcaatatcatacatatgagatctcccttgtaaaatcatttttgcttaaaaaaaaagataaaatagaactgtctcttacaaacatcatcacaaacatttgtgtcaaagaccagcaataccacttgtaagatttttccaacaaatgtgaaaaattacttttgttagtcagcgtaaatatcaaaatagttactttgaaatagaaaaaaaattagaagcaatttaaatgcctatcagtaaagaactggtttaaatattaaagtatagatgcatggtagaatattacctccctgttcttaaaaagtaactatgttctggccaggtgcggtggctcacgcctgtaataccagcactttgggaggccgaggcgggtggatcacgaggtcaggatatcgagaccatcctggctaacacggtgaaaccccgtctctgctaaaaatacaaaaaattagccgggcgtggtggcagacgattgtagcgccagctactcgggaagctgaggcaggagaatggcatgaacctgggaggtggagcttgcagtgagccgagatcgcaccacggcactccagcctaggcgacagagcgagactgggtctcaaaaaaaaaaaaaaagtaactatgttcttatgtggaaggatttccaagataccctgttaaatgataaaaatcatgttcagaaaagtgtttatagtattctaatatttgtgtagaaggaaaaaatacatatattcttataaattcttacactatttctaaaagaacatggaggaaactgttaacaggagttgccctcaggatgaaggagtgagagagattttttttcactgtataatcatctacctcttacattttgtactatgagcatatgttactcatttgaaagtaacctgtttggtagttcctcaaaatgctaaacatagaatgaccacatgacccagcagttccattcctgaatataaaccccaaagaactgaaaacagggactcacagatactgtatgctagtattatagcagtattattcacaatagccaaaaggtggaaacaacataagtgtccattaacagatgaatgtgatatgtacataccatggaatattattcagtcttaaaaaggagggaattctgacgcatgctacaacatgggtgaaccttgaagatgttatgctaagcgaaacaagtcagacataaaggacaagtattgtatgattctaattatatgcaaaatccagaaccagcagattcatagagacaagcagattagaggtttccaaggggtgcaggcagggaaaaacagggtagttatgactggatagtcaccgagtttctgtctgggatgttgaaaaggtttgggaatagatcattatgatagttgtacaacattgtatatgtaattgatgccactgaactgtacacttaaaaatgggggctgggcgcggtggctcactcctgtaagcccagcactttgggaggccgaggcggatcacctgaggtcaggagttcgagaccagcctgaccaacatggagaaaccccgtctctactaaaagtacaaaattacctgggcgtggtggtgcacacctgtaatcccagctactcaagaggctgaggcaggagaattgcttgaacctgggaggcggaggttgcagtgagccgagatcgcaccattgcactccagcctgggcaacaagagcgaaactctatctcaaaataaaaaaaaaagggtaaaatggcaaattttatattacatgtattttaccacaataaaatgtaatttaatttaaagacataaaatataattttatttaaagaaaaaaatgtatgtaatatattatatacactttacaaacaaaatgtaatttaatttaaaggaaaaaattcctgttcagcttaacctcttctctaccagaaacttccccagaaacatttttccaacctgatcccatcctcctaaagcaaataataccgagtgcatagcatgtgcaagggtctttgattgggtactaccaaaaccagaaagatatgtgggcaggcatcctgtgtttcaaaggagcttatcacatagcctagagagcagatgtgtgtatcactatcgtgtaaagcagaaagagtgcagaacagacatcctggccatgtgctatgagtgccgaggcaagaataaaacaactctgactggaagagccaagtggcttggcagaggaaatagccaataaggtgacctagaagaagtgggattcactggaggcccagaaggctgatgagccaagctttattagtaggaaggtgtacctctgaacaaagggtggtagtctcctgtcactgggctgtggtgatgggaggattatactgtaaggcagtataatcctgaattctgaaaaggcagttgaggccaaatgacatccatttttaactgtccagtttaattttttgacttttaaatgttggctgtggggaaatagcttaatagcttaggttttcttttctttttttttttttttgtctgttctttttcgctatcctgctcaccatttagggatgtgagccttttattcttaccaagcagcaaacttgaacagtttacattttttaatgtcttctttccaactcaaactatgtttgccatctagtgaataatccatgccattacaacaacctactcaagatccttgtttcttagcatggcagccaaactcacaggcctccaaatttcattgttggtagtcatttctgccctgaacttctctttccacttgccctgacatcgactttagagacatcagtaataaaatctgatcccccaaagagtactgataatattcacatgaaagaaaaatttagttgtttagaagaaaatgcactttagaaatgagaagtttaagtaggatcggacttgaaaattaaccaatgacaacacctttgtgtgaatatagtcctcccggatatcccagcgagattcattgatcacagtgtatgtcacattcctttcgaggctttttcttctccctgtatatcctataaatagagacaagaacgttaatagcttttgattctgaataaatggtacctatttggagcatacttcaaatttctgattttctgaatgcccgtcaaagagagaaagctacactttcttcttctattgttatatcattgagtagaattcattttctttcaaaggttgtcattaatcacttgagagaatgggacatgaaatattgtgttgtatgtgcaggggacttaaatatacatactggccactcagaattctttttttttttttttttttttttgagatggagtctcgctctgtcacccaggctggagtgcagtagcgcgatctctgctgactgcaagctccgccacccgggttcacgccattctcctgcctcagcctcccgagtagctgggactacaggcgcccgccaccacgcccggctaattttttgtatatttagtagagacggggtttcaccgtgttagccaggatggtctcaatttcttgacctcgtggtccacctgccacggactcccaaagtgctgggattacagacatgagccaccacgcccggccggccactcagaattcttaaagggcctagggtaacattttacagctgaaaactcagagtttctaagtagataatgatgacttctgttttggaaaatgtaatgggtccagtgtgtctttttgcccctgcgatctaggctatgagaactgatttactcaacaattattaactgaatgtctactatttccacggctctagctaggtactgtgttaactattaagttctttttccaaaactttgttatagcctcccctacccgcctctttccatgggatccaagcaaggatttcttacactgcattttgtcctacaagcgattatgctgtagagagacaatgggtacaatttctactttactgccaagtttagcttgttattcaggctatgaagcgatagcctggatgacagcttctgtcctccagtccaacagcacaccctcccaagtcctgaaatgtgacagaacgtgttgtaggaagccattcactcaatctcaaaaaccatgtgaactgcttggctgtcatctaaaattgatactaccttttattttttgggtgaatttctctgcatctgacctttgcagggaaaaccagaaataccgggtatatgtcgtgataccacttctgccagggttcgaaggagacatttcaaccggcggaggaaatgctctacaggcaatcatgcacttcaactacaggtgccaaaactctaaatggtctattttgagctttcggtcatgcatcatgtaagctgatgaagggaatggcagtgtttctccacatccattcggtggagtggggaacaaatgaacactttattttactttcaaatcttggcccgtttgctagttgataaaattcaaatggagcctacaatgataaatgattggcctaagacacatggcaaacataaaagaactaaaatattagtccttcttgtatagttactgtctatttctatatatgtataatgttgattaaaacttatctttaagtgggtaaatagctattgagctttacatgtactttgcagtaaatagagaaaaaattaaatgcctgaaatggtaagatttgcttgtgtttggttatgattctttaggtagcaagtccttcaacaaggttgataatgatagcctctgttagtaaataaattcccggaattttgttttctctaccacatctttgttaaaattttagggaaagttttgtgcttgatatttttaaaagctgagtttttatatttatttaaaagggcacacttgggttcctcttgaggcttcagatttggccagtggagcattgtgaaaagggctggaaagtgctagctggtgggttgggggagcacaggctagaaagcctgcatagatggggatggaaatgcacctctgaccttctctcagggtcacttaaccaaaatctcttatttttctgaaccacctgtagtttctcacctttctaatcaaacccttctgaaaggtgggagaggacgaatgatactttacatagaacctttggtaagtaaagcagattaggggtcagggccttggtcaaatcgggggtggagacttagatgccctcctgcttgggccccctcgccagatgctcctgctggaggatctgtgcacagttcgagtgcaccattgtagtggaaatttttttttaatcctcttttttcttactgatgtttcaagcttgtatctgtttatctgccaggatttcaaggaaagatttttgtttgtttgtttcctccagggtgcttctgcctagttacagtacaagagagctttaactgtgctttggcctatatacttggactgaagatttgcacatttctaatattatctgatttataaaatgataaagcttttcaagtatttaaggctctgacataatgtttaattgaattttatcaatttcattcgccattctaatattatttttgtaatattgttaattgtaattgttttctatgactattttcttgccttcgaaccagctgaatgaaataacacatttggcttttgttcagaaacaaaaactataaccttttattatgcaaaaacatctctatttgctggcatcatctttaataatagcatttctcaggcataagtatactctttattactctcatagagcaagcagatgaagcatagaatttttggttttgtcagattttataattcatcagtgattatcagagtcttaagaaacaaaatcattagcagagtcctttatttgagactatatttttcgtttttagtggttttgctgaatttaaagacagtccattctaatagtttaatttgtaaattattctgctaagtgcttgcccttttcacctctgagagcaatgtgattctctaagtattcttatctactgatgcattctaaatttatctttgctgttacccagttttgtaagagggaaagttcattcatgacccttctttttttaatagcctctctttctgaaatctaacacgaattttataacttttccatttacctacctcaaaacaactatcatgtccctattagtagcattacaaaagtgatattcatgtaactgtttttagcatttagatatatatgtagcatcttctcatagaagcacttgttctgtttttacttgtgttaggattaaacctacagatactgcatgggattggttgttttgaaacctctgtaattattttctcctttacatattttcagaaccatgtgcagaggagaaaattccatccttggacagttaaaagcagagcgtaagtaactgctttttttctcatatcattgttttttattatgaaggtgaggtatcagtaatcattaatgttttcacagtgtgattatagaactctgtttataaaaggtaccccacaaaatgttcacctgtaataaagtatttattctcattaagttgcccaaaccattattcaaatgaagacaccaagactaaataggtaataaaaaccgagcatctttgtaatttctatttatttttatttatatatagttgttttaataataacaatcatctttatgaggtattatagttgtttgttcttctttatctactggatacaattttttatacttttcaaagacactttcgcagacgtcttttttttttttttttttttttttgagactgggtttcattcttgttgcccaggctggagtgcaatggtgtggtcccagctcactgcaacctccgcctcctgggttcaagcagttcttttgcctcagcctcccgagtagctgggattacaggtgtgcgccaccatgcccaactaatttttttgtatttttagtagagacgaggtttcaccgtgttggccaggcctgtctagaactcctgacctcaggtgatccacccgccacagcctcccaaagtgctgggattacaagtgtgagccaccatgtgcagcctcagatgtgttcttaattgattcttctacctagttcttggctacaatatattgtaactaggggtttacctatctatagctccctgaactatgggttcagcatatagtgggcactcaatattgctctatatctctgtgctctatatctttgctctatatctttgtgtatcattacaaactaagctggaatcagaacccaagttgtatgacttctagttcaagttgggtccagattgtgaaaacgtggacagccacactaagaaggctaggttttatccagaaggcaagaagaggttggtggaaaccctctgagcccctggagcaaattcatcaaactgacgtttatatgaagattcatttactgttggtaaacagggtagagatggtggcaagcaagagacaaaggtgcactggtaatggaaaaggaggatcatgtgtgggtaagattatgagggatgacttgaggggatgtggaagcaggagaggaagggaagtgtcagctaattctgagtttcaatccaatggaccaagagaatggagctgctgcaggaggtctggaaaaggcagaaggactcatcctaatcatgtgaaggtcatgatatgaccttcagatagaatataaacctgaattgagtattttgaaggaagtttttattttatactggtagcctcccaaatggggtgcactggatgatgtactggaatgtgggtagaaaataatagactttccaagtctgtatatttttagcttaaaagtaagaaattaggacatcagcaggaatggcagaggaaggatctccaaaaatatagtcctacataaaagcaacaaaaatactgacaaaagttgtcacaatcaacttctttggatggggaaattaactaaaggcttgtaacaatccaaggagtgtttaatcaagaaaaacagctgaatcttggtaagaatagcaagctttgtggcattttaacttgccatatacccatctccctcttctcagctccatgataatcttaaaagccaacagctgctcaaatcagggtgaaaaccagcagcctagcagccattggagggagcagatcagggttaaggctcccatgtcccacagttctcacattgtcattatttgacctgtctggcacttccctttaaactcccattctaagtacttatatttatttcacctgactcagaccttgctcagtgcaagtagactttttaaaaaacctggtatttatcaaaaacaatcagcaacatttatttagcatcacagctgactgaagaggcagtaacagttgagtgagcaagaagctgactaaaaatcttaagaggataagctgaggaaggagatcccctagtgggcactagaaacttccaacatatccctgggaatctgaaaggtcatgggtctgtgtagggctgtgtgcaacggcccagggcaatgcacgtgctcaggaaaggattgagaaggccctaagctctcacctctggctgaccttgaggctctgtggaagcagaaagtgaagcctaaggcagagttataaactgcatgcctgagcatgtaaggcctgtggccctcacacacatacacagagcccctcagtaaagtataagaaactcatttggtacaggcatttaaggaattgtataaagtatgttctctgaccacaatggaatgaaattataaataacaaaaggaaatgttgggaattcacagataggtggaaattatacaatatacttctaaataaccaaagaatcaaagaagatacttcaaaggagagtagaaaatattttgagatgaatgaaaatgaaaacagcatatccaaacttatgagaggcagctatagcaatgcttacagggaaatttataactataaacatttatattatttaatagaaaataagaaatctcaaatcaataacctaaccttacattttaggaaagtagaaaaagaagagaaaactaaacctaaagcaagcagaataaaataaataacagagattggaggggaaataaatgagataatagaaaaaaatagagaaaattagtgaaaccaaaagttagctttttgaaaagatcaacaaagttgacaaactttaggtggactgactaagtaacaaatagagaagattcaaagtaccaaaatcagaaactaagaggggacattactactgactttacggaaataaaatggagtgtagaatactatgaacagttgtatgccaacaaattagcccagatagatggacaaattcctttaaagacattgtattagtcagggttccctcaagaaacagaaccaataggagatatatatatatatatagagagagagagagagagagagagagagaaattatgtaaatataacttctcagcctccataattacctgagccaattcctcataataaatcttttcatatatatgaaagatatatgtatgaatatatgtttatatatttatataatatatattatatgaataggtattatatataatatatattatatgaatatatattatatataatatatattatatagaatatatattatatataatatatattatatgaatatatattatatgaatatatattatatataatatatattatatgaatatatatttatataatatatattatatgaatatatattatttattatgtattaaataaaatatttatctattaaaaatgaatatattatatctaatttatataattttatataatatataaaatataaattaaaaattatatataaatatataatttacatgtatatttatatatccatctatataatatatattcatatatatcttttatttatatgaaaatatttatatatagataatatatgatatatttatatatagataatatatgatatatttatatattacttatatgttatatattataaatatatgtatagatatatattttatgtgctatatataaataatatataaaattgtatattatatattatatatttatatatctatctttcatatatatatatgaaaagatttattatgaggaattgactcaagtaattacggaggctgagaatttccacaatctgcaagctggatacccaggaaagctggctatgtaattcccatccaagtctgaaggcctcagaatcagaggagccaatggtgttaatggtagtaaaagggtaagagcagaccgagattccaacagaagcagaaaagcaagaatcaaaaggcatgaattctttttccatctgtctcttgatctcctctggccctcaatggattagatgatgcccagcaacattggggagggcaatctactttagtgaatccacgaattcaaatgctaatctcatccagaaaacccctcacagacacactcagaaacaatattaaactgggcacctcttggcccagtcagattgatacatacgattaatggtattgtattaaagacacaaactcccaaaactgcttctagaaagagctgaaattctaaatagagcaataacaagtaaagagattaatttagcaatcaataatcttcccacaaagaaaagccctggcccagtggctttgctaattagttctaccatccgcaatagaattaacaccaattcttcacatacttttccccaaaaatagataggagaaaggaatacagttatgtgttgcataatgacatttcagtcaacaacagattgcagcatgatggtggtcccgtaagattataatggagctgaaaaattcctatcaccaaatgatgtcacagtcatacccatggcatggtacaattattttatttttaaataaatttaaaaatttaatgtagcctaagtgcgcagtgtttataaagtccacagtagtgtacagtaatagtttagaccttcacatttattcaccactcacacccagagcaacttcattcatggtaagtgctctatgtaagtgtatctttttttttttttttttttttttgagacggagtctcgctctgtcgcccaggctggagtgcagtggcgcaatcttggctcactgcaagctccgcctcccaggttcatgccattctcctgcctcagcctcccgagtagctgggactgcaggcgcccatcgccgcacctggctaatttttttttgtatttttttagtggagatggggtttcactgtgttagtcaggatggtctctatctcctgacctcgtgatccacccacctcggcctcccaaagtgctgggattacaggcgtgagccaccgtgcccagctggttaagtgtatcatttttgatctcttataccatgtttttaccatgctttttctatgcttagattcacaaatacttgccattaagttacacttgcctacagtattcagtatagtatcatgctgtacaggtttgtagcctaggagcaataatctataccatatagcctgggtatgtagtagactatatgatttgtgtagtaggtttgtgtaattacactttatgatgttcaaacaatgacaaaatcacccaatgacacatttctctcacattctcattaagcaatgtattactatacttcccaacacattctaagagtccagtattatcctgataccaataccaaggtcattataagaaaagaaaaggaccaggcatggtggctcacacctgtaattccagcactttgggaggctgaggcaggtggatcacgaggtcaagagatcgagaccatcctggccaacatggtgaaaccccatctctactaaaaatgcaaaaattagctgggcgtggtggcatgcacctgtagtcccagctactcgggaggctgaggcacgagaatcgcttgaacccgggaggctgaggttgcagtgagccaagattgcaccactgcactccagcctggtgacagagtgagactccgtctcaaaagaaaagaaaagaaagccacagatcaatcagatcaatattccttgtgaatgtaccacagaattcctcagtgaaatactactaaactgaatccaacaatataaaaaggattatacatcatgaccaaatgggatttttcccaggaatgcatggttggttttaacatctgaaaatcagtcagtgtaatgcatcatgttaatagaacaaaggacaaaaaccacacataatcatctcattgacacagaaaaattatttggcaaaatcccaaacactttcataattaaaacaaaacaaaaaaacctcaacaaacttggaatacacaggaacttcctcagccatgtaaatggtatgtgtagatgtcacatataagctgacatcatacttaatggtgaaagactgaaagctttcccctctatgatcagtgatgagatgagaaagttcacttttgtcaacatcgtactggaggttttagccacaacagttgagcaagaaaaatatacattttttaaagggaaaggaacaggaagagtaaaactacctctttttatagatgacatgatcttgtatgcaggaaattctaagaaattcacacatactattacagataataaattagtctagcagtgtttcaagatacaagatgagtatacaaaaatcaattcacttttatactctagcaatgagtaaactgaaaatgaaattaagaaaacaattcgatttaaaatagcatcaaaagaattaaatatttaggaataaatttaataaaggtagtggaagatacctacgctgaaaataataaaaccttgaaagagattaaggaagatataaataaataaatactctgtgttaatggattgaaagacttagcattgttaagatggcagtactctccaaatttacctatacattcaacacaatccctaccaaaaccccaactacctttttgaaaaaattgacaagctaatctgaaagttcatgtgaaatttcaaggcatttagcattgccaaaacaatcttgaataagaacaaattggaggtgtcacatacgtgatttcaaaacttgcagtaaacccacaataatagtgtgctactgacataaagttagacttacaggtcaactgaatagagtcgagaatctaaaaataattcttatgattatggtcaattaaatttcagcaaggtggtgccaaaacaattcaatggagaaagaatagtcttttcagcaaatggtgctagaaaaactagatatccacttgcaaaaaaaaaaaaaaaaaaaaaaaaaaaaaaaaaaaaaagaagttgaacccctacctcataccatatacaaaaattcactcaatatggatcaaaggcctaaatgtaaaaactaaaactatacatttcccggaagaaaataataggcataaatcattgtgacaatggcttcttggattttacaccaaaagcacaagcaaacatataaaaatagataatttagatttcatcaaacatgaaagcttgaaagcctttgtgctccaatgaacattatcaaggaagtgaaaacaccccacagaatgagagaaaaccatttgcaaatcatatgtataaggtactagtgtacagaatatgtaaagaattcctacaattcagtaataaaaataaaaataactcaaaaaataaaaaatgggcaaagcagctaaacaggtatttttctaaagaagatattcaactggatgataagtacataaaagaaaactcaatatcactagtcactagaaattcaactcaaacccacaatacaacctcacagcttcacattcactaggatggccataataataataataataataaagtattggcaaggatgtgtaaatagtggaaccctaacacattactgttgggaatgaaaaatggtactgcttctttggaaagccagtttggcatttctgcaaaagttaaatatagttagcctataacccagcagttctactccttaacatttacccaaatattaaaaacaaatgtccacacaaaaatctgtacatgaatgtttatagcagcattattcagaatagccaaaaagtggaaacaacccaatgtccattaactgatgaatgtataaacaaaatggggtgtatccatacagtggagtattatttagatgtaaaaaggcatgaactgacatatactacatcacagatgaacctcgaagaccttacactaagtgaaagaagccaggcacaaaaggccacatattgtctggtttcatttttataaaatgtcttcaataggcaaatccatagagccagttggtagaataatagggtgtagaggagagtggaatggggtgtaactgttaatgagtgtggggtttttttgggggagtgataaaaatgtcttaaaattaggtggtggtgatggttgtacggccttgtgaatgtactacttataaaacatactgatttgtacactttaaagacgagaattttgtagtataaaatttataaattgtaagaatttttaaatgatttggaaactttaaatacaaatttaaaatattgacaagttaaaatagtgacaagtttttagtacatgtatataatttcaaaataggcatatgtacatatattggtgttgtgtgttcagtaatttttcactgatggtctgctcaacctacaaaacttttgtaagcaactttagacaaaagatatgtacatcaccaataatgaatacttccaaaagttgcatctcattgtatctaggacagagatttgccagagtattatctctgtctctattttctaatggcctaaaatgaagatgatagtgaattagtaaatttataaaagatatatcgataaaataaaatcgggaaaatcattcagcgctggcagtggcttgtaaaaatgcgcaggtgaggatatagggcaaaacagcttattattgagtttctcaacagtaaaaatgtcctgagcttattataaagtatttcctttggctctggacccttttcttgcctttgcctattcaagggtgcaaattggtttttaacacaagaattaatttcaatgctaagcctgtttatgaaaagatttccaagtaccttgggaacagtcaaaataaggcatctcagtggggaaaatgttcatatgctagacagagagcaaagattaattacataatgcctgtttctaaagtacaaggttgtattgttggctttgtttttgtatatgtagtggttttaaatacatgaactagctaatctctaattggatagagaaatatagttctctactgttttaattatttagaataacaaaactgctgctatgaatatgttaaaattcctgaaaagaaaaccagcagctattagtatataattatctgatataccagtcttcagagatttaatgtttaatttaaagcatttctttgttgtttttataatttttgttaattttggtattttagcagccaatttagtataatttaagataagggccagaagttttcaatcaggattagatacgtacatatactaagtgctacaaggaacgaaagcctgtaacaattcttgatgtcctttcacgaaatttccttataaatattgagtctattgtattgaatttctcttctttttttaattatactttaagttctggggtacatgtgcagaacgtgcagttttgttacataggtatacacatgccatggtggtttgctgcacccatcaacccatcacttacattagagatttttcctaatgctatccctcccctagcctcccatccccgcaacaggccccggtgtgtgatgcacacaccaatgttcacaacaggtatgtcctgggatctgaataaatctccaggttctcagatacctccatggcattatgtaatttgggactctttcttatacttgttcatctatttcttcacattaatgcttatgtatgctcctggcttgctcatattttcttcaaaaagcatatgtttctctagtatatcctcataacataaattaacatcaccaacctttgtacctattacatgtcaaggcagtttttttcacagaataaagtactggctgaaatattttctctatttgttttttcttctttccgtatagagttcatggtgaatttattcacatcataaatgggtgtccccatagcatttgacaggccacactcgcatttgtccaaaatgtctactttctggctaggaaccattatctttcttttagatcatgttactggaaccaactgttaggtctcttcccaaggccatttttcacaaagaaataaagatttaattacttcgtaagagttattgcatagtcaaggatgagtgggaagtaggtatggactgtgggctgacaggatgtcttactaattgatgttttgctgatactctgtaggcctgctttggcatggcacatagatgtgctttagaaaattacgaatatgacatgtcctaaaccttcaagctgctaaaagctagtcagtatcattaatcttaaaaaaattaattttgaaataatctcaaatttatagaacagcttccaggactgccatatatccttcatcctaatttcacagatgttataataattttactttctttgctttatcattctctctcaatagaaagatacattcatatatagatgtagggatttttttttttaccctgagtcattttggaataagttgcagccatgataccaatttccccctaaatatgtatgtggtttctgagaaaacaaggacattctcttaatcaagtatagttcaaatatcaaaataaatgaacattgatataatactattatccagtttatagaccttattgaaatattgccagttgtcttaggaatgtacttcatagcaaaagaggaaaaaaggctttttcctaggctagaattcagctcacaataatttgtgacattgtcacatgtctttattttcctttaatctgaaattatctttcaatcattttgattttggggggtggcagagctttcatgatcttgatgtttttgaatagtacaggccagttgctctatagactgtccctcaatttgggtatgtccattattttctcatgattagatttagcttatgcttttttggagcagtatcacagaagtgaggttgtgttcttacggtaacatagcaggaacaaccttactggttatattaactttgatcacttagtgaaggtggtgtctgccagaattctccactatttttcccttcataattaatagtattttgtaggaaaacactttaggtgtatataagtatcctgcttcttatcaaccattgacctcctggttttagcatgcgttaattattctgtgaatcaattatcatgatagttaccaaatgctgactttgtgattccatcatttttttctatatttattagtttcttttaaattaattagttggaattctactgtaaggaaagttttccctttttccccatttatgtatttatattagtatggacttacagctgcttctcttatttagtgagttaagatcttggagttcagcttgcccagatttggccaatgagggccttttaaaggtggcttgatgatttttggacatgtccccgctaatcatcttcttttactggcacaacaaggtgtcccagactcatatattcccaacactagccctgcaatcagccatttcttcaaggaacctaggttattttagcgaaaaatggtatttataaagcaaaatctgggtgctagatgtgatcattgctactagaatatcactactttgggcctttgtacacacacacaaacctattctctctctttcttgtcatgtggatatctccaattccaatcccacagcataggattccttctagctatccctctttttatgtttatagctcctttctttcacagtgagaaacacggctcccattatccgcagcatatttatgtatatcctcaaccttttaatacacagaaaataggtttgggattgctggcccataccaccatgaaaaatgaatctacttactagagtttaacacttgcttatagtgttttgcctttagcctaagggtatacactcaaatgtctgtaatcaaaagtagtttgattacattgttaacttgatttgcttggattatgttattaacttcattaggtttggttcatttactttggtttatattacatttcagagttttttttaattattcagcctttattttattttatttcattattattatactttaagttttagggtacatgtgcacaatgtgcaggttagttacatatgtatacatgtgccatgctggtgtgctgcacccattaactcgtcatttagcattaggtatatctcccacggctatccctcccccctccccccaccccacaacagtccccagagtgtgatgttccccttcctgtgtccgtgtgttctcattgttcagttcccacctatgagtgagaatatgtggtgtttggttttttgttcttgcgatagtttactgagaatggtgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaagtggtgtgagatggtatctcattgtgtttttgatttgcatttctctgatagccagtgatggtgagcattttttcatgtgttttttggctgcataaatgtcttcttttgagaagtgtctgttcatgtcctttgcccactttttgatggggttgtttgtttttttcttgtcaatttgtttgagttcattgtagattctggatattagccctttgtcagatgagtaggttgcgaaaattttctcccattctgtaggttgcctgttcactctgatggtagtttcttttgctgtgcagaagctctttagtttaattagatccaatttgtcaattttggcttttgttgctattgcttttggtgttttagacatgaagtccttgcccatacctatgtcctgaatggtaatgcctaggttttcttctagggtttttatggttttaggtctaacgtttaagtctttaatccatcttgaattaatttttgtataaggtgtaaagaagggatccagtttcagctttctccatatggctagccagttttcccagcaccatttattgaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcaatgcgggctcttttttggttccatgtgaactttaaagtagttttttccaattctgtgaagaaagtcattggtagcttgatggggatggcattgaatctataaattaccttgtgcagtatggccattttcatgatattgattcttcctacccatgagcatggaatattcttccatttctttgtatcctcttttatttccttgagcagtggtttgtagttctccttgaagaggtccttcacgtcccttgtaagttggattcctaggtattttattctctttgaagcaattgtgaatgggagttcactcatgatttgggtttctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctctttttattttgagatatgtcccatcaatacctaatttattgagagtttttagcaagaagagttgttgaattttgtcaaaggccttttctgcatctattgagataatcacgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattgttctaaaattctcttttttggttgtgtctctgcccggctttggtatcaggatgatgctggcctcataaaatgagttagggaggattccctctttttctattgattggaatagtttcagaaggaatggtaccagttcctccttatacctctggtagtattcggctgtgaatccatctggtcctggactctttttggttggtaaactattgattattgccacaatttcagagcctcttattggtctgttcagagattcaacttcttcctggtttagtcttcgaagggtgtatatgttgaggaatttatccatttcttctagattttctagtttatttgcgtagcggtgtttgtagtattctctgatgttagtttgtatttctgtgggatcgatggtgatatcccctttatcattttttattgcgtctatttaattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtatcaattttggatctttcctgctttctcttgtgggcatttagtgctataaatttccctctacacactgctttgaatgtgtcccagagattctggtatgttgtgtctttgttctcattggtttcaaagaacatttttatttctgccttcatttcgttatgtacccagtagtcattcaggagcaggttgttcagtttccatgtagttgagcagttttgagtgagtttcttaatcctgagttctactttgattgcactatggtctgagagatagtttgttataatttcttatcttttacatttgctgaggagagctttacttccaactatgtggtcaattttggaataggtgtggtgtgatgctgaaaaaaaatgtatattctgttgatttggggtggagagttctgtagatgtctattaggtccgcttggtgcagagctgagttcaattcctgggtatccttgttaactttctatctcgttgatctgtctaatgttgacagggggtgttaaagtctcccattattattgtgtgggagtctaagtctctttgcaggtcactcaggacttgctttatgaatctgggtgctcctgtattgggtgcatatatatttaggatagttagctcttcttgttgaattgatccctttaccattatgtaatggccttctttgtctcttttgatctttgttagtttacagtctgttttatcagagactaggattgcaacccctgccttttttttgttttccatttgcttggtagatcttcctgcctccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgtagttacttcctagcctcagtggtctttataatttggcattggcatgattttgcagtggctggtaccagctgttcctatccatgtttagtgcttccttcaggagctcttttagggcaggcctggaggtgacaaaatgtctcagcatttgcttgtctgtaaagtattttatttttccttcacttatgaagcttagtttggctggatatgaaattctgggttgaaaattcttttctttaagaatgttgaatattggcccccactctcttctggcttgtagagtttctgctgagagatccgctgttagtctgatgggcttccctttgtgggtaacccgacctttctctctggctgcccttaacattttttccttcatttcaactttgctgaatctgacaattatgtgccttggagttgctcttctcgaggagtatctttgtggcgttctctgtatttcctgaatctgaatgttggcctgccttgctagattggggaagttctcctggataatatcctgcagagtgttttccaacttggttccattctccctgtcactttcaggtacactaatcagacgtagatttggtcttttcacatagtcccatatttcttggaggctttgtttgtttctttttattcttttttctctaaacttcccttctcgcttcatttcattcattttgtcttccatcactgataccctttcttccagttgatcgcatcggctcttgaggcttctgcgttcttcatgtagttctcgagccttggctttcagctccgtcagctcctttaagcacttctctgtattggttattccagttatacattcgtctgaatttttttcaaagttttcaacttctttgcctttggtttgaatttcctcctgtagctcggagtagtttgatcgtctgaagtcttcttctctcaactcgtcaaagtcattctccgtccagctttgttccgttgctggtgaggagctgcattcctttggaggaggagaggcgctctgctttttagagtttccggtttttctgctctgttttttccccatctttgtggttttatgtacttttggtctttgatgatggtgatgtacagatgggtttttggtgtggatgtcctttctgtttgttagttttccttctaacagacaggactctcagctgcagttctgttggagtttgctagaggtccactccagaccctgtttgcctgggtaccagcagcggtggctgcagaacagtggatttttgtgaaccgcgaatactgctgtctgaacatttctctggaagttttgtctcagaggagtacccggccgtgtgaggtgtcagtctgcacctacgggggggtgcctcccagttagcttctcagggatcaggggtcagggacccacttgaggcagtctgcccgttctcagatctccagctgcgtgctgggagaaccactgctctcttcaaagctatcagacagggacatttaagtctgcagaggttactgctgtctttttgtttgtctgtgccctgcccccagaggtggggcctacagaggcaggcaggcctccttgagctgtggtgggctccacccagttcaagcttcctggctgctttgtttacctaagcaagcctgggcaatggcaggcgcccctcccccagcctcgctgccaccttgcagtttgatctcagactgctgtgctagcaatcagcgagactccgtgggcgtgggagcctccaagccatgtgcgggatataatctcctggtgcgccattttttaagcctgttggaaaagcgcagtattagggtgggagtgacccgattttccaggtgccatctgtcacccctttctttgactaggaaggggaactctcagggttttgttttttttttaaatctctcttgattatttttttgaatgcatgaactatgcttccaatagccagaactatacaaaaaacatatttaaataaatgccattcctctatactttcagtttctaccccaaccatctttttcaccctgtacttatccatcccctattggtaaccaatttcatcagtttctaggttaatcttgttgtgtttcttcttggaaaaatgctcagatagttgtatattttcttatttctcctgatctctttcacaaaaaaatatactgcatattctcttgttcaccttgccttttccatttaacagaatatcctggaaatcactccctattaattcacagagatcttcatttctcgtaacactgcatagtcttccatatgtggatttgcgtttattcaatcactgtgttatgaatgggcaattagattgtcttcaacaaccattatatgcttctaacggaactacatacaatgggtaactgtgtatatattaatatatatacatatattcttatttgttgaaggtatatatttagcataaatttctagagtgggattgctgagtcaggaggtaaacacataggtagctttgttagatattgctaaatgacccttcaaaaaatttgtatgaatttgcattttcatcaccaatatatgagagagtctgtcttcaacccattctcactaacagaatatgttgtcgtactttttattttttgccaatcttatagataacaaatggtttctcaacgtcatttttatttgcattcctataattatgagtcaagatggatatcttttcaaatgtatcttttgtgtgtgtgaattgtctattcatgtgttttgcccatttttctattaagattttgattttcttttcccttcaattatttagagttctttatatgttaggattatcacctctttatctgtgacatgtactgaaaatactttctcccagtttgtcttctgccttttgttttttgcttgtcgtgttttgtgtcatgcaaacgtgttgttatttttttaatctaaccaatttacaaatctttttttttttttttttgcctctggatacttacaaaatctttcttacatttgaagtatagaggaattcacccttgctttcttctaacacttgtctggtttcatttgcttacatttttatctctgatccatttggagtttattcttgttaaaaaaaatttggagttttatctttttcaggtggctatggaactgtactagcacctttttattgaaaaggccttgtccttatcatttgagctgtttcctttatcatatacaaattttccttatgtatttgcatctctttttggactttctatcccattcactggtgtatctgtctatttatctgctagatctgcactgttttaattatacagactttatagtatgtgttaatatctgatagggctggcctggcacggtggctcatgcctgtaatcccagcactttgggaggccgaggtgggcggatcacgaggtcaggaggtcgagaccatcctggctaacatggtgaaaccctgtctctattaaaaatgcaaaaaaaaaaaaaattagcaaggcgtggtggtgggcgcctgtagtcccagctacttgggaggctgaagcaggagaatggcgtgaacccgggaggcggagcttgcagtgagtcgagatcacgccactgcactccagcctgggtgacagagcgagactccatctcaaaaaaaaaaaaaaaaaaagtctgatagggctaatgactcatagcttttctcttccatttttctcaatttattcttgcatgtttatttttccatacaaactacaggttatctaactccatgagaacttgttggcatttttaccattacattaccttatattacattacattaatgcgatctcatgtaatgtaatgagatcacattaaatttataaattaacctgggaagagttgacatatttctaatggtgaattgttctatcccagaacaagagcaatctttccatttgttcaagtctactcttgtgtcttgatagttttttaactttttctttataaaagttttgcacgtgaaccattaagtttatctcttttattttctttgttgtcattctaaatgaggctttgtctgtgattatattctctaagtggttattgttttgtgtatataaaggctattgatttctatatgttaatttatatcctgttattatatttaatatttttattatttgatataattttattactgattcttcaggtatgttttcacagtatctgcaagtgaagatgactttactttttatatgatttctcttatacaactatattggctgatacttccaaggcaatattaaatagtattgaaaatattatacccacatatgcatataaatatataatacatatattatatatattttcagcatgttaagaaagtattcatcatttcctactttcttcattgcttttatcaggagtggatactgaattgtgtcaaaagctttccagcatctgttaaaataattatattatttttctccctagattgatcaatataatgtctaataatggatttcctcatatgagcagacttgcatcctggaatgcatctcacttggtcatggtgtattattttcttagtgtatactaatcttaaataattatcaaagctctatggcagtgtcattcagaaacaatatcccctcggggacttactgaattgatttccgctgaatcagaattctgtgaagagtcacaggaatctgcttttaacaaattccatagaggtggtctttgtgcatgctgagaaccactggtctactatattgttcaatgtgaattttaatggaaattactgtaaaaaaatatttactttagcaaaggtcctgctccatgattcctttgaaaagctgctttgtatcttaaacttataaattctagatcatgatccagctgtaggagagtagatgatacagagaaattaaaaggtaaaatattttttagtttcagctgatacctgaatattcatttatccactcatacatttatttagctttttttagcactgtgaaaggatgagaaacaaaaatgtgtaagacccagttcctgtacaacagtagaataacttgaagattatataaatgtttgtaagatactaggcattatttagaaatgttttccaggaattttataggtctgaggggcttaaaaaaggaaatggatcagaaaagacttaaaaaaggaggtgattcttcagatgaagtgtctttccaatataacattaacaaatgggggaataaattgcaaaaacctcatttacatgaaacgttttagaaatgcatctcttacacatggtgtactagtataccaacatttcaactctcatcaaacacagctatacaacatcactcatatatatatgaggggagagctatctctaaatggaggcatctctatacataacctatgaatgaatttctttccaagatacccaaacttaatagaaacactgaataacatcagtagcaaaatagaaaccatcagtaataaatggaaacttcagtaaatgggagatgaactgccacccttctattagtatgcttcaaattctcttaaagacaaaaaaaaatgtatgctctctttctatgagaatttgtgatagtttggttccactccatttattcttggtatcagacttgcttatccaagacaactgctgtgtgggagaaagaccataaaaatcctgtgactaacactcacaacaggggtcatgattatgacttggcttagtatggaatgtatttcttcttatcatgtgaatggcccccatgtgattagagggatggcaatattttgaagtacaaacctggtgctgcttgctctgaagaaaattctaagtctaatgtagtaaggattcttctgtttcctaattttaatgatctaaagggaggagtggtttttcattgccaacatttttatttacccaaagtctgcagaatttaactgatgcttcacgctgaatatgctacaaatgatgtagcatcaggtggtttggcacacaccttgcatctgattcaaactgcagcaagtgtcaagcaggatagaagcaaatgtcacactgaagtcttggttaatctattccagctcagttttaaccatcactcttcagtagttaactcatcaaatcattaaaataaaatgttcatatatgaatagctttttggattgccttagcaaagggaagacagaaaacacttcaattaaaaaaaaaatatatataatatatatatatatatatatatatatagagagagagagagagagagagagaaagccattcagactgacaatatgaaattcagatatcaaaaataaatcctggatgaattctgaaatagaaaacatatacatataatatacaatctattctgaacagtctaagtagtatgttttgagaaacaataagatttaatgtacgtttattgagcttggtcatattaattttaataatttctttttaaatttgcagttggtaatcagtggataaattacatatcattctgtggtcttagaacacatgcagagctcgaaggaaacctagtaactgagcttatctatgtccacagcaagttgttaattgctgatgataacactgttattattggtaagtacagtatatggtctataattgtattccttgccagttgacttaccccatgcaaaaatgtttgctgctattcctcctaagcatcctttgcatttgaaacagacagtaacaccataactaaaacatttctgaagccatcctcttctcttacatcctttctaacccagttgttgaaattgttataggtacagaataggtgtatatattcatggggtacatacgatgttttgatacagtcatacaatgtataacaatcacatcagggcaattgcagtacctatcacttcaagcatttatcatctctttgtgaactaaactatttttatctgtgaagaatcagaggtacagagcaattaaatggacttcgtgaaaattgcagaatccagaggcagctgtttaacccagcagtccaataatgtgccagatttcactaattctttattactcccttttttttttaatttttaaaactatttttgagatgggggtctcgctgtgtttcccaggctggtctcaaatgattcttctacctcagtctcccgtgtgctgggattacaggcccgagccaccacacccagctatccccttatttttatttacaatccaagtgcccagatttcagggattggtgggggataaatggggagggaaagtgtgtcataagtgagtaccttgtggtaattcgtatgtgtttataccacatccacctaaccattaccacagatctgaagttgtacaaaagtcgaaatcagaaggatggtaaaatattgctgcctctatgcattaccactatttttcctaacatgcatgttttccatgtcattaattaggatgtagagcagtccaactttgttgatgtgtatggatgaagtgggaattgtgtactaatgataggatgtagccctgcactaaggtctgcagtcatttcttgtcaaggatacacaggagacttttccaaaggcctcttcccactgacaaattcaggagagttactctcctaaataacttgtacattctacccaaattagattagcttgacaagagaggtagatgttcagcttcattcttttatatacatagaaagcttcattcttccatcattgaattattttgacttctaatattaatattatataaaatgagtattggaagtccaggatgatagagtataaataatcaaccaggtaaatgaggtaaccagtgtgggtcatgttatttagagagatgatgtgtcctactaatgggaattctgctcatctgtttcaaatgaaatgtagtttatcagctataataagatactttcctattattcaagaaactaaatgtcatggagtgttttgaaaattttggacaataaatatgctttctattctccactgagaaaagaaaacatatctcatatctgagaagaataaaactgtcttatctggaacatgatttgaatagaaaagaaacatagttctgaagccagaaactgtgtaaaccacagtgtggtgagatacatacacacacacacacacacacgcacacacacttttaatatttgtatagcacattaaaataatattgttcctttatctcctcgtctatagccagaaactgtgtaaaccacagtatggtgagatacacacacacacacacacacacacacacacacacacatacacacttttaatatttgtatagcacatttaaaaaatactgttcttttatctcctggcctatagggataaaagctctttaggagtttatttattcccccatttgccctaatactcaagatttcatttatttctcctgagctactctgacttgctcttcaaaagcaaatctcagaatactttggaattaaatttgacaatgacagtaagaaataaaaactattgatgtttgctgaaatggaaaaataaacaaagccacatatttcttcaccaagatttcagaagccttgaagtaaaaactgacagatgtaaatatttttttgaaaggtcattttgactttcagcctcgtttactttacatgaagtataaatacaaattagtttttggtaacagagctaacagttaaataaatttgttgaggtttttaattgacttattttctggaaaagtctctaaacactcaaagactccaatttattttgtttagcaatacttgatcaattttgcacacaattcttacacattctcttgaaactgaggatatggccctgggagtctaaagaggtcttacttgctagtccttggaggctggattccttttttccttccccaagtgccttagagaatcgatttctcccaaggaaaaaatccagagtttcttttgttctttttatctcggtggaaactcaagaataagcaggtttattgttactgttctaacacattcaccctatttaagttcctaacacagaaaacagtgtttaaaattctcagagacgagtttgagaagttaggttgagaatattttataggtgttaaggaagtatttaaacatttaaaggaggtttaagtaatgtatgattaatttttcttccatggcaaacttatgccagaatgattgaatagctgacataagaaaaatgaccatttatcttcattttactcctcatgaggaaatatttgttttctcacactgaagatctcttttgtgcatagctttaattgcctgtggccctgggtaaccctgctggtcatgaaatctgtgaccaaatccagttttcttacctatcttaattttagcctttaaccagacacacatatatttggtttccaaaacaaagccaagctccccttcaagtagattttaagcctatcctgatgactaagtgaaacggttgtttttaatgttcactaacccactgcaaagcacaatagagagatgcgaaacgtgagtaaaacagcgccactgccctcccagagatcactggctggaggagaggcagctactccttccatatgagagcagaaacactaggatggatgttgccaaaccagaacaagaaggttcaggggcaatcaacaagtgtgggtaggaggagaaactaagtcgagctcatgagtctcaggatttaaagagcaggcttcactgtggcagatgagaggctggagttgaagggctgccccagtaaagagggggatatttcctcatgtctgcaatttgcttttaaatggatcaaaacaaaaatataaattaacaatggatacagggatggagtggtataccaatgcctggttcttatttctagaaattatgatctagttggtctggtttggggccaggcatttgggtttttttggttttgtttttggcatcagtattttttaaaaagcttccttgttagctttcctaggtaatgctcatatgtggtcagagctgagaacttctgacctggaggcaaaggaaatacaagtaggcagaaaagacagagtagcccagtgtgctcaatagaagaaccagttttccttcaaaacaaactaaaacggggtagagttcgtgcgttcgtttcccattactgctgtaacaaatgaccacaaacttagtagcttaaaacaacacaaatttattatctgacacttcagtaggttagaaattcagcgtgagtcccacaggactaaaatcagagtgtgagcagggctgttgcattcttttagaggccgttagggagagtccatttccttgtttctagaggctgcctgcattccttggctcacagccccttcttccacctttaaagtcagcaacattctatctctgaaaatccccaaaagtctcaacccattcttctgtaatcataactcagtctgactccctttcacttttacagatcttatgattgtattgggtccacctgtataatccaggctactcactctatttttaaagttagctgattagcaaccttaattccatatacagccttagttcgcctttgccattgaacatatattcacagttttcggagatttgaacacggacattttggagagctgctattctgcataccacacaaggattcacaatttctaagtgagacacacaaaataagcacaaaccacaaaggaaagataaatccaactgcattaaaattcagaaatttcttcattaaaaggtactgtaaagagaataaaaagataaaccacaaactgaaatatttgcaacccatttaatacacagaacacataaagaactcctataaatcaataagaaaaaacaaatgtccaaagaaaaatgggcaaagaaattgtataggaacttcatcaaaaagaacatacccaagcctcataagcatgtgaaaaaatgttgcttctcattaacatgagacaaataagagtttttaaaaataccagactggcaaacagttaaaagttgggcaatctaagtattggcatggctgtggagcaatacagactcccctccactgctgttgggagtgtaagttggaaaacattctggtgttacctagtaaagtcatacaccctgcagcttagcaacccacgcctacatacagagcctaagaaactcacacatgtctataccaagaaacaaatactcagctatgtagagcagaattgtgcatcacagcaaaactctggaagcaacccaaacatccatcaatagcagaataaataaagaaatccctagtgtgttcattcaaggaaaagaaatgcattacaattatgtacagaaaaatctcaaagacataagactgaatgaaagaagcaaatctcaaaggactatctgatatatgattccacttatataaattaaaaacaagtcagaagtaaactctttttttgttgtttaggaaaacattcagagcatgatgaacacaaagttaaacatcaagtcttcctcttggggagggaagggtatgcatgggaaggtgcacaaagccttctgggatgtggtaatattgtttttggccagggtaataaattcagtgatgactattttattattgcttaagttttacacacatattttcatatagccttttgtattttgccatattcacaatttttagaatgttttctaatagcactcagaacaggtcatataaacaagaaggatgcttatagagtaaaagaccaaaattccccttattttcttctctctcttcactgaaaagcacctactattgttaacagttcagtgtgtatctttctagatctcttgttctgtcttcttcctcatatgttgtataaaaatagggtaatactacaactgttcttctgaatttgattttcagaatacaggaacaaatggagggagcatttacatccatcatatcttattatatctaatttattcattcatctaaaattttctcatttctttcctcacatgcctattaaatagcagccaacacacttatttaatgtggtggagagtcagttatctgggtaattccatgttggcccttaaaatacaagaacgacaccctctgtctaataattccagctcagaatgctggaaatgtattcctcacctcgggagtgtcggggcccactgtggtgggagaggaatgggggcgcgtgggagaatgtgtgtgcggagggggctttccaggctggctcacatcccaggttctcctgacccgaaacaaagcagtgatgtcagttcaatccagcagcccccgcctgacagcggcctctgctggctccaggggcacagtaaaagtcctaaagtagcaatatgggatcttcaatctttgagctcctacagttcacacatggggcgattaagccagagaggaggcttctttaaacaaatgctacattccatcaaatggtcggttcctatggcagcattctccggtgcagttattgtagagttaacaaggatctgataataatgccagtaataattaacatttgtagagcagcttgtaaatcattaagtgctttcacatggtcttacttaattcccacaatatccctacaaggtctatattattatctcaatttatgaaagattatattaaagctgagaaagattaagtgaattgcccaaattaatgttggggcaactgtcaagctcaaagatatagctgcaaattttatagcataaccacgatgtaagtctatgtataaaggatgatttggtgctaacaaaacaaagtgtttcaaaggttcccacttttcagcagcactccagtagcattctcacatttctgtagggtgctcgatcctttctctgttacccagggccaccatggggaaacactcacatccatagtcatcatagatttatatattaaccacatgacaatattctggcaacaggcagtaaagtctcttcaggaaagggcagcttttctcattcatctcaccatttgagctctggtagggctgctgtcaccttatagctctggctgctccagtcagagggccgccagggtgcctgttcaacctgacccttctgctccacgtctgaagaagcagtggagttgttgcagctagagcaagaggaacaagaagagtcagtcaggccctttctgtagtttgcaggacacctcaaggattcaaatgcatgaatctgcagagattaatgcaaaaaaacgtgatgaggttcctgaatacacagcagaggactgcagaaagcacaggttgaactaatagcaaaatatttgcccttcacatgtaaaagtcaacattctcagctcacttggatttaaaaaaaaaaatggactccttgaatgaaccaggtattgagctaataaagagaattaataattttaaaaaatagaatggaggaaagttgctacagaagctattggcatgctacacaagtgagggaggcaagaaagcagaaagcccaaagccacaaatgacaatctgtatttgagattatactctattaattatgaaggtactcttgagttttgacattcacagttatgtgactttgagttaaagcctacagagagcctgattcttaactccaaaagcaaagccatctttcctactgaactggtaggcatgccttttttcaagtgcttgatgattgtaacagttagaatcttttgtgccacaaggtagaaaactcaactagaagtgtgtgtgaaacaataaggaacaatgtagaaaataaggaaaatatattatttcacatgacagaaggtaagaatattcaaaggttggctaattcaatgacttaaagacccagaatctttcttcttttttaattgttatttttatgttttgtttagagatgaagtcttgctctttggcccaggctgaagtgcagtggtgcagttacagcccactgcaaatttgaaatcctaggctcaggcgatcctcctgcctcagcattccgagcagctgggactacaggcatgcgtcaccacactcagctaatttttaaaaactttttgtagagaccaggtctcgctatgttgtccaggctggtctcaaactcctggctttaagcgatcctcctgccttggcctctcaaagcactgggattacagacatgagccaccatgcctggctcttttttctacttagcattttctttaagcttttttgtttgttctctagtggttgtgaaatggctgcagcagctcctggaatcatgtcttcttccaacccttcaagccaagatatccaaaggatggaagagacagaatccattttttgtgtgtttatacaaaggggaaactctttctcagaagctttccttcatgtcacattggctagcaccatgtcaagagcccatttctaagccagtcactaataaaaataatgaaattaccatggctggcttagactgattaagattcacccctgggttagggagggccccacctccctaaaaacacatcttcccttgaaaacctggacaaaattacggttttgtttgcaaggatgaattgagttgggagggcaaccaacagtgtctgccacaacaggaaggttgttcagcctcactgtttctccttacaggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttaggtcagtccgccaaagtgtgtctctctgatgcatttccactgcagcagtcgctgggacccagccccgctagccctgagcacatgggtcatcctaggttcttcttcatctaaaacagtgtgtcccagaatataggatatgtaccaccagtagtatgcgaaatgactttaggtggtacatgaatattttttattttaatagctttttattactgtcacgtgcagtagaaaaaactgcagtggtgcagttacagctcattgcatccttgaattcctaggctcaagcaatcctcctggctcagcattccgagtagctgggactacaggcccgtgtcaccacacccagctaatttttaaaaattttttgtagataccgtgtctcgctgtgctgcccaggctggtctcaaactcctggctttaagtgatcctcctgccttggcctctcaaagcactgggattacagacgtgagccaattaaatactagtccttaactgaattaggactagaccaggtcaaaccctccagcttccatttaagtttttaaaatcaaattaattccagtaatacaaggatataataaaaattattgaaggggtatgccagtgactgctggtgtaaaatttaaatgtggaaacttctgttttcaggtctaaaatgactccaggtgtcgaagatccctgatctttggcaagaagatgcaaattttaaactaatctgtggtgaagcagagagaatactgggctaggaagctgggctcgtttcagctgtgcgatcctaaataagtccattcaataaagtgttatttagaactttcaagggctgcgctgtaactgtccacgtcccctgttgtgttttctcaacacagtggtccctctagaaccttctagatcatgttgcttctctgctcactactgtccaatggcttcttatctcacaaggaacaagtaatataatctcgtctcctttcactgtttcccttgctccctgcagacactcatttccccaccggctgtggaacaccctgactactctcccaactctaggcctttgtaggaagtccacagttttatgattctagaactatatttgccataatgcaattttggtgaggactgtatagtgggatgcagcaggtggccccgatatagttaagatcagtgcgttatgccctttcgggaagggcactgcgctgcagcctgttgttttctttgtgttaaatggtcccttttggaaactggctcacttgcagatgggcgcttagtgagcacttaactcccggcaaaggcagaggccacttcgctcattcctaccaatccagacttcggcttccaagaccaacataagcctcagttgtagagacattctgctgtctctgtctaagtagctcaaaaaatccatccctcaaaatctatcaataccttctaacaacttttattgctgtatttattgcctttgttactacttgatttgccagtaagaagattttcaaaccattgataattcaattagcttctaatggtaatttgttttgtttagcagaggagaatttaaaaattggtaccctgctaattaacccattgattgcctactgcggcatacataaaagacaaatacttccttttgtaagctggaatgtatgttatatcttttcagttccgtaagaacttaagaattctctttaaagtcatgagtttctttataactttttaaatgtgtaataattatagaaggtagaggtttttgattacagcacatttttatgtacaaatttggcaaatacagaaaaccagtaagaaaattaaattcatctgtaataccatcaccttgtgataacagttttaacatttggtatatgtcattccacttttttctatacatagatattaatatattgtattccctttttaaaacaaaattagaattttgcaggcctacatgttttttattatttaaacaatgttacacacattttccatgtcatcgagtattcttctacaatatgttaatggctacattatattttattgtatgtgtatgccataattcctttaatccctcattgtttggcagatatttttgctgatataaaaaaatgggtatgtttgtagataccttcttgttcaccttctttattgtctcctttgatctcttattatatcactggcaatattttagagggcttattccttctatcttgactgagtttatttaatcttcaccaatttgttagatttcacatggaatttcaccattttaattcacattttttagaattaaaaatgtgtttattagccatgtataatttttttcataaattgcctagtttatttgtatcctttgcccattacgatggaaggtttaactttctttttttattatttttatacaattaaggagtacaggtacagttttgttacctggatacattgtgtaggggtgaagtctgggcttttagtgtaactgtcacccaaatagtgtacattgtacccattaggtgatttctcatccttcactccacctctacccacccaccttttggagtctccaacgtcagttattccactctgtacatccatgtgtatgtactgttttgctcccacttataagtgagaacacgcagtatttaactttctgttatttcatttaggataatggcttccaactccatgcatgttgctacaaaatacatgatttcattcttatttatggctgagtagttttctctggtgtgtgtgtgtgtgtgtgtgtgtgtgtgtgtgtgtgtgtgtgtgtgttttctttatgtaattgtctgctcaggacatttaggttgattccaacactgtgctattgtgaatagtgctgtgataaacatacaagtgcaggtgtcatttttaggacaacttaggtagatacccagttgtgggattgttgtattgaatgatagttctatatttagctctttgagaagtgtccatactgtctcctatagaggttatactaatttctgttatcaccaacagtgtatatgcattcccttttctccacatcctcaccaacagctgttgttttttgactttttaataatagtcattctgattggtgtgaaatggtatcttgtgtggttttaatttgcatttatctgataattaatgatgttcagcatttttttatgtttgttggctgcttgtgtgtcttcttttcaaaaatgtcttttccattgtcttttgcccactttttaatggggttgttgtttaactttcttttaatgatttataagtattttaaatatgtgtaggatgcttattcctttgtcatatgtgttgcaaattttgtttgcctgttggcttttagtcatctttggagaatttgggggaaatttttcaattcttattaatcaaatcaatctgtttttttcttttttttccccacctgcctttttctgtatgcttagaatagcttcctcagcctaagattaaacatttacttgtgtcttctcctggtgcttgtttggttttactttttacaattaacatctgcagtgtattttagtgtaagaagtgaggtcggggtcctgactctttttctcaactaaccagatgatctggaaccttacgatacgtagtaggactcttcgcctctcttatctgcagtccacctttaagatacactgaatcactatctgttctggcttctcgctagtctctctgttatgccatattgaaagtctgtttacttgcatgccagtgtgataccatgtaattattgtggctgtgcattttaagactactttttgccataccacttcttcaaattagtattctttttcaaaataatcttggttattcataaacattaattcttccacatggactttagaattgtttactcacgttctctcaagttcttactagttttataaaattggaattatagcggatttatagatgaagaaaagaactgacacctttataatattgagtcatcttgttgaagaacaaggtatggacttcaatttatatgaatattttattgttcttcaataaagctttgggtttttattattggtggggaggaagattattctacagtaaataattcatttttttaatgctgatcttatgctaactttgtttctaggtgctttcttttacttcgcatttttcaaattgtgttaaagaggcagttgttcttcaataattattttcactttgccccaatggcaaacacagataatatatttaaaagcaccacaaaaacattgcgtcaattttagcctctttttattaggaaacattcccaaagataaatattgtggcctagactacaaccatttttttcacttaaaaaatgcagtttcactccattttccatctggcctattttaaaatagaaatagagagacttatttcaatgtgaaatcaattctaaatagagacagaatcaaacatgcactaaatttcacagctataagctgaacagttcaagtcctagaaaattatccaaactttgcagatataaccatcactcaagagaaaccattgtccacacaattaggactcagaatcatttaaagtgatagatatgaggaacggaaagaacagaaataattttttgtggttttcctactgtcccactttttttgatgaataagcaaatattaaataattttcattaaatacatcaacataaaattaaactagttttctctcaaactttagtcctcaaaagaacatccagagtacttcatattatttttactctgcatttaatataaatttcttataattaaaatactgccagggaaaataatatattgcctattttagacttatttaaatactttttctacaaacaagcccttacctgatagtttggtggacacattggcttatctcttgctctaatttaaaagcaaagttacagaaaaactctttctgctcaattttcagcttcttaaatctggcccaaatcaaaggtattataataattgacttactgtcatcatttgtactgtcattcacatttgatgcagtaaaattgtgctttgggtctcaattagcagccaatgtctatgtgcaaacatctcttaaatctttttttaaaaaaagttattctcgtgtagtctgaaggaggcacattatttgaagtggaaacagaactttgaggttataaaagtcaagaatcctagaaagcctatggtgccagatccattttaaaaaaatttttatacagtggaaaaagtgcagactaaaactaaaatgagtgtcctttaatatctacagacttgaactttttcgtgagttgataatgttggagaaaactgggaaaatattcatgcttaatagtgtatgttttggtacagcctttcttgcagtaatttgaatattctctgacccaggaattctaattctaaaatttcttctaatgaaataatcacagaaatgtacaaaatcacatatgatgaataaactgtgttcattgtaacactgtttataataatgaaaaattggaaattacccaaaagtccataatgaaataattggttcaataaatttcacgtgataggaaactctgcagccattaaaatgatgatgcaaatctacatttatttaaatacaaggagggtaacaatataatgatgtccagttgttaaagccggtggtcaattcttatctgaattggacagttctccttgacatacttctttgtgtggtttcaggattccacatcctctggcttttctccagcctcgctggttcctcctcctctcccttactgttgatatacacccggtcctcttctctgtctatactcacttatttggtgaactcagaaaaaaacattcagcctatgagcatgtgcatgaggacaattctcagatttatatctctaaacaagccttctctcccaaaccccagttccatttatctactgcctactcagcactgccacttgcatctttaatagatgtctcaacaggctcaaaatcgaattcctgatctcccacaaaccagctctacccacagaattccctatctcagctaaaggcgactacagctgtacattattatagttgctcaagacaaaaaccttgtagtcatctttgatgcctcactttttgacacaccctacattcactctatcagtaaaacctgttggctctatcttcatctccactgccacccaggcccaagccaccatcatacctcacctggattatgggagtagctcctaaatgggctccctgtttcaacccttgccccccagagtgtgttctcaatacagcagccgtattttaatatgtaagtcagattctgtcactcctctgcactgatgtctacactctccatttcacttaatataaaaaccaaagccttacaaggccaattttcctattgctctttccaaatagcacaggtcttcttggtattatttcagcctatcaagtatgtgggaaaagggctttgccctcagtttgagttctaactccattactagtgtgcctcgagactttagtttcctatctacagaatgagaatcatctgtcccgcctaccacacaggattaaggtggaagtgctttttaatcctaaagccttctctaagtacaagggttattataattttcaaatatcacttctaaaacttgtcttgtttgcttgagaattttttgttatgtctagtccgctgtttatgtgtggtcaattcagacaatagtttcttttatgtcaggcactctgaggatatgagagtagctaggtcatggtctctcaaataatttgcatatatatatttgcatatatagagatagatataatagacatatatcctgcaacaaactgctttatctcagttactcaatgtggaggtcacttgtatttcagggttgtccttggctatcttgatgacccaagtgaggacattcaggatccagtgagtgacaaattcttcaaggaggtgtgggtttcaacagcagctcgaaatgctacaatttatgacaaggtgaagttcacgtattcccctcctccgtttcttttcactgaatctcatcacaaaaagcatattgttatttctgcatattattggtacagggtattcttaataaacgtaaaaaagctaatacatgtccaggttgtaataaaatacctctttgtggaccctgaaaaacaaaggcaaaaagcattgtggattttggtttagaagaggctttagcagcattccagtctctcctgtgatgcaggaatcccatcagcagcatccttagcacctggttacccagcctttgtacatgtctagtgacaaagagaagaggggcagatggcataaaaaaacaagccacagctgagtccagcctagctcaccccgttgctggtgttataaccttgtgtatagtgacttaactttctgagtttctttttcctctcctataaattgggaggaatattcacaagggtagttatgaggacaaagaatagtctagtgaatggttttagcacatagtgtatagtaaacagtattcatccttatgatgaatcttgttaatattaataacaagacatgtcatttgttggacagctctagttttagaaaggtgttttaaaaccggctccatttgatgcataccaaatgcattgcctgtgaagtctatcctttggttataataaagaatgtaaaagagttaagagttgcgtaacagtagaacagcttacttcgaaaagtagctagttgcccatcagggaaaactattcaagctgtgttctagcccagactaattgaccatctgtgagaagttggataagtctgtgttcttcttcatgacttccagggacagacgtgaacctctttaaaaaaaaaaattagggaaaatacgcaatttttctcttagagccccttccagcagagaaacttattattcttaatgaaacatgtctactgtctgtataaccttgtttcttttctttctttccttttttttttttttttaattgacatggagtctcaccctgttgcccaggctggagtgcagtggcatgatctcggctcactgcaatttctacctcctgggttcaagtgattcccctgcctcagcctcccgagtagctgggcctacaggtgcccaccagcacacccagctaatttttgtattatgatacaggctggtcttgaactcctgacctcaagtgatccgcctgccttggcctctcaaagtgctaggattacaggcatgacccaatgcgcctgacccctgtataaccttatttcatccttatttcatggaccgaaggccatgatcaaataggtcatgtgcatagagtcattaaaatgtaattttacaaatgcagtgcacagccttatttgggtcctggatttgggggaaaacatctataaaagacattttggggataacaggataaatctgaatatgaagcataacttaaatgacattatataattaattttcttaggtgtgagaatagtgctgtgattatataggcacatgtccttattcttaagacatacctgcagagaagtattcaggggtgaagtgttatgatatccaaaactcattttcaaccagcaaagtaagtgttacatattaacaattgataatgctatgtaaaggtacagatatgagcctctttcaagaaaagttagggaaaatataatatgcaatattcctcttagaccagaagctccagtgaaattcagggatgattattatccaaaaaaaattaaccttaatgtggggtaacattagtgtaatttcttgccactaaccatgattttttaaatggaagcagatctatctgtttgtagcagatctatctattgttggttataagataaccaactcttaaatcaggtctgtgctgtaacataagactaataatatgtttcatacaacagaggtcttgtctgttggaataattattttccataaaggccatgtgctcgcttttaaacttttcactcatttttctatttatgctctaatcaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgtataccaaaatccatttcctttgtaacaagaatttaccagtaactgtgatctaggttgccaaaagttgtctgaatctccttattcttctctgatcttcatttatgcagccaatgtctagctggacctgccctcatcttgcagttcatacaggcactgtttgagagattgtttattattagatgttgtaatgctgcttcaagattcttcatggttacatgggatgcccctgctcatctggtcctgaagtagtaacattcacccaaatgaggatatagtcattattccttttcagtcactgtacgaacacggcagactttagcctacacagtagactgtgttaggcacttctggtaacattgacactgtatcttgacaccactaagcaacaggaaggaataaattccaatattgagacagagatttatttcattttgctcccaaaggcactgacaacatgagtccttgtgattaggcccacctgatcaaatgtaaaaacatgcatgggatatttgattacgtaacaaccagctaaaactgagagcacacagccttcggaaacccccaaggtgtcgaggaggatcagatccagataagagaagatgattccttctagtcctgtaaaatttcctgtcatccttagctgctgggttgattgaaatttgatctctacatttcaaaatcaaactagtgaatacagtttgtctttcaagagaatcagaggcatcgtaactcctaccaagttagtaagtatgagtctaaccttgtttgacattcaggtcttctgctacattatcttctttgagaaaaattaattgattataaaatatgtgctacttcacttacattattaaatatgtattaacgcctctcaccagggcttccagtgaagttacaatgccctagtctgtgaattagtctggaaacgtgtttttccttttcggatgttagagtaccctttgataaactaaattttactaagctgaacaactctgacagtctaaagagctaatgtgggttaccaaaaggcctgtacctgtaaaacaaaatgcaggtgtaatgattatacatgtctatggattacctggacatactctcatttgggttgttcttcaaagaagcaagcagccgatccctgttttcataaagctaatacttcagttggaaaaattaaacaggagcacaaagtcagggataggggttagcagaagagagaaatagtgtcacatcaagggcaggatctcatagctagggaacatttcacaaataaggtgagattttgtaaccaataataaaaatgaatgtttttataagtaaataacttatttttcatatggctaaagatggtaaaatgacttcattctatagccattgtaaataagaatttgctattgatgaaagaagttcagattggcatttgaagtattgagtgtatgggatctctaaggatttcttagattttatatttaaatattttttaaaccttagaggagtcaacaaactggctcttgattttcagcaccctactctcatgaaaaaagcctgaaaggaccctttcccttataagtaatttaatccaatttctccccattttatagatgaggaaactgaggctcagatcagatgagaactcacttaaatccactcaatgtgtagatggtagagctgggactagcaacattgctgcagcccattgttggcctctctcttcactttatcattgcccaagaatgaggatatgcagtaaacagaattcaggcaagatacctctaagctgttttgaaccctctgatattttgtatttatgtgtttgtctgtctccccctactagaatgtaagctccatggggcagggacttcactgtattttgttcatagtgtatccccagagcctggaccagtgcttggcacataggagatggcaataaatgcttgtagaattaataaacaaggtgaaggagagagctaatgaaatgaaaatcttagtctcatataagaagtcttactac

SEQ ID NO: 17031 - DNA, 100863 bp, Human
  misc_feature (1)...(100863): n = A,T,C or G
atgctcatcatcactggtcatgagagaaatgcaaatcaaaaccacaatgaaataccatctcatgctagttagaatggcaatcatacaacagatgctggagagggtttggagaaataggaatgcttttatactgttggtgggagtgtaaattagttcaaccattgtggaagacagtgtggcgatcccccaaggatctagactagaaatgtcatttgacccagcaatctcattactgagcatatacccaaaggattataaatctttctataataaagacacatgcacatgtatgtttattgcagcactattcataatagcaaagacttggaaccaactcaaatgtcccagtgatagactggattaagaaaatgtggcacatgtacaccatggaatactatgcagccatagaaaaggatgagttcatgtcctttgcagggacatggatgaagctggaaaccatcattctaagcaaactatcacaaggacagaaaaccaaacaccacatgttctcactcatatgtgggagttgaacaatgagaacacatggacacaggacagggaacatcacaccccggggccagtcggggggtggggggctggaggagtgatagcattaggtgaaatacctaatgtaaacaacgagttgatgggtgcagcaaaccaacatggcacatgtatacctatgtaacaaacctgcacgttgtgcacatgtaccctagaatttaaagtataattaaaaaaaaataagaaggtggcctctggagttcctaactctggaatgtactaaccatatgattttaggaaaactatttttctgagtttcagtttcttcatctgtaaaattaatgtaatagtacccacctcttgaggttgttttaaggacaacatgtaaagagattaatttggaattagtatttaagacagattggagaagggaaaacctgtgggtagggaacagttaacaaagctattgtaagcactgagcctaggcaaagacagtaaaccactagactggagacagtggaaaaacagcaaaggaaaagaagtaggacaagcgactgactcctctccactctcattcatcttgcaaattcctttttttctgttcatttaacataatctgggaacctaaaactacactttgaagtatatggtctgtctctggacattattaactgtttgctcatttccttagagctacaaataaccatctgatctctctcttcaccatttcaacatctgcaatatgttctcccaaatcccttacttcagtcagttaaaaagcaaaacaaaacaaaaatcatccatctttttacacaatattttcaatcttttctttgtaatttattccttcattcttaaacttgccaatcaggcctcctgcaaattcccacggaagcagggttccctaatttaacaaaacacaaaattcaaaaagaaaaccaatcctgccatttctgggcttaaggaaacctgaaactttccttcaaaactctgcagcattgctcagtactttagtgcctaattcctacaacgagctaagatcagaaaaatcactacgtaataggaatcttaaaatgcgcaaggctttgagaacatgggttttcaacatacagcttgctctttcaggatctgtcttcttatttgcatatatttctgagcaggaagttatgcgcagtacttttagtctccgcgtgaaaaggtccttcatgctaatctaattcaattcagttctcctttttctttcttcttctcctcgccctcttctcagggaaggaatcgtcaaaaatcaatgtttcaacagatctcgcggtgctattcgagattccctattaaaaaaaaatagaattgatgcaaacagcctgttccttccggggttttgggctggaactgcagcgcttagagagctcggtggaagctgctaaaggcggaggcggggctctggcgagttctccttccaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcggtaaggagagtggggagtccacctttgttgttttcctacacaccagtcctctgctgccccagaaccattaaaatgcagaagttcctctggcagcttctcctttggaagactcatgcatccccgatcccacccttcttcttcccttttttccctttgttgcatcgatttcatttttttttttttccacatagagttcagctttgtttgcttcgtgacgttggggggcacatttctgctttgaaggaaaacgaaagctaccaagttttgggagatgggagatggtgctatacggtctttagggttacgtgaagtcaagtaaaatcgcacactggtgagtttcaagagtgagacatttgatgaatacgccctaagtactgagacaaggaggagtgcacttctgtaaaggatgggggtacacatgctgtaactggtggggattgagtggaggcctaccgaggcattgtaattattctgggtgagtgagaccctggtaatagagttattttgagagtgtgtagaagaaagtggttaacttgagcttgaaggcctgttagaactagacaaattgggaggggaagttggtaacaatgacgtaaatttttttttaacttaatatgacacgagattcagttttccccccatattgtcccttattttgactgtttctattctttcaaaatattttacttttaaatttctctcactgcttcaagtatattgagaactggatagggagctcagtggcttcttgtgtagtggcagcctgagttgctgctgcttcaaatgataggactttctctttcatggattcacttactcttaatttagaataacaaattttcagcagctgtcgggagaatatgataaactggggtgcaagatgagtgtatatccatgataaatgaaagtgcttctgctttttacaactcaagagaaaggcagacagtggcaagaacagatgtgtgggttcagattgtagggtataggaaccccttccctcttcttgagctttagagcagcagctaatccaggttgttgtgtgtttttattttttggcttgtttatttacacctgagaggatgtggaatggaagtggaggttatgttaaatcacaagaaccttgatatttgaactttgtcttctctggccaccatgtgtggatatgtttatgcaattttggaatatcagaaaatttaatcttacattttttgaataagtttaggttaaaaaaaagaacaccttttatatttcctttggacctaattttatgagcctcttgctttattattttccatacatgttgtctaatatttcaaagtaaaatttgagttgctcagagtctcaactcaatccaataattgtaaagtccaacttaatgcctttagttaaacccctaatgagactgaacagatcaggcagttagttttgctttgggagtcatacagtttcaatactgttatttattctttgctttctccttcctctaccccttctttaaaagtagattcaacaagaaactgctttcagaatttctattcaagtaagaataactgcacctctctttgttaagtcttaagtttccaagagccttagaaatggctgctgtcttctattatttcctttattggactcctttttttttttatttagatttcaacttttattttagattcagagggtacatgtgcagatttgatgcatgggtatactgtgcaaggtttggggtaccattgaacctctcaccctggtagtgggcgtagtacccaataggtaattttacaacctttgccttcctccctccctcctctgtagtcttcagtgtctattcttcccatctttgttggactttattgttgaagaccatgcaaatggcagatgtttatggtatttgtattttatttcaattttttgtcatgagtagttagaaatttattagaaatttatctactgtagtaattatagttcaatgaacctgttatcaaaattctacttcataatgccaaaataaatccttgctttattatactattacaacacttttaaataataccaaaacagtgtaaagtgagtacttctttgtaacatgaatggagtggtgattatttacttcagaaaggcacttttcagtttgctgtactaaagttttcctttaagattgatgccctgtttgttttaatacataagttagaaagttttgagcaaatatcctgatggagtcctacaattgcacatagtgagatacttcaataagtgactaagtttagttgtctgaagaacagttaaaagcttctttgctttggattggtggtagctgactgtttcttaatcttcctactggttgtcattaaaaaaaaaaacaacagatgttatactggttatactgggcagagtgggggatctggatctgtgataattggcaagacaatgttaacttattatggtggcgggcgcctgcagtcccagccactcgggaggctgaggcaggagaatggcgtgaacccaagaggcggagcttgcggtgagcagagatcgcaccactgcaatccagcctgggcaacagagcgagactttctctcaaaaacaaaacaaaacaaaaaaagtggcctaatagtgaagagtagcacttgcttcttgaaagtttagaaatgaaaacaagtatgttggtctttgcaatggatttcattttttatttttattgatatatcataattgtgcatatttatgggggacatatgatcttttgatacatgcacacaatgtgtgatgatcaaattagggtaattaggatatccgttaccgcaaacatttatcatttatttgtggtgggaacattccaaacattctagctgttttttctagctatacagtaaattatattggtaactatagccaccctattgtgcaattgaacagtggatcttattccttctatctaactgtatttgtgtactcattaaccaacctctcttaatccttctttccccctacccttctcagcctctggtaaccaccatccattctacccaatatcttcatgggatcgacttttttagctcccacatgggtgagaacgtgtggtatgtcttttgtctttctgtgttatgtcttagttcacttaaaataatgtcctccaggctcatccatgttgtcacaaataacagaatatcatttttatggctgaataatattttattttgtgtgtgtatatatatgtgtgtatatataagtgtgtgtatatatatgtgtgtgtgtgtgtgtgtatatatatatatatatatatatatatcacatttcctttattcattcaccgttgatggacacttagccacatatcatagttattttgaatagttctttaataaacatgggagtgcagatatttctttgatatactgatatcctttcttttggatatatacccaaaagtgagattgctaaatcatgtgatagttctatttttgttttttgaggaacctctatgctgttttccatggcagctctagatcatgtggtagttctatttttgtttttttgagaaatctctgtgctgttttccatagcagctgtactaatttacattcccagcaaaagtgtactagtattccgctttctcagtgcccttaccagcatttgttatctttttggtaatagccattttaattggagtgagatgttatctcattatagttttgatttgcattttcctgatggttagtgatgcggaacattttttcttatacctgtttgcgatttgtatgtcttcttttgtgaaatgtttattgaaatcatttgccatttaaaaaaattggattatttgtttttttgtgggtttcttttttgctactgacttccttatatattccacatattaatctcttgtcagatggatagttggaaaatatttcctcccatttttaggtttctccttactctattgattgtttcctttgctgtgcagaagctttttagcttaatatagttccatttgtctatttttactttcattgcctgtttttgaggttttacccaaaaaatctttgcccagaccaatgtaatggacttcttgatggtaaccataataatgatagtcagtagaagcccctaagtatgtcagatactatctcatttttaaaaataatcctttgaattaagcactatgattatctctgtttttcagagaaggaaatacagtatacaggttcaaagagtaaataactttctcaaggttacacagttggtaagccatagagcttgaatccaagcaagatgtttgaatccaaagaatatgtacttaaccaccaagaaatgcatcctcccagtgatttatggcaactagtaggcatgaggaaataaatttgaacacgagtaagaggtaggggaggaagtaagtcctgtaagtggaagaagagttgcctgggcatgtgcatataggggaatagagaaatgggcagctagtgtgtaggagggatattgtgtctaaaagggaatgtctgtaagtagggtaagtgactgttcacccaaggccaagaagatagagaagacctacacagttggaaagcctaaactggtctggtataggtcaaggtataaaattcaggccttaatactgtttagtttgatgggaaccatttaacaagaatgcagcttccaagtagtctgtctatatgaagtgatttctgcctgttcagaattgtttatacatgtcttaactcactgtgacacaggtatatgccacgttttgtttcttgagattgtaatgccttgtaaatttacatttaatggaaaatgaatagtaatctcagagcctatataagttaataaattgcaataacttcttaacaaaaatcaacattggcctaggatgagaattgctagagagatgatagcttggagaattttaactggtttgggagttttttccctatacatatttccccaagacccataatgatctccatttcatggcatctatgcattctatttgtgccttggtgtagaaattttaagattgtgggaaatagatgatttcttagggttttaattgtgaagtaacttttaaaaattgatgtattttatataactgataaaacagaagctagttgtagcttggattgttcacaaatatacataatttttctctatggttgtactctgcacaatttataacaacagataaaacaatgttctggattgtgtaattagtcactagtcacagtattttcttcatctggataatatagaagagcaagacacagttcttcattatgtggttctcaaataattgtactttaggcgcagaatgttttgctgctctgtctgtatttatacattaaacattgattttgtgtatgcaaggatttttgtcatatcttccaaagtttgtttgaatgttgtttaaaggtgttcatagaagatgttcacttagaagactaaaattagaaactgttcaccaaatgactgggacatactttttggaggtccctaacagtggaaaatggcagctttcacatggcaaatgtggagactcaagatcagtgctttcaaattgatgcttagtatttgatggctgatttcctaaatttcacagaaacattggaagaatttggcccaaaaagaggctgatcagtgatcagtgatggtgattcttgggcatttaaaaagatgcttaaatgttacatggttgtagggaagaatatattgtgaaagtttagtaaaagattaattatctgggccgggcacggtggctcacatctgtaatcccagcactttgggaggccgagctaggcggatcacgaggtcaggagttcaagaccagcctggctaacacggtgagaccccgtctctactaaaaatacaaaaacaaaaaaatagccgggcgtggtggcgggcacctgtagtcccagctacttgggaggctgaggcaggagaatggcctgaacccggaaggcagaggttgcagtgagccgagatcgtgccactgcactccaatctgggtgacagagcgagacaccgtctcaaaaaaaaaaatcattatttggtagaagagaaagataaaatggacttatttctagcacaaagactagttactttgttgaggaagggttttgatcaataaaccctccaccagggttagcctagggaaaaaataaataaacctcaaatgtcaatcagattgaatgttctctgtagctaatctttaaaatcttttatgaaatatatattgtgcaattaaccaagtatcatttacaaaaacatttcctgctttaatggaattatcaaggttgaattttgtatttcatttcttactgatacaagtaaacagattaagagagaagctgctggttaactatctgaccatctgtttgctttcagatctactttgcggcccactaggaggccttttaaacccagtctttaattactttcttcaatccagaccaaggttaaacaaaagtacatttagagagacgaggcggttcatttatgatgactgttttcattaatatgagagacaaacctgaccttttacacttgggcagcagagaagaattttaagcaaggagatttttttctagcccaggtcttgcctgttggttttattaggtttgcttgaaatcttgcagattgccagaacatcaggcaaaaaattcaaatataagtttaaaaatatcataacaaattcaaagactgtatatttaagtgttcaatgatgctaggttttttgttgttgtattgccctttcgttagcataactaagtttttttttttttttttttttttaagacggagtctcactctgtcacccaggctgtggtgtgatggcatgatcttggctcactgcaatctctgcctcccaggctcaagcgatcttcctgcttcaacctctcaagtagctgggaccacagacatgcaccaccaggcccagataacttttgtatttttggtagagacaggttttcaccacgttgcccaggctggtcacaaactcttcagctaaagtgatccgccctcctcgaccttccaaagtgctgggattacacgcgtgagccaccatgctcagctgctaagatttgactttagtaatagtaaagacaacacttatttatgcattgtatatgtcaggcaaggtgcccagggctttacctacattattttacttaatttatctttacaataatattttaacatagtaataactactattagattcattttacctaattggagggggtatctctaagatccagaaacataggtacattggtcaagactgaagagctagaaatgacagggctgtgatcagaactctggttgttcggacttcagaacccactcctaaacactgtgttatttacacatcctctgtttataggtattgaatagaaattgtcaatactacataaaaatcctgttatatgattttgaaatacaattgccattcaagaggggatgatgtctaagtaggcaaatgtgttctcattcataacccgtactcgagagtgagatgagagttggcactggtgggcaggctgggtgtagggaggatagtagcaccatgttcttttaaaatgtggttctttttttaaaatcaaatgaattcatcgagggcacacttaaaaataatatttgtctgtactttcttatgctggcctgtgttacatactgaatttttatgactgattctcttgcatgttatgtggctatagaccaacataattaaaaggtggtttctatgattctgtaaatctaaattaaccaggaaggcagtactgctataacttgtaaactctggttttagactctagtccttgatttctgtccctttggcttagtcctttttggaaatgagaccctatcctagagttagggtctagccaagcctttctgcttgggggatttccaaaaatgagtcaagacaaataaaatttcacctttcaaacaccagagaatattcatcttaggtaacatttactacatgagaaaattttctgtttcaccatcacctttcagccagttgtttcattataagtgcagcatgtttttctgttaaaattatctgtaaatatatatttaatagtagttgtatgatattggagaccgttctcttcagtatgttatatcaaatttgatttagaaggaagacaagcatatataattacttaatttattaaacatatgatcaatcatcttactttaatttctcatgcaaattgtcagctttagtgggtaataatattaagagctataattcattgagtcaggcacaccggtaagaactttacatgtattgtttcatttttctgacaattcaatgaagctagtactcttattatctctgtttttaagaagagaggctcagagaactagccaggtcacagagctagtaaagtaccccccaggtttgtctgattccagggcccatgatctgaagccctatgctattcttcccacttgatgatattcactaattacccactctgaatgcagctctgaaactgatttacaagtcgttgtaatacttcttttctgatgaacttgaaaaaccatgaaaaatacttcttaattaactggtctatagcaatacgtggtctatagaaatactaaggataattctggtggtctgttacatcaagtggagaacttgagtttatcagaggagacaatcaaagttataagagctcagcctatactattagttagaatgcagaacatgtacctttatctcaatttaagaaaatcattttattgcaatctaatgaaaagtagataagatgaattgttttttgaagggattttaaagcttttttagctgtaagggtgagatatgttttattggctattgcctgtgtgatttgagtaggtcataaaactttctttgcctctcatcattctcacaagctgaatatgagtaacttaaaatgaagagtatcatgaaagaaagcttctagaagtgtgtgatggttaatactgagtgtcaacttgattggattgagggatacaaagtattaatcctgggtactgtctgtgtgggtgttgccaaaagagattaacatttgaggccgggcgcggtggctcacgcctgtaatctcagcactttgtgggggccgaggcgggcggatcacgaggtcaggagatcaagaccatcctggctaacagggtgaaaccccgtctctactgaaaatacaaaaaaaattagccgggcgtggtggcgggcgcctgtagtcccagctactcgggaggctgaggcaggagaatggtgtgaacccgggaggcggagcttgcagtgatccgagatcgtgccactgcactccagcctgggctacagagcgagactccgtctcaaaaaaaaaaaaagtcagtgagttggggaaggcagatccaccctaaatctgctgggcacaatctaatcagcttccagcaaatataaagcaggtagaaaaacgtgaaaaagagagacaggcctagcctcccactttacatgtttctcccgtgctggacgcttcctgcctttgaacgtcggacttcaagttcttcagttttgggacttggactggctctccttgatcctcagcttgcagaaagcctattgtggaaccttgtgatcatgtaagttaatacttaataaactccatatatatatatgtatatacacacatatatcctactacttctgcccctctaagagaaccctaatacaaagtgttgttggaaatttattactaaaaataatgaaatctgatctcagactttcagaaaaaacataattggtcttgtgattcaggtaaataattttaacttctcaaaggattcagtagttggggtgaaatattttcagtgaatttctacttgaaacaagagtaaaggtagacctggcacaatggctcatgtctgtaatcctagtaacttgggaggcccagcgggggacgatcatttgaggctaggcgtttgagaccagcttggggaacaaagtgagaccctgtctctacaaaaaataaaaaataaaaaaaaaagaataaagatgttaaatttaaactttctaaacaatgttgaggggacaatcagggttgttggtggtgatgagacaatttgccaggtaacaagacaaacacctggtgggttttaaagtgagcaaaatggaagtgtgacaagatccaaagtaaggacaattttatactcgactttgaattcatgctttgaattcattctttttttttgaaaaagaggatgttgaaaggcaagtaaaaaatattgtgaaaaaaatgtgactaaacatttacaaattgcccatcagatcagattaggattttttattagatctttaagttaaagttgaagaatgagttttgtttagtgtgtgtttatatccaattagaaattgtgtggctatgattaggtgctgtatggggagcttaatagaggagtgcatatctcacttgggatttaatctgactcaacccatgagttgaactcgagaagtaaagtacacatcccaggggatccttatgctgcccaaatgccagggactgcttgggacaggtcccaccagacacacagcatgtgtgcactttccaaagtcagtcactctaggtttcatgaaaactcaaagcatctaatacgatcttgtcaaaattatgtctacatgtccaagtggatttactgtaaatcaatgtctaattactttttgaaaattattcacttacagagattgaattgactttttttcatttcataatgtggttgagtaggaaagtcttagaattgtactttttcgttgaagtataaaactagcgatagagtgcataaacattatattgcttaaaatatatggagaatggctcaaaaggagctattagcacaaaaaatgagattctgtcttgtgcaacagctcatgtaagagaagagattttggggaagaaaatgaaatttgaaaccttggattgtcagaacatggatttctccaaaagcagttataagaaaaaaatagttgactatctcccagtgattgaggtaatcatgaccgaattctacacccacacctccacaaagtaccaccacttgatgtcatacactttcttcaaatatttgaagttggaatggtaggcattaatttgtgtatgttttagtaaaaatatatagcaatttttatttcatatgattaatggtgagtcattatgctaggtaaaagcatatgataaaaagatagatggcatgttgcacataatagcgttatgcatttttcctaaatatttccttaagctttagcaattgcctcttagcaactgtttcaagttatataaggcagatttctgttcctaatgaacagattttgaggcaaggggtatattgttacagttttttttttaactttcctcctcatttattaatggacccgtcaaaagttaaaaatactttgtagaactctactgtagaatagtactatttcaaaattcaacaaagtgatgagtagcaacttatcatctacctctttcacttcttattacacagaatataattataaactggtaagtttttaaataaatattttttcacatatgagtggatggcctgttgaaattcaagtgcaaaacaggccacccaagtggagatttgcagctgctagatggaaacgtgtgactagagtttgggaaagatggtggacggagagtagatatgggagtcatttatgtataggtgctacttcaaactatggaaaagaatgaactcactaggaaaaaggaattatggcatgagatgagaagagagctgaaaacaaagacaggactttgctgaatgttcacatttcggaggaggtgaaagaaacaggaacagcaggaaacacgtggattcattaggaaagatcagagtagcatcttgtaatagaaaccatggtagggaagaattttcaaggacaatgaacattgttagttccatacaggaattttgaaaactgataaaaggtcattgaattcaaaataaggaaatgattagtgaccttggagaaaagcggtttcagtagattggtgaaaacaacagcctgattgggaaaggttaagaaatggagcaaataatgaggaagagatgagtatatagactaatatttgactagtttggtgagaggaaaggaaaaagaagattcctgaaaatagttaaaataaaatgatattattccagcgttattaaaaaagaagaaaattaagcgaactggaatttttcctagaaaaatcctgtttgtctgttttcccagcctagatttatcagatcattgttgattctttaatttcaccatagaatcaactttaaactacctcagtgtctagtggctgaaatattcaacaattaatatttggaaattgtgacagagacagaacatgaatatttgtgataggaaaggatgaaagcaaataaatatttttatattgttctacttgagaatgcccaatgaataattttatcagacaaatgcatattatttcaaaaagcattttattaccctcgtaaaaaataagcaggaaagtcaaagttctcataaaaagtatgaagaacagctggacaatttttattaccaccatttatttgctgaaatttagtaaagatcagtttgattctttagaacatattgctttttaaactttgacttctggctatgggatggattattttagtcataagaaagtataactgatctaatactttacacttattttcccttctcgctaatgccaacctagcttctaggaggctggaaagagtatacggttagaaaattggtaggcagatcacttcctttaagatttctgggctgacttaagatctggtgaatactattcaagaaagaagataaagaaaggaaaatggaattaaatcagaagtttgggattccatatcaatgacattattcaattctagtggagagagtttatggagctccggttccataaactctctcccctagaatttcatacttctacattcaatacttttacattgaactaacttgatcgtatgtgcacatacatgtaccatataaacacttggcagagatgttcaagtgcagagccttgcacagggtggacaatttgaatagattatgtagataggtcctgccgattctgaatctatgatttgtgcttaggaattatcttgctttcaccctcaaattcactcattcattgagaatatacttgttgccagccactggactaaactctggacccaggctccgaaggacgagaaaaggccaggaataaagattttctcagcctcctccctgagccagaatgaaggagaaagtatggggatgtcaatttgagggactaagttacatggtctgcaaataagaaaggagtcaaggcagaggtactttagggactctctgcctgcctgttgataagctgcctcatagaaattagcattctcctgtcccccaaccagtgtgcaaatatattctgcctaccctttccagtccccctgacaatgatcttcttattgaatgacagttctgaaaagtgataagttattagttcagttgaactgttacccaattttcttgccatttcactaggcagaagtgtggaaagtagatcctaagcacaatttgcacttcctttttataccggaacattccacaaagacattactattatacagttctgattaaagccaaatgttgcagtcataataaattaaagatttgtggcttcattgtctgtttctaacatttagcctgggattatggaacaaagcccactaaattccctttttcattatctaaaaaatgccttttagacttttctataattccctcaccttgagatcatcctagctttgatcttttgtgtaaacaattatgtcttataaaaatctgaattgtattcattcctttatttataatctcaaccactttctgtttgtcactcttcctgctctccttgttttttttccctctcttttccaagggttataggattcctgacagtttggtttgaagtttagttcagtattctatatatcaatatgcattatttactttgtttttgctttaattttcaatttttaatttttgtgcgtacagagtaggtacacatatttatgaggcacatgagacactctgatacaggcacataatgcacaataatcacatcaggataaatagggaatccatgaacccaagcatctatcttttccttgtgttacaaatgatccagttatactctttcagtttttaaaatgtataataaattattgttgaccatagtcaccctggttgcactgtcaaatagtagaccttattcattgactctatctatatttttgtacccattaaccatccccatcctccctaccctacccattatccttcccagtctcttataatcatggttctactctatctccatgagttcaattgttttaatttttagctcccactagtaagtgagaacatgcaaagtttgtccttctgtgcctggctcatttcacttaaaataatgtcatccagttatatttaagttgtcgcaaatgaaaggatctcattctttttataactgagtaatactccattgtgtatatgtgccaccttttctttatccattcatctgtcaacggacacataagttgcttccaaatcttggctattgtgaatagtgctgcaataaacacaggagtgcagctatctctttgatatatccattttcttttggatatgtacccagcagtagggtggctggatcacatatatgtaagctctatttttagtttctttgaggaacctcccaactgttctttttagtggttgtactaatttaccataccaccaagagtgtatgagggttcccgtttctccacatcctcgccagcatgttattgcctgtctttggataaaagccattttatttatatatatttatttgtatcttctctcttattttcttaatctcactaatggtcaattaattttgtttatattttcaaaaaaccagctttttgtttcatttatctttaattttttgtttcaatttcatttagttctgctctgatctttgattttttttttcttctgctgggtttgggtttggattttgtttctctagttccattaggtgtgagcttagatggtctatttgtgctttcagactttttgatgtaggcctttaatgttaggaactttccttttagcactgcttttgctgtttgatagtttgtatcactattatcatccagtttaaagaattttctaaatttccatcttgattttcactgttgactcaaagatcattcaggagaagactatttaattttcatgtatttgtatagttttgagggttccttttagagtgaattttcaatcttattccactgtggtctgagagagaacttgatagaattttcattttcttaaatttattgagacttgttttgtggcctatcatatgatctatcttggagaatgttctatgtgctgataaaaaatgtatattctgcagttgttgggtagaatgttctgtaaatatctgtttagttcatttgttctagggtacactttaagtcagttgtttttttgttgactttctgtcttgatgacctgtctcgtgctgtcagtgaagtattgaatttccccactgttattgttttgctgtgtgtctcatttcttaggtctagtgtaattgttttataaatttgggagctcctgtgttaagtgcatatatatttaggattgtgatattttcatgttggactgatatatttatcattatataatgcccctctttgtcttttttcacttttgttgctttaaagtctgttttgtctgatataagaataactactcctgcttgcttttggttttcatttgcatggaatatctttttccacccctttaccttaagttcatatgagtccttatgtgttaggtgagtctcttgaagacagcaaatagttggtggttggatttttgtccatcctgccattctgtattttttaagtggaacatttaggctacttacattcagtgttagtgttgagagatttttttcatcatgctaattgttgtgtgagtactttttttaaaattgtgttattgttttataggtcctctgaggtttatgctttaagaaggttctattttggtgtatttcaaagttatgttttaagatttagaactccttttagcatttcttacagtgctggcttggtagtggggaattgtctccacatttgtttgtctcaaaaagactttatctgtccttcatttatgaagcttagtttcactggatacaaaattcttagcttatttttttttgtttttgtttactgaggttaaagatagtaccccaatctcttctggcttgtagggtctctgctgagaagtctgctgttaatctgacaggttttatacatctatatctatatctatatatctgtatgtatatatatatatatacagatatatatgtgtatatatacacacatacagatatgtatatatatctgtatatatacacatacagatatatagatatagatatatatacacatatatatctgtatgtatatatagatatagatatagatatagatatagatatatcccaatttgaaatgaagaagtcaatgtatccatctttgcagatgttatgatgttacatttggaaaaacctaaggacttcaccaaaaaatcccattagacctaataaacaaattatgtacagttgcaggatacgaaatcaacacacaaaaatcagtagcatttctaaatgccaacagtgaacaatcagagaaagaaatcgaaaacttatttgagggaataattgaggaaaacttccctggccttgctagagatctagacatccaactacaagaggctcaaagaacagccaggaaatttgtcacaaaaagatcatcacctaggcacatggtcatcaggttacataaaatcaagacaaaggaaagaatcttaagagctgtgaggcaaaagcatcaggtaactatatatatatatttacatatatatgtagatttatatatgtacattttttcagtcttcttgagtttctttcatcaatatttcatagttttcattgtagagagctttcacttgtttaagttaatccctgtgtagtttattatgtttgtgactactgtgaatgggattactttcttgatttctttctcagattgttcactattggcatttagaaatgctactgatttctgtgtgttgattttgtatcctgcaactgtacataatttatttattaggtctaatgggattttttggtgaagtctttaggtttttccaaatgtaacatcatatcatctgcaaagatggataaattgacttctttatttcaaattgggatgccctttatgtctttctcttgtctgattgctctagctagggcttttagtagtatgttgaataacagtggtaaaagtggacatctttgtcgtgtaccagatttagaggaaagcctttcagtttttttcccattaagtgttatattagctgtgattctctcatatatggcttttattatgctgaggtatgtttcaatccccagtattttgacacttgctgtcatgaaggtatgttgaattttatcaaatgcttttttagcatcatctgaaattatcatatggtttttgtccttcattccattgatatgatgtattacattgatcgatttgcatctgttgaaccatctttgcatccctgggataaattccacttggtcatgatgaatgatctttttaatgtgttcatgaattcatttttttagtattttgttgagtagttttgcatcaatgttcatcagggatattggcctatagttttctttttttggtgtgtctttgtccagttttggtaccagtgtactattggccttgtataatcagtttggaagtatttcctccttcttttctgcttcagaatactttgacataggatttgtattagttcttctttaaatgtttgataaaattgagcagtgaagcccatcaggtcctggcatttctttgctggaagactctgttgcagctttgttctcattacttgttttttgtctgctcaggttttggatttctccatggttcaatatttgtaagttgtatctgtctaggaatttatcaatttcttctgggttttccaattaattggcatatagttgctcatagtagcctctaatgatcttttcaatttttgtggtattggttgtaatatcacctttttaatcactgattttatttaattgggccttctctctgttttcttattctgagcttaagtttgtccattctttacatcttttcaaaaaacccactttttgtttcattgatcttttttagtgtttttttttcatttcaatttaatttatttttgatctgcccttatttatttattttcttctaagtttgggtatgatttgatcttgcttttctagttctttgagatgcacctttaagttgtttatttgaagtttttctaaaaaccttttaagtcacccttatagctataaacttttattttttactatatatttcactgtatcttataggttttggtatatcatatttctgtttttattggtttaagagatttttcaattttcttaatttcttcgttgacccactgttcactcaggagcatattgtcttattttcatgtgtttggatagcttccaaaattcttcttgttattggtttccagttctattccattatgttcagaaaatatatttgttataatttcatttttgaggaatttttaaagacttgttctgtgtcctaacatatggtctattcttgagaatgatctatgtgctgaggagaagaatgtgtattctgcaggcattgaatgatatgttctgtaaatatctattagatctatttgttctacagggcaactgaattctaatatttctttgttgattgtctgtttgtataatctgtccaatgctgaatgacaggtcttgaagtctccagcaattattgtgttaggctctatttatttctttagctctaataatttttgccttatatatctgggtgctccagcggttgttgcatatatcttcttcacccccttcttaacttttggagttaattcatgtcgctgctacaattaaacttgataagaatcacctattgtgccagaattttcaatgctgtggctgctcaatggttgcctttggccaactgtatggcaaaaagtctaagtgctaaagtaattatttctccttaggtttccgtcagattactatataagtaaagataatttttgctccacctttcccctttatctttttccccagtatatttgtaacaatccctactgcaaacatttgaactctggcaaaatgggtgtcttactcccaggagttaataagcataagaatccatttgggccctgttgctctagtggataaattttgtcctagcatcaaggttgttctttttaaaatagcattatggctttccacattttataatggtgctttaggtgaactaaaacaatgatatctaggtagaaaggtcatgcagtaaaacattactcttttttgttattaatgtcaattgttattaagaaagcttgagcataacactgaaagttccttctccattgtatagaaattgacttttagtctgttccacctttatcaccatcaaacatattgcaaataaaatattagaagcatatgtatagaagggatcatgggaaatcatctagtccatccatgtaaggactgtttgtgaattgtcccagaaatattattatcaattttctcttagtaaattctccaaggaaagaaatatacaacctcctttggtaatatgctgcagtaatactttattccttgttgtcctagactctgcgtctaagattacagaaatctggctgaccattgaaggatttctttcttttttatttatttaattttttattatactttaagttttagggtacatgtgcacaacgtgcaggtttgttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccatgtgttctcatagttcaattcccatctatgagtgagaacatgcggtgtttggctttttgtccttgcgatagtttgctgagaatgatggtttccagtttcatccatgtccctacaaaggacatgaacttatccttttttatgactgcatagtattccatggtgtatatgtgccacattttcttaatccagtctatcattgttagacatttgggttggttccaagtctttgctattgtgaatagtgccgcaataaatatacatgtgcatgtgtctttatagcagcatattttatagtcttttgggtatatgcccagtaatgggatggctgggtcaaatggtatttctagttccaaatgcctgaggaatcgccacactgacttccacaatggttgaactattttacagtcccaccaacagtgtaaaagtgttcctatttctccacatcctgtccagcacttgttgtttcctgactttttaatgattgtcattccaactggtgtgagatggtatctcattgtggttttgatttgcatttctctgattgccagtgatgatgagcattttttcatgtgtcttttggctgcataaatgtcttcttttgagaagtgtctgttcatatccttcacccactttttgatggggttgtttgttttttttcttgtaaatttgtttgagttcattgcagattctggatattagccctttgtcagatgagtagattgcaaaaattttctcccattctgtaggttgcctgttcactctgatggtggtttcttttgctgtgcagaagctctttagtttaattagatcccatttgtcaattttggcttttgttgccattgcttttgttgttttagtcatgaagtccttgcccatgcctatgtcctgaatggtattgcctaggttttcttctagggtttttatggttttaggtctaacattttctttttacctcttttttttgtggtgaagtgggagatcagattcttgaaactgtggaagcaggggaaatcaagcaccatacaatacatggagagccagtagttatcaatttaatatatatttcctaagtacccactgataaaatactcaactctgtagagaacaaggccttaattctgaaagagctaattttgttttgaaaagcttaaaataagtctgatgattttttttttcttttctacctctcttctctttttaggaagctttctgtgtattgcttctgcctgtggatcagtacagtgtaagatcatgtgataaggggaatattcctatatgaaactcaagacatactgaattaaaaccaattttaaaattagtgttttaaacttttttttttctttgcgatagggtcacgctctgtgttccaggctagattgcagtgatgcagtcacagctcactacagcctccaacttctgggctcaagcaatcttcccatctcagtaccctccctagtaccaggtctgactgattaaaaaaaacttttttttgtagaaatgggatcttgctatgttgcccaggctggtcttgaattcctggcctcaagtgaccctccagtcttggcctcccaatgtgttgggattacaggtgtgaatcactgcacctggccaaattctttagtcagtaattccctaaagctcaagtattgggagttgttcattcatgatagttgatagtgttataaatgaagaaaattacatgacatggctaatgtaatacccaatgcaatgctttaaaaggttcaatttccagaaaaattttatcataaaactttgaattatactgcttgttgttgtagaagaaatatcactgttttagaactctatacttaatgctgtgactttttaatgtagtttactgctaacttgttagaaatctttgtcatcatcagtatgctaatcaaccaggaaaccctgtgttggggcgtaaagggccttagggaaatgggttaacctttgtttcatcccattccccaaccccagtcaccacgtaagaaagaaatgaccttaactctacttcctaggaatgctagttagatttttaaaatgtgattaatagcaagagctttgaatttctttgaaagaaaggatttttttttcattagcagcccaaaataatttgttaaaactctaatgtgacttctttaaaacacaatttataatgtcaggaagacaagctgaggcacaagttacgtgcttaacccaaaaccatataattggaggcaatactaagagtaaatcaagaatagatactagaaggcattatttcaggtcacaattaccctgtgagattaagatggtttgtatttactaacttcattgtatacaaaaagtttattttgagcctcacttatgattccactgcatttttcttaaactacatttttggatatggtataataaatggattatgaatcatcctttgttcaatcttttttgttgttgttgtttttgtcaatagtcttttctccttctttttcctcaactctggagttgggaacacttttttttttccccctaagtcactagagaaaccacgaaggaggcgctatttcttcttggagtttgctgattaaaagctaactcaacctcagtcttttctaaaaaaaaggtgatggttcagataattgcttgatgaatgatatgtgaaacaaagatggctttctcataaaaactccggacaaatagagactatatttcactcaatactcaggccttctttcaagcctttcaagtctgaggtaagctctgacatctccagtaccaattttatttttttttaaccagctctttagccatggaaaagcattaattttttctttcaacaaaaataaaatttgataagatcttcagtattaggggaataactgttttagcatagagcaggagattatttatatattttctttttaatttttataatttagggggtacaaatgcagttttcttacatcgctatattacatcgtgcactcatcatctaaatagtgtactttgtacccaatagataaattttcatctctcaccccccttccaccctctcacctttaatagtctccattgcctattatttaactctgcatgactatgtgtattctttgtttagctctcatgtataagtgggaacatgcagtatttgactttcgtttctgtgttaattcacttaggataatgggaaattgcatccatgttactgcagaggacatgatttcattcttttttgtggctaagtagtattccatggtgtatatttttatcacagtttctttatccaatcatccactgatggacacgggttgattctgtgacttggctattgtgaataacacaatagctagatccaattaattttatataattaagactaaggaaacacaatgatcctagttgaaatgttaaccaatattatgggtcactactaattatattgtaaataaatcccagtcctctgaaagaagaatgataccttgacctaagtgttggcagtacattatttcttcttctgaagaatgatttctttttacctcacatagctttcatttctgtggtaagaacattaaacatctactctcatcattttttattagtacaatatatcatcattaactgtaatcaccatgctatgtacaatagatctcttaaagttattcttcctatctaacggtagttttatgtcctttgaccaacaactccccaaccacctcccattggcacctctaataattattcagataggttgttccattgttagacaactctagttagtacaaaggatttaaatttaatttaaaattaaaccaaaatgtggttctttctaacatctacccagtggtttggatttttgtattctgaagtaaatcttctccttgctattagagcacttcacctaaggtaagatccctggcatgtctccttgcagttttctgaaaacagcttttgattatctgtctaaagattgaacgttcctagttctttcaaacattctatatggtgcatatattttatgccctttacaatcttggctgccagcttctaatttgagcctccctaatatttttaaagtgtttaatccaaaagtcttaagtgtaagtcttcagtgtagtcttggatatatttatatatatatatatatctatatatatatatctatatctctctctctctatatatatatataatttttgttatattttgtttatattttatctatttattttatgtatttatattttatttatatttatattttattaatatttatatttaaggtgggccctaaatgtaataacaacggtctttttagtagaaaggcagagggaaaatttttgacataaagggaaataggaggtatgatgatgtaaacaagaggttggagtgatgtgaggaaagagtcatgagccaagaaatgtagatgggctctgaaaactagaaaagacaaggaaaatagaatctctcctagagccctcagaaggaaagagttttaccaccaccttggttttagccctgtaagactaatttcaagctctgacctttagaaccgtgttgtttcaagccactaaatttgtggtgatttgttagaatgacaataggaaacttaatagagttgttggctatgccattgttaagtcatttatccttgtgcagttcacttaactctgtcactgcttttgttccttttaagtaaggttgagcttaacattgcccatattacagatctttcaagattgtcataagaattgtgaagttgtatctgaaataaatacattggacttttctaaagaatgatattcttatgaaaaaatggagcatcaaaaatcagttactgagtcattgtttgttagacctgacaccagttagaaacatggtggaaagttttcaatcactttatggatttgaaatggccacattttattttgatctacagaagatttccagatccattgctaaagcgatcagttagtttcctatttaacagttgcatttttgtatttttcttaaaaacaaacaaaatgttctgttctgcacagtttctaacccctatgcccttactttgctgggtctatttgagaacagggggcctgtctcatcacttggaaaaccttagagttcaagtctgtgcgaagaatgtgcaaaaattcttgtactgttgggactgttgactgcttcctagcctaaaggaaatcagttgcctaaaggaaatcagttgtcttatgtttttacatttgctttagaaatgatttcttttttgcttgctatcttgataaatctctaaaagacataatgattccatttgctttttaagttttaaataataataacatttacttgcaaatactgttaaaataatataattttatctatttttatttgttattttataattcttgtaagccgaatgtgctgttacatagcctaaaccaagaatgggataagtacattggtgaactaatgcctgaagtattaacccatatgataacatacttcatttctttcttggatttctgcactgtctggtgaatttacacaagttattacaaaataaactgtgaccacgatgcttcttgttctctcatatattgcagtttgtatgcagttttagacaccagggcttaaaaaaattatagtgatttcatgtaagtatgtatagtccttttctagtggtggttcatatgaatgggtttaaatagaaaaatgttccatgtaaggagccatagtattgtcaactaaaaatatcaaactctaatatttatgaagaggtttattctgaaccatatctaagtgaccaatggcccatgacacaaccttcaggagatcatgaaaacatgtgcccatgttggtggttggactccagcttggttttatatattttaggtagacataagacaccagttaatacatgtaagatgtacattggttcggtccagaaaggcagaacaactggaagcaggtgctgggagcggggacagcttccaggtcataggcagattcaaagattttctgattggcaattgattgaaagagttactatctacagatctggaatcaatagaaaggaatgtctgggttaagataaggggttgtagagaccaaagttttctcatgcagatgaagccactaggtagcatgcttcagagagaatagcttgtaaatgtttcttatcaaatttaaagagcctgttctattggtaattttaaaagggaggaaggtataatgaggcatgaccagttctcccttcccatcatggcctgaactagattttcaggttaactttggaatgcccctagccaagaggaggggtccatttagatggctggggggctttgaattttatttttggtctacagtatatagttaattcacattactttgttcatatgttttggtctacagtatatagttaattcacattactttgttcatatgtaacattactttgttacatataatgtaaattcatttctcaacacagtgacattaagagctctttgccacaaatgacttatagctgtgacatatgagctatagcttgtgagttacacacagcatctagagggttcaaaattcgatattactgaagtttggaaatcttgagtgtcctgagtagaatgacagtcctcttttacaaagaacctagaaaattggatagctcctttttaaggaagtctgtgatccattaatgtctctgctccctagaatttgtgtccagaggctgtggagcaagtgtccatgattaaacaacatggagttattagtaattaaggagattctgaaatgggagaagttccgtatactccttacaggatgtgccatgggggtgtggctcactttttcggtggcccgccactcaaacctctggggggagcatgcatatgggcaggctgtgggactctgaccccacaacagtgtcttggggtgaatgtttacagctgaagccccagtgggcgtgtgttacagtatgctctttcagtttagccatctgtaggtgccttgtgttagtcagctcaattagaccccaccctgccttatcacaaggacagagtgctttctgtatcctggggtttcttgccttggtgtaccagaagaatcggatcacatgtgagcttggagaatgattgcaaggttttattgaggggaagtagctctcagcagatggttggggagccagaagggagatggagtgggaaggtggttttcccctggattcaggctgctcagtggccgggctgtcctctgactgccctggccaaactccatgtcgttctgctggttggtggcttgccagtgactgttggtgtgctcttacactagtgtgttcctttcaacatccagctgcttgtgtgttcttccacctttgtgttcctcttgatgtccaggcgcttgtatgcgtgcccagtagggtctcagggtttttatgggcacaggatgggggcatgatgggccaaggtggtcttgggaaatgcagcatttgggcaggaaaacagaaatacttgtcctcacctaggtctgtgggcacaggcccagggatagagccctagccagggaccacaacctttccttcccagcgcttccatgctcctcttctgtatcaattctaggcatatgtcgtagtggaagggacattgaacttgcagtatgaagttcagaggttgagtgtgaattccaccattcatagctgtgttgcaggtcccttcatttctgtgaacctcagtgacctcaactcaaaaatgactatacattataatactactcccctacctattccataaagttgtcatagtgaaagagattatatattcattattcagttattcatcaacaagtatattttgagcatcttctatgtgcttgactttgtgctaggcactgaggattcagtgttgaacaggatagacatagacatagcccctactttcattaatgttacattctactggaaaatacagacgttaaagaagtaaatgcataaataagtatgtaattatgacttctgataagtgccaggaagtaagaggacagagtttagagtgagagtgtaacagtagacttactttagataatgtgatcagggaagatgccactctggaggtgatgtttaaactgagttccaaaggaaataagaaggaaacaggtatgtgatgtgcaaagaaaataacatttcaggctgagggctagcaactgaaaagacctagaagaggaaattatcttggcatatttgaggaacacaggtaatccctggtgtggccagaacaggctgaataatatgcaataaaattggagttgaagtcagaggagagatcaaataaagccagtggtaaactttataaactctaaaatcctatacaagtttaaagtggtggtggtatgactggcactattttcgtccatataacattcccgagttctttcatccttgtaatgtgtggccccaactgactgttgacgcatgaagataagtctgtggattcctgtttttatgctttgactctgagctaaattgggtgaaagctggattcccctaactttctttaagataaaaaaaaatcttagatttcttctgtagttatttgcccccaaatgagatttttcatatcttgtggttcctaattgggtcactgaatcagtgctcgttagaacaatatgttgatatgtaaaagtaaggcaaatatgttcacaagttggtggtctgtggctcttgaaggagagaagtcagaaaagccaggttggattgaccttggaaaatgttcatgtagaaatagatttaaatattattttagcagcagcctgtcagtaaaagctttgttcattcttaatctcttaggaaaacaaaagcttccgccaataagaatggcacatttcatcagacgcatgtctaaaaagatggacttacagatgaagttctatttgtaaatttggagtcaagggaatacttatcactcctaactcagtttatcacttaaaagagttgtgaaatgtggtgtcattaggcttcttttttaaataaagagagttgaattttattttatttattttctctataatgttagcctttgagggtgtcattattcatattcatcacttttagaagagagaagttagaatatcattttggatactttcttttttaaatcaattccgtctgaacctagtgatctaaagaatgtagtaaactgtgttataggattttgtcctttgctggaaagcagtttgttgctgtatgtagctgattagaaggagggttcctaactcttactaaccaatagctattatcaatttaactgaattgctgttttggttttgtggtctttatcagctttcataggttatagtggcaataattctaaggagaaccttttggagctcagtcagcttactcagatagactcatggcaagccattagcaaacactagttgtaaaagtggcagctttgggtccaagactgctgtagcaatattttctgggtgctatcaaatgaaattaataaaatcatttgcatggtacttagcatcattactagcacgtagtagatgctgaatatatatgcatgttcacatatatttatatgcatgtttttatgtgtttctctctatatatatacacacacacgtatatgtatatgtttgtacaggtgtgtgtgtctacacagacacccacacacacacacctcaaagcctcagtaaaattggggataataatacttacctggctgttataaagtttaaatgagataatatgcttagcacagtgcttaaaacagtaactgttctatagctatattttatatatgttttattattattacaggtataccttattaaactcatattgtccctaaaatattttactatgcatagcatctaatgcaagttatttaattctctctgaaatttagatcataaataggggtaatagtattacatacacatcacagaatagttgtgatgactaaacaagatgaagttctcaatgtagatcttgggatacagtaacggttcaataaataaataaatagtagtgaattagtgatgatgatgatgatgatgatgatgatgatgatgataaggaagatgatatcacctgtcctctggaaaagaaatgtaggctaactactagtttttctgaatagcaagattttactacttagttgatgctctcccagaattgtttttgttactaaattcaaacttttaacatgcctatcctgctctcctttctcatgccttctctctcactctctctctctcactcttgcatgccaaatcaagctgtttctttgtgaaagcaccaatgacataggttagcttactatttttgaggtccagctgtacattttaataaacacttttcgtattgtggaataatgacctagtctttccttcttaaaacatgcagggtgaaatcctcactatttttatgaaacagcatctgatcttgaacttttatgactcacctcagtcacttcacctgtattttggccctgtcagatcatgtctttatttaaacttttgatattttattctttatatgtttttgcattagtttttatttttaaaactttttctaagtatttttatcttgactactgtggttttggtgccttcttaaattttatgctagagatgactactgcctcattcttctcactggaggatatcatacaactatatgatatacaactatatgatacatatacaacttgcaattgtgggattcaccttttctgagtatgaaagtggaaatcttctataatagtagttgaatttttacaattgattgggagaacaaataataacaagaagctgtcatgaatttggtaacactttgaaatgaatttgtattttagtttaaacaacagcatctacacatattgaaaaaaatagttgtgtgtttaagtgcaagacttatttattcagtctatagatagtgctttgcatacgtagagctttgtagaccctttacaataactcttgtttctccctccatattcttcatcccgacagagatctctggaccacagattagaaaccactgctgtaagaattcagatataaggaaaatcagtgtgcctaaaatatgtttagagaatataggactttgatatccatgagcatttgaataccttgcccaaggttatatagccaataacttagcagagccaggatccatatccaggattttacactgacatgactttggcatgaatttgaaaaataagtaggagaaaaggagtaaataaatgtgggaagacattctgtttattgagtgccttttgggtgccaagcttggagccaggcactttgcattcctcttttatgtagtctatgaagtaggtgttattatgcccattttacatttaagaaaactgagcctcagagcatttgaataccttgcccaaggtcttatagtcaataattttagagccaggatccgtatccaggattttatagtttcattgttcgactaagacaggaagaagtcagctactgttaatgctggtaaacaaaaagtttgaatttaaactggtaagtcagaagtgcacagaaattacagttgtttgcttttatactttcctcatttggcaggcccatcttaactgcctagatatttttaaatgtcctgttgaggaagtttgtgtttttttctaggtcatcattcaacagattattttgtctttcattaatttactattaatatttacctctactctctaggctctttacatagtctagaatagtctgtttttcacaggctatctcgagcaagttgcaaaaacatacatagtctctttattggccctttctaaattcttcaaattggattttaaaaagtagattccaattacaaataggttgcatcaatatagaaataccttgacttgctcattttctcaaagtaataaggcaaatgttaaaaaaaatcatttctgcattatgcattaataaaatacagatgatgaaatggttttcctcattttctttttagttgtctttcatgatttttacaaagtaaatttatgaacagttcagtgcagcttttcgtttttaaggtattaatgcttcttccaatgttttgattattttgcattcaaatatggccaggagatgtgattgttaattacatttctttatgatttgtgttacagcaaaatgttctccattgaattttttggtgtaacatggaaaacttttcttctgttgtgaaagtatgtgtactattgaacagcaagataacttatggaaattttaaagttcttagatgaggcttaactgtggaaatattcttcttttttcaattctgtctcccactaaaatcattaaggctctctgggtcttgagacatatgaattcttcaccttgattgtaggtacccgttaacagaagtttactaggcatgttttaatatctgaaagggttgtaattctgggttttgagttatgtccctttcctttgccttttagatttttgtgattgtgtcttagactaatgccagtagttattgtggagatttatgagctagcaagtacttatgagacatctgggtttccatacactgtaaagctgaacaatttaaagcacaaattttggattcaggatacatgtttttaaatctcatgtaatggaacaagctatcatttaatggtggttgtcttgagtagattacttaccttttccctcatctcagagagtccctttctttatctgtcaaatgaagacagtaataccaacatcacagatttattttgaggatttagagataatgttatatgctccacactgtgcttagtacatagtaggcactcaataaaggtaaagctaacaaaattttgataaatattattttaatgttagcaaagaaaacatgcttatgagcttgaggatttaggatatagtatgcctggcagagaccactaccaaactgtcccaaaaagtagttgcttttttcttttaggaagtctccaggtcttacaacccagagtttggaagggctggggagagagaaaaagggtcagagaatttgtatttttaatgcttggggttgctaggtagttgagtatcggaaaagtgaatatggaaacttgcctcagttgacaaaagtagaacgtaagaaagggaaagagaaatagtgcctcaagcaaacaattaagagcaatagtttactgttttcagatatgatatatagactacccacctctacccagagtagtgtttttaatgcagactcctaggcccaggtcttgactttctgaagtatattttcagtcatactgaggtttgaaaatctcctggtataacaaaataaggttgaaattagttcaaatttttatttttccacttattaactgtacccatggctcttgtccttcttatgttccactccaactctgcttttaccactctagccttttttctccttgttattacataactcaatcaactaactgtacctattcaactagatagttgtgtaacatgccatcatttggtcttaaaccattggagtgctatcactggctcctcgtactgaacttgtacagttttctagctgacagctacttttaatttcctgacctctcatccacaatgtctggtcctgacatgactgccaattcttctccctagtttctatgtggtctgaattactaccctgaccaatctgatgcccaggtttgtttgttttttatgagtttacccaatttagagcctggatagcaaacttaactcaagggtatggactcagatgcaaaacttcagtgtgtatagcctacagactctataatcaccgaatacttctttgtaccccagtgcagatcgtgtccatatctaatttaataggcaagagcacacatgctaggtgtggaaaaatggacaaggattctgcattttaagcagaatctcaaaaaataagcaataataattaaccagaattacaaccctttcagatattaaaacatgcctagtaaacttctattaacgggtacctacaatcaaggtgaagacaaaggacattcctgtgagaggtaacagtaagagcaaatacatgacttaggactagtaaacgactcagtgttaggttttctataaacattccattgtttctcacgatgcagtatgagtaacacctgcttcaaaaatttcagagggtgactgtttaaaattttattcatgggtgctctagacttattaaatttggatccatgggaatgcgactcaacagtctgcattttcaacaacagatgcaccatcaaaaaacatcaagtagctatatataactaaggatatgtagttgaagacttgagaagactgagccatgtatttctaaaagggctgaaaactatgtagtttagagaatgctcactttctataaaaaagtggcagtgtttggaattagccacacactgtggaaccaattaccatttaagttataatacacaggattctagaagaaaagaaaatgatcttatctgaagtccagtaagttttgttgtgtgtgtgtgagggaaggacggagggagagagagaggctgagggagagagagagagagagagagagagagagacagaataggatgacagtgcaaggaggccctggtgtggcttctaagtggcaaggaaccttcagtaagaaagcaggcacagtctaaagacttgaaaccatggaaattagatagattccagtgaaggctatggtagtgagagaaaagtcaagtaatgttattgaattaaattcttacttggatttcctagggaagagatggatcaagatggtgaaatagaagactccaccaatcatccccttcacacgaacaccaatttaacaactatctacatgcacacacacaaaagcttcatcaatttaacaactatctacatgcacacacacaaaacctttgtaagaactcaaaatcaggtaagtactcatagtacctggttttaacatcatattggtgaaagaggcactgaaaaggtagaaaaaacagtcttgaatcaccagtgtcgcccataactccctccccgaccagcagcagttgcatggtgcagagagcttctctggttgctgggggagggagaactcagcaattgtgagacattcaactcagttctgtcctgttagagcagaaaggaaaaccagaccaaactcagctgatgtctggacacagggagcatttaaagtagccccagccagaagggaattgttgatactagcagtcagaacttgagttcttgcaaaccttgccacagagggttacattgccctgggtctttaagtaaacttgaaaggcaggctaggctacaagggctgcaacactaaggcaaatcctagagctgaactgagtccagatacagtagactgtggggcacatgagctactaagacaatagctgggttggctaagggaatgctgtcatcacccctcctttaaccttaggttgcacagctcacagctccaaaagaagcgccttccttctgcttgaggagaggagaaggaagagtggggaggactttgtcttgtatcttggatactagctcagccacagcaggacagggcactggtcatagttgtgaggcccctgtttcaggccctagctcccggatgacatttctagacataccctgggccagaagggaacccactgccttgaagggaaggacccaatcttggcagcatccatcatttgctaactaaagaggcctcaggccctgaataaccaacagtgattcccaggtactacatcaaaggccttggttgggtctctgattgtaagcttaaggtacccgcttggctggccacaggagggtagagcatcaggcaagctcttggagtccctgactccaggacttgactcttggatggtatttctggacctgccctgggcctgaagggagcccactgccctgaagggtgagtctcaggccaggcaacattaactacaagccgacttacgggcccttgggccttaagggaacattgacagcagtctggcagtactccccatggcctgtggtggcagtggccacggggtgaggcacctctgcctttggaaagtggagtgaacagtagaaaggactacatcttgtggcttaagtgccagtgcagccacagtataatagaacaccaggtggactgctaaggtttttgattctattatcggcctcctgcacaacacctttgaatccacctgggatctgggggaactcaccacactgaggagaagaacacaggccaggctggttttgtcacctgctaattgtaaagccccagggttttgagcgaacaggcagtagccagggggtgattacagcagggctcgggtgagacacagtgctatgtttgcttcaggtctgacccagtgcagtcatagtggtggtggccacaggggtacttgtgtcactctgttcctacctttgggtagtgcagaacagagagagagagagagagagagagagagagagagggagagagagactccattgcttgggagaaggtaagggaagagaacaagagtctctgcctggtaattcagagaattctcctggaactagcccagcaccatcaaggtgatacctctatgagtatgcaacagccaaagaattaatggacttggcatgccttctgaagcagctgcagcttggatcacaaacccaatttattttgaatatctggagagcttttctaagaaagagaggtacaaacaagcccaaacattgaagattacaagaaatacctaactctttaatgcccagatgacaaagaacatctactagcatcaacatcatccaggaaaacatgacctcattaattactaaataagacaccagggacaaatcctggagaaaaagagatatgtgaactctcagactgataattcaaaatagctgtgatgaggaaactcaaaagaaatcaagataacacagagaaggaattcagaattctatcatataaatttaggaaagagattaaagtaattaaaaagaaacaaacagaaattctggagcagaaaatgcaatgaggatactgagaaatgcatcagagttttttaatagtggaattgatcagacaagaaagaagtagtggtcttaataactggctatttgaaaatgcacagtcataggagacaaaagaaaaaagaatatgtagcacgcatacagaatctaaaaaatggtggaaaagggcaaatctaaaagttatgggccttagagaggaggtagagaaagagataggggtagaaagttcattcaaaggaaaaatgacagagaaacttccaaaacagaaagataccaagaaacaagtacaagaaggttgtagaacaccgagcagatttaacccaaagaaaactgcctcaaggcatttaataatcaaacttccaaagatcaaggataaagaaagaatcctaaaagcagcaagagaaaataaataacatacaatggagctccaatgcatctggcagcagactattcagtggaaaccttacagaccgggagagagtgggacgatatatttaaagtactgaaggagaacaactttaacccaagaatagtacatctagcaaaaatattcttcaaacttgaaggagaaatattttccccgacaaacaaaagctgagggttttcattaacaccagacttgtcctacaagaaatgctaagggtagtatttcaatgagaaagaaaataatgataatgagcaaaaagtaatctcttgaaagtacaaaattcactggtaagaggaaatacacagaaaaaacacagattattatatcactgtaactgtggtgtgtaacactcttatcctgagtagaagaactaaacgataaaccaatcaaaaacaataactacaacatcttttggagacatagacaatacaataatatgtaaacagaaacagcagaaagttaaaaagcaggtggatggtgttaaggtgtaaagtttttattagttttattttgcatgtttgtttcttcatgcaaacagtgttattatttagttgaaaataatgggtcataagatagtatttgcaagtatgtggcatgccaacagtgaacaatctgaaaaagaaataaaaaattaatcccatttacaatagccagaaataaaattaaatagcggggcgttaaccaaagaagtaaatgatctaatgaaaaccataaaaccttgatgacaggaactgaagagggctccaaaaaatggaaatacatctcattttcatggattggaagaatcaatattgtttaaatgttcatcctacccaaagcaatctccagattcagtgcagtccatatcaacatagcaatggcattcttcacaaacatagaaacaacaatctgtacagttatagggaaccacagaagacacagaatagttaaagctatcttaaacaaaaaagaacaaaactggaggaatcacattacctgacttcaaattgatggtggtggtggtgtgtctggagcagcctctgtggggatgccagctacagtgggggagatgcagcttgggctacacactccgcagagccagtgggggctggtaacaagtgggagccccatcccctactgagttggcagggtgggagccccatgctcctgtgtgcagctgaaaatgcccagccaaggttgtgaacccaggcatccttgccctctcaggggcctggaaatccatccctgcttctgcaggctcagaagtgccttttccctctctctggcctcttcccgctcctggtgcctgctcttgggtggagcaaagttgtggccttgtctgggtgttgtagcaacccaactgggtgtgtgcatgattggggcggtgctgacacagcagaccctgctgcctcagcttcctctagactttgtgcactgaggagcatgagagggatactgaggaggctgagggttgcttggcacgggcctgcatgcaccccttggcacaaacagcctgggtgccatggatggcagaaggcagacagtctccggggtggaaaggggtaggtttcaggtgaaaccccaccttcaagacagataaagtctgaaatctgggggccaggctgccagttccaagtggagtccatggcccagagtgatagcttatggtactttttcttggcccacccatggctccccatggaccaatcaataatcatttcctccctgtgagcccataaaaaccccagactcagccagactctggcagacattgggattatcagctgcaggaaggagctacccacttttggtctcctgagtgttctgtcactcagtgaagctcatctcctggctgaaacatgcacccctgttcactgtgttgtgggcaacaaggagagaagagttgcagccctttggggaccccagacttagggggtccccgagccagagatgtgacatcctctttggggctctgcagttcctggcatctgcaacttccaagcatcaccacgttcctctcgtccagacacaggttgcttgcagtggaaggcacgtgcagtacatctggtccagccacagccttgcatggagctggtacctgtgccagtgcctggagctgcctgcccgacagcagaagccagcatgcctggctgggcgcagtgtctggtccccacacttgctcacccacacacccctcacttctctgccctggcttgcccttggcaggtatgggatccaggccagtagcatgagccaagtgcagcatgctgaaccgagtgggcggaataagaacttgtaagtaatactgaagcagaaggtgctgccagctacagagttttctagcttgcaaaatgacaccccaagaatcccatgacaaaattatactacagagctataataaccaaaatagcatggtattggcataaagacagaagcatagaccaatagaacagactagagaaccctgaaacaaatccacacatttacagtgaactcatttttgacaaaactgccatgaacatacactggggaaaagagagtcacttcgattaatggtgctggaaaactggacatccatatgcagaagaatgaaagtagacccctatctcttgccatatacaaaaatcatatttaaatggattaaagacttaaatatgagatgtcaaaagtactacaagacactactacaagaaaacattgggggaaactctttaggatattggtctgggcaaaaattgcttgagtaacactgcacaggcaccagcaactaaagcaaaaatgaacaactgcgatcacatcatgttataaagcttctgcacagcaagggaacaatcaacaaagtgaagagacagcccacagagtagtagacaatatttgcaaactatccatctgacaaggtattaataaccagaatacttaaggagcccaaacagctctagaggaaaaaaaaacttataatccaatcaaaaaatgggcatacagaggacaatcagacatggaaaagtgctcaacatcactgatcaccagagaaatgtaaatcaaaactgcaatgatatatcatctcaccccagttaaaatggcttatctagaaagacaggcaatagaaaattctggtgaggatgtggaggaaagggaacccccatacactgttggtgggaatgtacattagtactaccagtatggagaaatgtttgtaggttcctctaaaaactgaaaatagagataacacatgattcagcaattctactgctggatatataccccaaagaaaggaaatcagtatatcaaagaggtattctgcactgccatgtttgttgtagcattcacaataggtaagatttggaagcaatctaagtgtccatcgacagatgaatgaaatgtaaagaaaatgtggtacatatgcacagtggaggactattcagtcataaaaatgagatcctgtcatttgcaacagcatggatagaactggagatcattatattaagtgaaataaatcaggcgcaataaggcaaatgccatgtgttctcatttatttgtggaatctaaaattcaaaacaattaaactcatggccatagaaagtagaaatatggttaccagagattggaaagggtagcgagggggtcgggaggagattggaatggttattgggtacaaaaaagttggaaagaatgaataagacctactatttgatagcacaacagggtgactgttgtcaataataacttaattgttaaattttaaaataactgagtataattgtattgtttatagcacaaaagtataaatgcttgtggggatagatacccgattctctatgatatggggatggatacctaattctgtacgatgtgcttattaacattgcatgtctgtttcaaaacatctcatgtcccccataaatatatataccaactatgtgctcacaaaaattaaaaaaaaataagtaaattcttacttgattatatttatacaagtcttttacatatattctaatatatttacattaataatcataataatttatgagggtaagaactcatgtccctcttttggacatcaggaaactgaggccttgaggatttaagtggtttgtttactaccttatgtctaataggtcaaatagtcaaatggtgaacgaaatttgactcagagtccagtattattgttaatacaccacactgtctccctcacctattgaaatgataacagtaataatgacaactgacattaattgaaagcttaccacatgtcagatgtttttacagcactttattaatttatttagtcatctttattgagttattttttttctaccaaagttggctttctttcttgactgctaaaatccttgtatctaacatatgtctcttccatgcaaatcttcacaactctttaggaaacacagaccaaaaaatgtagggaaaaaatccaagaaaaaggagtgctggggggacacatgaattacaagactggacagattatgttcatttgggactatgttcatgcagttgtctctgtcaatcagttatagggctgtaattaagtaacaaaacatcacctaaactaacatttaaaatgttagctgacagggtacatttctatgaaaaattttagctgagcctcttattttatgaactttaggttattatgccaacatgcagcatgtaatgtcatgcttgttgccctaaggtgtatttatcatcttcgaattgtttgctttctcaaactagacaggcagagaacaaaaaccagttgtatgtattaatatatagtcagctttaaacttaaaccaattctaaatagatttctaatggctcatgaatcaagtatctgattaacagctttaagaaagattctttttttaatttaattttcttattatacttttaagttctcagacacatgtgcagaatgtgcaggatttgttacatacgtatacatgtgccatggtggtttgctgcacccatcaacccgtcatctacattaggtatttctcctaatgctatccctccctccaccccgctacaggccccggtgtggtgtgtgatgttcccctccctgtgttcaggtaaaagaaagattctttcctgtccagaaacagaggtcattttagaacttggggttaggcagaggaagaaaaacctagaaggtgtcagatgctagcagagcatttttgcctacttcatttctttgcatccctcttttctggtttagttcttgggcctgaaagtcaatatactctgcttttcttcagtgaatgtcttctgatttagaattaggccaaaacaggcttggattgaaagatgaaaatactgctagtaactgattttacagtgattaaagcatcaatagaatagatcttgtcagtattcttgtgagagtactatccaaatgatgcattgtggtttaaataaggctttctgctctgaataggcctgtacttaaaagtatttattgagtacccacaatgtataaggcactctgttctgtattctgaggcacacaaacataaatcagatgtgagacctgcccttgaggagactctgttacctagtagcaacaagacttttatgtgaaagtgtattttttcacatttcacatcatattccacaaaaatatataggtatgtatatattttttccagatttcttcctttgcacacaatggtttggcgagcttgcttttatgtaataagagatcttaaaatgcagaagcagttatatgagcaggtaactgtgcgagtagaaaagagaagtacattgcattaatttactgattgttcatgcctcactgtatgaataaccattatatttatattacaaattaaaacatcttaacttgtagagatagaaattacagaatatatcttgttttgctgtaccatgttagttttctttttgttcagatagttctgtctgttaccattttatggtgtccagtccatcattgatgggcacctaggttaattcaatgtctttgctgttgtgaatagtactgtgatgactatgcaagtaagtgtgtctttttggtcgaatgattttcttttggatatatacccagcaattagattgctaggtcaaatgttagttttgttttaagtttgagaaatcttcaaactgctttccacagtagctgaaataaattatgttcgcatcaacagcatataagcattcccttttctccacagcctcgccagctttttgacttgttaatagtagccattctgactggtgtgaaatggtatctcattgtggttttgattaacatttctccgatgattagtaatgtggagcattgttttatatgtgtattggccgtttgtatatcttcctttgagtagtgtccgttcatgtcttttgcccatttgtaatggggttattttgtttttgcttgttaatttgtttaagttccttatagattctggatattaaaccttggtcagatgtgtagtttgtgaatattgtctcaccttctataggtggcctgtttactctggcagtagtttcttttgctgtgcagaagttctttaattacgtcacacttgttaattttttgctttttgcagttgcttttgattacttagtcataaattctttctcaaggaagatgtccagtatggtttcctaggatttcttctaggatctttatagtttgaggtcttacatctaaatatttaattcaccttgagttaaattttgtacttcatgaaaggaaggggcccagattcaatcttctgcatatgggtagccagttatcccagaaacatttattgaataggaagttctttccaattgtttatttttctcaactttgtcaaagatcagatgactgtaggtgtgcagctttatttctgggttctctattttttttttatcttagtcagtgagtctgttttagtaccagtaccatgctggtttgattattgtagccttatagtgcagtttgaagtcagataatgcgacgcttctggctttgttgtttttgcttaggatttctagggctatttgggcaatattttagtttcgtatgaattttagcatagtttttttctagttctgcgaagaatgttatttgtagtttgatagcaataacattgaatctgtagatttctttaggcagtgcggtcattttaacaatacttttcttccaaatcattagcatataaagtttttccatttgtttgtgttgtctttgatttcttttggaactgttttgtagtttttgttatagagatctttcacattttggtttgaacacatcaaacctaagcattttattcttttgtgcctattgtaatggaattgcattatttacttggctctcagcttggatgttattgttgtatagaaatggtactgatttgtgtatgctgattttgtattagaaatttgtactgaaatagtttatcatttccaagaggcttctggaagagtgtttagggttttctaggtgtagaatcttattgtctgtgatgagagataatttgacttcttttcctatttggatgcttttatactttctcttgcctgattgctctggccaggacttccagtactatgttgaaaaggagtgatgacagtgggcatccttgtcttattgcagttttcaagagaaatgcttcgggtttttgcccattcagtatgatgttggctgttggtttgatatagatgactctttttattttgaggtatggttctttgacgcctagtttcttgagggtttttatcatgaaaagatactggattttattgaaagctttttctgcatctattgagatgattatatggcttttgtttttcattctgtttttgttgtgaatcacatttattgatttatatttcttaaatcaaccttgcatcccaggaatgaagtcctgcttgattgtggtgcattaactttctgtcgtgcttttggactcagtttgctagtattttgttgaggatttttgtgtctaggtttatcagggatattgtcctgcagttttctttttttagtgtaactttgccaggttttagtattagggtaatgctggttttttagaatgagtaagggagatgtccttcctccttgttttgggaatactttcagaggaatgggtacaagttcttctttggtagaatttggctgtgaatccatctggtccagggctttttttttggttggaagtttttttttttaaattactgcttcaattttggaactcagtattggcctgtttagggtttcaaatccttcctgattcaatcctaggaggttgtgtgtttccaggaatatatttatatcttctagattttttagtttctgtgcatagaagtgttcataatggttcctgagaatcttttgtatttctgtggggtcatttgtaatgtcacctttgtcctttctgattatgcttatttgaatcttatgtctttttgtctttgttaatctagatagtgtatgtctttcagcaggttttatattgtaccatgcaggtaaacctacaagcccgtagatggcacttacaggtaagagctggctgcactcaatacagctaggtatatactcgatttttgtttactgagagactctttgtagaggaccctgctgtgccacgatttcagcggaccaggctggggcacccagcaatggcccacacagactagttccaggtcaacaagctggccctggtggcaagtctcattgtccagaagagacagctgctgtagcagctctcttccctacccaggcttgtgacagggcagagcacaattccagttcctactgctgaggcacttttcacagttttggctgtggagaccccctacctaactccagaacagaatttccaatctctggcaagggactaaaatgcctgcgtggttgtgccaccaggttgccaaaacatgactggcttttatgcacccaaattaaaaatggcatcctgctcttagccttgggtatgggaaaatatccgcagcttttcctggtgtctttccctcagagtgtcttcaagcctcttcccatgttagctccaggggttgggagaaagaaagcgctgtccattggcctgggttgcttggatccccagtggaaagatgaatcatagggagaggctctctgcctctctcatgtactttaatcacttttattttttctcacctttatcagctgtatgccatcacaggggctttgctgacattcttctcccaaggatctgggatgtccctcacaattctggtggattcccattttccttcttgaattaaagctcacagagtttatctatatgcactatgttgttatttccaagtgcctgaggcatgctcaaatacgctgtcttgggaaaacaaaacaaaacaaaacaaaaaaaacaaaaaatcttaactatctttattgctcttcctctgacacctagaacaagtgtcaagaaaagtctcagctcaataaatagttgttaaatgagtgcttgattgaataattcttaattcttaatctttcccaaccaatggaccagtaaatctcattagttattttaataatgtctcttagagagtaaatttcctctgcatttttacaacttataacttccacttgacccttgttctttcagacctagattaaacaataatttcttaactacagtctattttcaacctatcttgcatacttctattatactaattttcctcactgttttccttgtcccattttattgcttataacatacacattttactaggggactcatgaaccctgttaaccatcccttttataatgtgaaccttgcaattaagcattccattacagaatatcttttatgtctgcaaagttttacatgcctatggtttccctttttatgtagtatttttgtcttctcttgtagtccccagaacactgctgggcccagaatgagtacttaataaatacttgctgtcctgacatacagacggttatccgtttgtgtttttgtgaaaaagctaaactcttattcaacaaaatggtcgaaagaaaccagaaagtaactatgcaagtagttaggaagaatatcggtgaatggaaattttaatcttaaaaactagtgctataaaggggtagtacaaaggaattttggggggagtaattaaactgttctgtatggtagttacatgatgctatgcatttgttaaaattcatagaaatgcacaacaaaaaggtgaatttcacagtgtataatttaaaataaatttaaaaaatatttttaatataatgaaggttttaacttttttttttttaatgcagtatactaagcagcatcttgtctccatgttctggagttatggacttgctttttctttcttaaaaatagtttcaactggccaggttcagtggctcacacctgtagccccagcactttgggaggccgaggtgggtggatcacgaggtcaggagatcaagaccatcctggctaacatggtgaaaccccgtttctactaaaaatacaaaaaattagccgggcctggtggcacatgcctgtagtcccagctactcgggaggctgaggcaggagaatcgcttgaacccgggaggcagaggttgcagtgagccaagatccgagatctcgccactgcattccagcctgggcgacacagcgagactccgtctcaaaaaaaaaaaaaaataaaataaaaatagaaagaaaaaaatagtcttagctataatgataggtgattatttcccttcctggtctcacgcataatactttggtataacccaagtttggtgttgtactccatcctcttctttttccttctccacatttaaaagaaattattaagtatagttgatgaaattatgccttcattgatatacagtagcctgatttatataaagtttaccaacttcaactattttttttctcctcggaacaaactttcaaggccaaattcttgttcttcataaagcacccataggtgcaataaaaatgcagaatttagaccttagtttaagtttttctttttctcagcaaatactattcacagtcatgagccacgttttccttcaattgtactggtagataataggcactaggcagtcattgaatgtatccaaatatacctggtccccgtgttggatggaaaagctagagagcttcattttgtgacctgatatgaaatatattcataaatacaccatcaggtagagagttaaaaaaatactgctttaagttataccatagcttctaatcttaaatttgtgatatttgtaaaaaatcctgctgatttttaatgaagactgcataattaaagaaacctcctaagacttttcacaagtcaaaggacacccagctctctaatcattatcataaactaaattgggcaatctgagacgttttatgaaaattactcgtattttaatggattttatgcaatatcatttaaaatatattttggatttcagttctagacttgaatgctggaaaatgtattagacaaaaatatttattagaataactgcttaaaatatgtttttaactgttaaaggaattttatattttaatactatagttttctgtttattagtttaaagccactctttttttttcattggcttgactagctcgcttccgcttttcaatttttaggatgaaaaatttcctaattgtttaacaaattactgttttttttttatttatgacttaattctttaatttcctcttgtataatatggtggtaaagatcatgggttctaaaattgtgctgtttagtttgaatctctgttctaccattttctagctgtgttctcttgggcaagaaagttaaactgctctgagaactgttttctcattaattacaatgagacacagtgcttagtgtcatgtctggcatatgatataagtatttaaaatgtataattctcacatatatttcactgaagtacagcaaattgaattttaatgtcccactaaactttaaacattctaaaacagaaacaatattttctacttttttgctccctgaaaactgaggctgtggaaccagaactaacctacaggatattgggggtagcttccactgctaggatatttcatagaaacatgaactgaagaatatggaaaaagcattaatcatttttaaaattgctacatagcagtaatcttttcaaattatttcttaacacttccacttgtttttataccaagaaaaatggaattatttatatggaattctacatgttctggatggctgggaatatttagtgctttttttctgttcccctaaaaagatagttacttaggtgttggtctgtttcaaatctattgtgaaaaagttgcagtattctatgatgaagaatcattaacaagtatttatcatgtagatattttaaaatatccataaatgtttacagaaactgcatctataccaataaacaaagaaacattcctgagatatacctgaaacatacctgagatgtactgaagcgcagagatgattagtaacctctttaaattttagagagtttataatgggcagaatccaatacccgtttgctgtcagttatacctgtttgccagttagtcagatgctcaggtaaattagatatatttcaataaattatctattgttggatcactaagtgatactttagaataaatcatctaagatactttagaataaatcattccagttgtgcatatgaatgcatcattttaatggagaaaatgtatcttactgtctcaccatggaaactggcttataactgaacttcgctttttagtaaaggggtattcagtcttttggcgtccctgggccgcattggaaaaaaagttgtcttgggtcacacataaaatacagtaaccctaatgatatctgatgagctaaaaaaaaattccaaaaaaatctcatagtgtttttaaaaagtttatgaatttgtgttggaccacattcaaagccgtcctgggccacatgtggcccttgggtccccggttggactagcttgttttagtatatggcttcccactggatcttaaacaggttttagccacatttttggtaagcagttcagcatttttaaaaatcagtgggtaaaatgagtatttgaatttctacaattttatttcctgtaatttatacttactactaatattgataaaattaaaacaaacaagagaaaaaagcagttctgcttacacaacatttgagtaataacacaagacattagagttcttttttcatacactttactttcaataaggattctatgttattttcttttttcaacttgaatactattagatttatgtcaataagtgattctctgaatcaggatcaaaatgcttatggcaaaaacatgttcatagagtgaataaatgctttgcagcttgtctatactttaaaatgaggccatggtttacttttcgtcttttggtaaatatatggagatttgcttttagagtgaaaataggtaaagatgtaatgtggatcacaataattgatttcacacataaataacccacttaacaagagagtgatgaaggaattgtattatcatccctggagatggaagagttcagtctggcttgatggattatttttgtttttttctgtttgtttgtttgtttttttatttttctgagatagtcttgctctgttacctgggttgttacccagtggcatggtcatggatcactgcagcctcaatttcctggcctcaagcaaacctctcaccttggcctctcaaagtgctggaattacaagcgtgagccactttgccaggcacttgatggattcttcaagcatccatgactcctatttttaattgaattgttatacaacttaacacccacaattttctgttcaaccaggtggtgaaattacaggttttaatcactcaacacaacatttgatgttcagatgaccttccctttcaaaaatctgtaagacaagagctggacactttataatagtcaaaataacttgtaaatggtagatgttggcatacgattttttattgatttcttgcttttttgcacatcttgtgagcagtggcactgactgcttttgttctgtattatcttttcaaagatgcaaatatccttgaaagatatagtgtctcccttcagagcaaagggtagatttgcttactgtccagtataaaggattcagattatgtatcctttccctctgtatcatcatgtagaaattgaggatcaggaagcaggtaaaagaaaatgctgatactctgattactgctgtatctgtggcccaggggtctcgtgttatctgccagcatccttaaaactgtgttaggcttacaagttagtttgcaagtagggtaaaatctcagactccaccattcttgacagtagttcttatttctggacatactgttgttcttgatagtcatagttcaaataactatgctaacaattaattgcacagaaattcagtaatgagcccatagaattatatgacccaagccccttttattttagcaccttttgtttgctagttggttaacttcttggatcatttgattctggtcttatttaaccaattaggtaatatatggcagttgttctcagctgggcagtttggaccatgtttttttggcttgtgtctgagagtacattcttagtgctttctggtatgttcatctggggcacaccgctgtggcttcagactagttcttcttcctatggcaaataaatttgttttggtgggtaaacaattatctaagttgctaggctcccttgaaaggaaagtgtttaatttcttttgtaatgaaatcttatcactttaccaactatagaggaaaaagcccagtgctacagctaacatagtctgaaaaggtagtatttgcttttgttgtgtgtgttttctttagtcatggggagcccttcaggtatgatgattaccatgtggacccaccatcagtgacagatgtttaacagttattttcccagaccagcctagagagggtgaccagggaaatgcagtatttttgtgtgtgaaagtaacttgatcaagacttatttaccaactgagtgtgcagccttgaagaggcattgatgtaaacagattttagattgttaagcaacatttattaatatacattgctttgtggagattcttacaacttctttcttaagttttttttttttttttttgatatggagtctcgctctgttgccaggctggagtgcagtggcacgatctcggctcactgcaacccttgcctctgggttcaagcgattctcctgcctcagcctccccagtagctgggactacagacgtgcgccaccacacctggctaatttttgtatttttagtaaagacggggttttatcatgttggccaggaggttctcaatctcctgacctcatggtccgcccccctcagcctcccaaagtgctgggattacaggcgtgagccaccacacccagccacaaattcttttaaaaagcaaaattgcaatcatcctatgtttgtggaaggccatttacactcttttaccctgaatagactgtaactgaaggttagttttgaaatgggtggctatgtttaatttttcagtgtgtgaaaaataaaggcatgcctatttgtctcattatatgaagttaataaagcatgctatttagttagacaagggtttcattgttttgaaagctgatcctgtgatctaaaattctgagagaattttctgtggaaattacccagttatataatgtgtacaaagatttgctatcttctgctgttaaacatttaatagaataataattattaaggatatataaaatgaatttatataagttgaattggggcattgtgtgccatttcagtgaatttgaacaatctgccaaaggattatgattctttcctgcatttgagggcttgcttcacagtgagtgttagattgcgattctgtcagagtgatgccattagcaataggtcagacccctgaataattttctgttttgctccccttctttcactttatttatagttcagttatttatggttgccactgtaataacacttttgagtttaaaaaagccattgccttaaaatatttttgttgtattgagagaaaatttggttctaacaaagagacgttttactgggatgaaaatacagaaaggcctatggagaaatagctttttttcccattggaaaaataaagggaagtggagaagtacatttatttcaacctagaatcattaggagttgcatttctgagaattttcatgtgtgtttctatgggtattattagtcttcttcatagaatgatttgggggactttcggagattatgtcaataacttccttactcctcattatttcacaatgtttttggttttccccctttttcagaaacaaatgttggtggattttcacagtgaacactagctaagtacatgagtaggttttgagtatagggattgaggttcagatttatttaacttcagaacgttttctactgcttcagatttatctattcattgagagagagaatgcttttgcatttgaaacaatttaataggtgccaatctaagaaaaagagcaattttacaatttggcaggatgttctttgatgggaattgacttagcgctccagaaatatattgctccacagtatttaactgccagtcaactttcttattagattctcttactttagaagctcctttttatggatcattatcaagatataatttcttactttggtcagccctttttctgagcagaacacttttggagttttgctgtaattcaataaattgttatgtcttcttaagtttctcagggagaaatttacagtttcccagtgatccttcaaacatttactgggcatacaaagtagcctatcttgtttctcagagccccatgatgtgagtgaggaaagttattaggcttcattaatgcttaggcatcagcccagcgtattgtaaactacttggctgatcgtgctacctagcaactatattgctttctttaaacactttatcatccctatttgttgtttctattgatattgacagcagcttaagaaacattttattgaattgtgcagatacagttttcttatgtttgatcccaaagtccagttcttcatttacataccttcactattatactgccctaggaagactttcctatattatggttgatgcattattctgtcattcattagttttaatagcttgaggggagggattttctctcaactctatatatctctagtttcttatgtatatttaaaatactagctaccaatccttgagtacttattatcatttattaatttgtttattctctacatatttatagaatacccgctatgggtcacagatatgatagcaggcactagataacatgatcagccatgagagagcttataattaacaatctagcttattttttgacaggcagtgcaataggcacattgcatctgttatatataattttctgtgcaacgattctgagaggtaggtattatgactctcaactaatagatgaggaatttgagactcagagaagttaatcaagttgctcagtcacacagataaatggaggatttgagattcaaatgcaagtcagtcaggttctgtattagttttctatgctgtgtaacaaatactaagtatttagtggcttgaaacaacacacacttattacatcacagtgcctatgggtcaggagtcctggcacagcttagctgagttctcctctaaaagactacaatcaaggtgtcagcaaggactgacttctcaatctgatggctccactatggcagaatcaattttcaagctcatatgaatgttggcaaaattcatttctttgaggctgtagtgctcatggcattttgcttcttcatagccagaaaaagaaagaccctagtgtgagtcttctagaaaaagtattttataacataacatcatcattagagtgacatcctatcacctttgccaaattctattggttggaagcaaatagcagatcctacccacactcaaggggagggaagcatacaagggagtgaacaccaggaggtggggaacatggtggggccacattagagtgggtcacaggttccacaatctgtaattgttccactgtaccatgctgcatctagtaagagctcaacatctatgaattgattttttaaaattctgtaaagctatataacactattagaaaagtttaggggtaaaatccccataatctcatgatcccaacacagttcaatgagtctcctgagcaaggtgctaggtactcatgcctgctgtctcaaagccatcataatgatggtgtttgacttcctgttagtctttaaaaaatatacacagttctcctttttactgctgaaatcagagcaaatatattattctccagaattcctttctcaattttgatatcattaacattttttcctgttgctgaagaattgtatagctgtcagtttcagagtgctcacaacattctttcaactgtccatgccaccaaacatttattttatcagatccaaatgattggatatgcaggcaactttcaatcttccactgctgaaaacaagtaaatgaacaacaacaacagaacacagttacataactacttcagactcagaattctgccgtcttttggattatttacttaaactaggaatccagaagtgaaattactggatcaaataacatgaacatttccatggctctgggtgcatgctatcaaaatatttctgattttatttgactgacttaattaacagccttcaaaatttccaaggcatatgatagtgctattaggaactctgtgatcactggaaagacaatatcttaacctgtcctaaatcaaggtgttttggttgagagaagtggggagaattatcttctcttcatggccatgggccatttctaagggtcttagtctaccctggagttcaagtggaagacatggataccctcaggatactgccttacccttcatatcaaatgatgtcatgtctatggatatttttcctggtcacagtgtaggacagtgcctttcctacaatagatcagaggctattctcacaggacatttgggaaatctgtatttccttgtgtacagggacagattggactaatttatctatttagatgcagtactctgctattgtatgtatccactttagcagcacattttacagtagggttttctgcaatagaaaagtaaaaagaaaaaaagctaatgttatacacagtagactggctcatagttttcatccagttaacactaacaagaacagattaattgattattacttttcttgtgattcaagaactgatagtttggagtttgtagttacagtctgtttttaaaagtatctgttgtgagctggagaatttagctaccaaatttggtttgcatatgcctgccctgtgacctcacatcagcctgtttgaaggtttgtgtatttttgcttatccttatatgggaaggctgcctggagaatctgtctgaccaaaattagaagcactgtagcatttgtaggaagtgtggttttaggatgtggattgtctttgttgcatagagaaggtggtgagttggagaacatcttacagactataaaataatcatcatttcatagctcttaatggtccttataactagtcagattcccttgattctctagattcttgaacttgtcccttgacaaagttcccctagagagaattgaaatctatgcagaaactcactgtaccgaattggtaatggtagtgataagggcagggaagtggaagctggaatgaactggtttgtttgctttcaaaatcttagtgtaactctagtcagaaatttttgaaatggaaggtcaacatatgctaggctagcacttgtcacaaatttagttttggtacttgattgtgacagtgtgatttgtttcaaggaaggcttttgctttaaggcacctactcccaaagccctcagaacaacctaaaatacttgttcctctatttcccttttattactcattttctgtagccacctatggtcagaagccactgacactgttatggaagcactgttgtggaatgttcttaacttcacactttatttgactaaatacatgaaaacagtttcaaatggagataggactttattttggtaaagtcattgtaattcatatgaatcattgcttcttcacagaaactttttcttacgaaatcttaaagatccaggaggcttttattgctgctggcatgtttctttgtttcattatcacataatctcagactgggaaaggacaaaatgattacctaaaaaaacctatggtgtataaaaccttcaaaatactcaaaataaccaacaggtattcttgttttttcttaggccaaactttagaattaagcataatgcaaaagtattatgagtcatatctgcactcaaggaggcttcattaagttggcagacagtgtaattagcatgagacaacatacattgtagtgcgtgattttgttattcgtaggcttagtgtttaaatggtgctttttggtctgacagagcatgggtaactgtgtaacttggagcatgttccttaatccatctgagcatttgtctctttatctatgaatttggaatgaaaataataacagctgtctcataaggttattgttagaattaaataaaataagcatgtaaagagcttagcacagtgcctggcccataggaagcacttaatacataataattattgtattatactttacaatacaattatatctgcaatacagagagagacttaatacatatagaattccataacccattgctagcacactctaaagtggggtctgtgtctcactgtttcttcttatgagcccagccctaatatacccacttacttgtagcagaaagaggccaaactttgattaagggctcgttagattccatcattaaattatctactagtatggaatttgtgaccttataattataattaaagttccttcagaccataactactatctttattttagttttacttacatcagggtaagaacagtggccattaggctcaatgtgtactcagggactatcatcttgattgaactatagctcctaacattattaggcaggagtcgaacactgatccttccctagaagcagaagatcttagagctgaaattgggtattatactgattttgtttataatgatgtagaaattgattaaattgtgtacatactcatttggataaaaaaaggaagcaaaatcacagactggtaagtagaagttaaatttaaattatttagcaagaacacatcaaaagtgatattagttgtaaaagattgtcgaccttctataaaaatctcttaagaaaaaagccatataaaatatcatgaggctagacagtgaaaagtagtggaacaaacttaagatttagagttagggatatctaagtttgaattccagccttgacacccagttgctttgtgactgtggataaatttacttaacctttttgaatctcagtattctagtctgtaaaatggagataataatatctaccttgctgggctactataactattcaatgaaataatatatgcaaagtgcctgctatagctattatcacttaattgacctacaaatggtagctcttattgatatgaattataagaagacagtatctgtcttccagtattttcagaacacagcctcaaattgaaatcctcctgaatttggaaataattacagagcaccttctgatagcctaaagtgtctctctgtgatggaggagcccataacatatgtgcggtcagagctctaaatcttgtaaaaattttgtgctccaatctttttgtgttttggtaaagcagatgctatctctttaccataggatatgctagaaggatactttgtagggccctgggcatttttgaggactctttcttctgatcagctttcatctaggatttggagaataaggaagtactttgctagttgggaatggataagaatctgtgtgcaaacggtaactatgaacaatgcctccctgtattcaaatcctaggtaaaaagaatgcatgtaggcatattgtacattccacaggcgttagtacttaaagggtgggaggaatatctggcatcaaaaaagtgactaaaaacataagtaaacaccactaataaatggagttttctccaatcaattttggagaacccatcaatttaatttggtacatgagatgtttaatccaggagatttattttgaataaatatttccaaataagagtcaaaccatgaaaaatcctgcccagtcagcctcaaagactgatgtatattactttttaataaactatcataggttgctgattacagccaccttacttttctcaaacttcccagaaactctagaaagtatggtcagagtcccactatgcagtaggagcttttataaaagcaccttgactacttgagtgtgggctggatttattgactttattctaaatatacagtgatgaaaagggataaaaggtgcagaactctggcagacactactataaccagttattcaaggttaatatcaccatcaataagtccgttgctataatatgccctatgacatgatgtgatgagaaaggcatttcttctttgtggtatttgtcccaaatatccataaccccagtataattatcagaaaagcataacacaaacttgacctgagggacattctacgaaatacttaaccagggcccctgaaaactgtcagggtcacaggaaataagaaaagtctgagaaactcttacagcccagaggagactaaggagacatggcaaataagtgtactgacacaccctggaaaggaacagaaagagaacattattagaaaagctgatgaaatccaaataggctggagtttagttagtagtatcataccaatgttggcttcttagttgtgacagatgtaccactatgaggtaagatgttaacaacagcagaaactgggtgagtgatatatggagactttttactatattcgcaaattttctgtaaatgtaaattgcattccagaattaaagtttattataattaaaatctaaaaacattttggtggtgctgagtttaaaataaaattgtgagatcaatcagttttagtatctactttgtgtccagccctgtggtgagcactatatggggagacaaaagcaaaaggcatagtccctacctccagatagcctatcaactaactgaagagatgtgactttgacatgtgaaatgattggcaaacattggtactctttgattaagctccaaactgggtggtaaaaactgcaggaggtcagatggagtggccacagagaacttcacagagtagacctggaagaatagattagaatggcatcagtggagagaggggagacttgcagatgaagggaacaaagagagaaaaagcactggagtgttgggcatgacatgttcagaggagaataaaggcagcctgatctgatctgggagagaggaggctgcatacttttacagaggcagatgaagctgggcctcattatgcagggcattgaaagttaaacagtcagagagggtaggggttggaaccggccacagggaacctcagtagcagttgggtaactgtatgtgtttcaattctttgaatttcagcctttggccaaatttatgtctgtcatatattaatcagctaacaactgtcttggcatgtacgtttgataagacaagactatgtggggacgatttcacctgaagaggtgaaagtacagccatgcccactttctggattaaaaaggctctttcttaactaaatgaaatatcacttctgaataatctcatgtatccagacctttcttgtctggaacttttctctgtccatgctgttttccatagtcagaaggaactttagtccctttattgttactgactcaaagcttgtttctgctttcaaaagaaatacattgtaattagatcgttttgctctttaaaaagttcgttgggcattttttttttaaagtgatgggtgcagtgtgtaataagaaaaataaaaagaacagaaagggtctgatgcctttgcactttcttgtctgttttttttgtaaatttgaagtacagaaattatatcttccacactaactttgcccactcaaaactattaggtaactgaactcttgacaaagcggaggcatgtgctgtattgttctcggtgtggtccagaaaccagaggcctcgtggtgttctactcagttctcctgtgtgcatactgcctgtgttcatgcaagcccacataatagggggttaggacttcgttgaagtcagttaaggctggtcaagagaaaggagattataataactaggaattcatgttcactcataagggatatttaggacagaatataagatgtctcaacctttggtgtcttacttagttacatagtttagaaggaactcgctcatatgtcagtctccagctgaatttggagtatgtctagtatatcccccccatgaaagtagtgtactgtaagtaatgaaaaacaaaacaaaacaaaaacaaggctttgtagtcagctaaatttagacatgtaatttgatttaaagaccattaatagctctgtcttactgagcaggtttcttaacatctctgagcccctgtttcctttgccgtgaaatggatagccaccccaaaaagggtttgatattcagaaaacacttaacaagcactcaacaaatgttagtcttctgtccgtaaacgattttatcctgtgcatatctcgctgctaacatatagtaaggcttggaaatttccttttggggttatcttgggaggcttttcctattcctttattatgtgaccctctgttagaatatatataggggcaactctaggcaaaattctgagacaaagaaacttcactgtcttcattacctgattcactctaggtggtccctccctctacttcaaatatgctcactgtctgccctttctgtgaagactaaagtagggaatcagtaatggtagagtttcaggcaccgagagtagaattggctttagggtaggatgttactctcagtgctccttatttcacagcctcatgaagccatctctgaagaaatgggaaaatgactaaataatgttctttctgactccagaaaaaagtatagacagatagtaattccagataaaaaagaagtggataaagttattcagaactgatttcatagtcaagaagaaaaacccttttaacccagaaactgggaatgactgtattttttttttttttttttactgttaacacctgaagacatagcagtttttgagaaacatcctttaaggagctgcttacttttcacactagactctatttttgaaattatgtaagccttaacgtgtttttagaaaaggtactgcaggcatgattgtggtagaagtgcaactaaaaaagaaaacagagtagagttttttttttttcttttttttaatgatactttaagttctgggttacatgtgcagaacgtgcagtgttgttacagttaggtatacacgtgccatggtgatttgctgcacccatcaaccggtcacctacattaggtatttctcccaatgttatccctcccctagtcccacacccgccacaggccccggtgtgtgatgtttccctccctgtgtccaagtgttctcattgttcaactcccgcttatgagtgagaacatgcggtgtttggttttctgatcttgtgatagtttgctgagaatgatggattccagcttcatccatgtccctgcagaggacatgaactcatccttttttatggctgcacagtattccatggcatatatgtgccacattttcttaatccagtctatcattgatggacatttggttggttccaagtctttgctaatgtgaatagtgctgcaataaacatacatgtgcatgtgtctttattgtagaatgatttataattctttgggtatatgcccagtaatgggatggctgggtcaaatggtatttctagttctagatccttaaggaatcaccacactgttttccacaatggttgaactaatttacactcccaccaacagagtaaaagcattcctatttttccacaacctctccagcatctgtcgtttcctgactttttaatgatcgccattctaactggcgatctcgtggttttgatttgcatttctataatgaccagtgatgatgaacattttttcatgtgtttgttggctgcataaatgtcttcttttgagatgtgtctgttcatatcctttgcccatttttttgatgcagttgtttgcttttttcttgtaaatttgtttaagttatttgaagattctgggtattagtcctttatcagatggacagattgcaaaaattttctcccgttctgtaggttgcctgttcactctgatgatagtttcttttgctgtgcagaagctcttcagtttaattagatcccatttatcaattctggcttttgttgccattgcttttggtgttttagacatgaagtctttgcccatgcctatgtcctgaatggtattgcccaggttttcttctaggatttttatggtcctaggtcttacatttaagtctttgatccatcttgagttgatttttgtatacagtgtaaggaaggggtacagtttcagatttttgcatatggctagcaaaaatagtgttttcccaacactatttattcaatagggaatcttttcctcattgcttgcgtgtgtcagatttatcgaagatcagatggttgtagatgtgtggtgttatttctgaggactctgttctgttccattggtctatatatttgtcttggtaccagtaccattctgttttggttactgtagccttgtagtaaagtttgaagtcagatagtgtgatgccttcagatttgttcttcttgcccaggactgtcttggctatgcgggctgttttttggtttcatatgaagtttaaagtagtttttcccaattctttgaagaaagtcagtggtagcttgatggggatagcattgaatctataaattgcttttggcagtgaggccattttaacgatattgattcttcctatccatgagcatggaatgtttttcgatttgtttgtgtcctctcttatttccttgagcagtggtttgtatatttacttgaagaggtccttcacatcccttgtaagttggattcctaggtattttattctattagtagcaattgtgaatgggagttcactcatggtttggctctctgtttgtctgttattggtgtataggaatgcttgtgatttttgcacattgactttgcatcctgagattttgctgaagttgcttatcagcttaaggagattttgggctgagacgatggggttttctaaatatacaatcatgtcatctgcaaacagagacaatttgacttcctcttttcctaattgaataccctttatttctttctcttgcctgattgccctggccagaacttccaatactatgttgaataggagtggtgagaaaaggcatccctgtcttgtgccagttttcaaagggaatgcttccagttattgcccattcagtatgacatcggctgtgggtttgtcctaaatagctcctattatgttgagatacgtttcactgatacctagtttattgagagtttttagcatgaaaggctgttgaatcttgtcaaaggccttttctgcatctattgagataatcatgtgcttcttgtcgttggttctgtttatgtgatggattacgtttattgatttctgtgtgttgaaccagccttgcctcccagggatgaagctgacttgattgtggtggataagctttttgatgtgctgctggattcggtttgccagtattttattgaggattttcacgtcgatattcatcagggatattggcctaaaattctcttttttgtgtgtgtctctgccctgctttggtgtcaggatgatgctcgcctcataaaatgagtcaggtaggatttcctctttttctgttgattggaatagtttcagaaggaactacgcatgcaataaagctcctctttgtacctcgagtagaatttgtctgtgaatccgtctggtcctggactttttttgggtgctaggctattaattattgcctcaatttcagatcctgttactggtctattcagagattcaacttctttctggtttagccttgggagggtgtatgggtccaagaatttgtccatttcttttagattttctagtttattttcgtagaggtgtttatagtattctctgatggtagtttgtatttctgtgggattggtggtaaatcctcatcatccttttttattgcatctatttgattcttctctcttttcttctttattagtcttgctaggggtctatctattttgttgattgtttcaaaaaaccagctcctggatccactaatttttttttgaagggttttttttgtgtctctatctccttcagttctgctctgatcttagttatttcttgtcttctgctagcttttgaatttgtttgctctttcttctctagttcttttaattgtgattttacggtttcgattttagacctttcctgttttttcttgtgggcatttaatgctataaatttccctctacacactgctttaaatgtgtcccagagattccggtacattgtatctttgttctccttggtttcaaagaacatctttatttctgccttcattcattatttacccattagtcattcaggagtaggttgttcagtttccatgtagttgtgctgtttagtgagattcttactcctgagttctaatttgactgcactgtggtctgagaggcagtttgttgtgatttttgttcttacacatttgctgaggagtgttttacttctaattatgtggtcaattttagaataagtgcgatgtggtgctgagaagaatgtatattctattgatttggggtagagaggtctgtagatgtctattaggtctgcttggtccagagctgagttcaagtcctggatatccttgttaattttatgtctcattgatctgtctaatattgacagtggggtgttaaagtcttccattattattgtgtgggagtctaagtctctttgtaggtctgtaagaacttgctttatgaatctggctgctcctgtactgagtgaatgtatgtttaggatagttagctcttcttgttgaattgagccctttgccattatgtaatggccttctttgtctcttttgatctttgttggcttaaagtttgttttatcagagaccaggattgcaactcctgctttttttgccttccatttgcttgatagatcttcctctatccctttattttgggcctatgtttgtctctgcatgtgagatgggtctcctgaatacagcacaccgatgggtcttgattctttatccaatttgccagtctgtgtcttttaattggggcatttagcccatttacatttaaggttaatattgttatgtgtgaatttgatcctgtcattatgatgttagctggttatttcgcctgttaattgatgcagtttcttcatagcattgatggtctttataatttggcacgtttttgcagtggttggtaccagttgctcctttccaagtttagtaattccttcaggagctcttttagggcaggcctggtggtgacaaaatctctcagcatttgcttgtctgtaaactattttatttctccttcacttatgaagcttagtttcgctggatatgaaattctggattgaaaattcttttctttaagaatgttgaatattggcccccactctcttctggcttgtagggtttctgctgagagatccactgttagtctgatgggcttccctttgtgggtaacccgacctttctccctggctgcccttaacattttttccttcatttcaaccttggtgaatctgatgattatgtgtcttggagttgctcttcttgaggggtatctttgtggtgttctctgtatttcccgaatttgaatgttggcctgtcttgctagattggggaagttctcctggataatatcctgcagagtgttttccaacttgtttccactctccccatcactttcaggtacaccaatcagacgtagatttggtcttttcacatagtcctatatttcttggaggcttcgttcatttctttttactcttttttctctaatcttgtcttcttactttatttcattaatttgatcttcagtcagtgatatcctttccttctgcttgattgaatgagccattgaagcttgtgtatgcttcacgaagttcttgttctgtggttttcagctccatctggtcatttaagctcttctctacacttgttattctacttagccattcatctaaccttttgtcaaggtttttatcctccttgtgatgggctaaaacatgctcctttagctcggggaagtttgttattacagaccttctgaatcctgtttctgtctcctcgtcaaactcattttccatccagttttgttcccttgctggtgtggagttgtgttcctttgtagaagaggcgttctggtttttgcaattttccacctttctgctctggtttctcaccatctttgtggatttatctacctttggtctttgatgttgctgatctatggatgtggttttggtgtggatgtcctttttgttgatgttgatgttgatgctattcctttctgtttgttaggtttacttctacagacaggcccctcagctgcaggtctgttggcgtttgccggaggtccactctagaccctgtttgcctgcatatcaccagtggaggctgcagaacagcacatattgctgccagatccttactctggaagcttcgtcccacaggggcacccacctgtatgaggtgtctgttggcccctactgggaggtgtctcccagtcaggctacacgggggtcagggacccacttgaggaggcagtctgtctgttattggagctcgaacaccatgtcgggagaactactgctctcttcagagctgccaggcagtgaactttaagtctggagaagctgtcagccgccttttgttcagatataccctgcccccacaggtggagtctagagaggcagtaggccttgctaagctggggtggactccacccagttcaagctgccctgccactttgtttacattgtgagcatggaactgcctactcaatcctcagcaaaggtggacgtccccccccaaccaagctcccgtgtcccaggtcaatctcagactgctgcactagcagtgagcaaggctccgtgggcatgggatctaccaagccaggcatgggaggggatctcctggtcggctggttgcgaagactttgggaaaagtgcagtatttgggcaggagtgtacttctcctccaggtacagtaactcacagctttccttggccaggaaagggaaatcctatgaccccttgcacttccccagtgaggcaacaccccactctgctttggcttgccctctgtgggctgcacccactgtccatccagtccctgtgagatgaaccaggcacctctgttggaaatgcagaaatcacttgtcttctgtgtcaatctcactgcgagttgtagaccagagctgttcctgtttggccatcttggaagtgatcttctttttcttttagcaggaataaaataggaaatcttagattacactttaatgctgccacatcttggaacatctgtcacgagaactctagggagccaggggtgcaggtgaggaatgataagaaaattcttattagacattttaaccaagacttgtttcttgttggtaaagagaaatgaacaaagcctccaagaaatataggactatgtgaaaagaccaaatctacgtctgattggtgtacctgaaagtgatggggagaatggaaacaagttggaaaacactctgcaggatattatccaggagaacttccccaatctagcaagacaggccaacattcaaattcgggaaatacagagaacaccacaaagatactcctcaagaagagcaaccccaagacacataatcatcagattacgttgcattgtgatcaaaccacttttggaaatattgcaaacagacaagctgaaaaaaaaggtgtatcttgctgtggttaaccctgaaattgagcaagaagaagccaatggtggctgggcatggtggctcatgcctgtaatcccagcactttgggaggctgaagtgggcggatcatgaggtcaggagattgagaccatcctggctaacatggtgaaaccctgtctctactaaaaatacaaaaaaaaattagccaggcatggtggcgggtgcctgtagtcccagctactcaggaggctgaggtgggagaatggcatgaacccgggaggcagagcttgcagtgagctgagatcgtgccactgcactccagcctgggtgacagagtgagactgcgtccaaaaaaaaaaaaaaaaaaggaagacaatagtttagtaggtcgtggcagtattcatttaagaatagacacagatctgtttggttattgaaagactacacagtggcaatactgcactcgcttattgccaaactgactaactggggtttcagatttgatgttccttttagatgtattttgtaagtaacttagtaaaagactgaattggcagctttaaatgctgtttgttcactcctcatccactccactgttaaatcatttgacacagagtaggcaaagacagggtcattacttttcttttttttcttttcttttttttttttttttgagacagagtctcgttctgccgcccaggctggagtgcagtggcgagatctgggctcactgcaagctccacctcctgggttcaggccattctcctgcatcagcctcctggtagctgggacttcaggtgcctgacaccacgcccggctaattttttgtatttttagtggagacggggtttcaccatgttagtcaggatggtctcgatctcctgacctcgttatccgcccgcctcggcttcccaaagtgctgggattacaggcgtgagccaccgctcctggcccaggctcattacttttctaaaatgaagagtgacccttcctagggtagcatttgaaataaatggagccaaatggagggagactccgtatctgaatttctctttgaggaagttgactgagtcagtcaaaaattataacctgtttggaaaaagacaaatacacatacacaccatgatttatttatagagttcgattatatgtaataattcagtaggagaaattgtgagcatccatttagaaagtttccaagtttattttgtaatactgtaccttcattgttctagttcaatatgctgtcacctttgtgagctcagtttctaccgttggccagttatattaaattttattaagtatgtcatcctttcaccagaactatagattgtatgcaatatagaaggattaaaaatctaacatttgtgctctccttattaagcttagtctaagtggcattgctaatagcaataaatgcttgttctctcttctctcattggcgttgccattctcttggctcctctcacctaacaaccttgtattgttgtcttagcttcttatttaaatacgctattgtaattgaacttttaaatatatctatttctaatctctcccaatagattgtaatgtgaggaagggatcacgcctatttatctttagctagtttagagagtctaacaaagttcattgagagtcacttaagagacactcaagaaatattgttgaattacttctgacaatcattttatattttagcacatcatagtcaagaacttctgtcaatgttaattaactgttagtagagaaagtgtgatagaggttgatcattaaaaaaggcaaaattcccactttggttaaatggttttttttttttttttttggaaggtcgacactttcttttataaaaagggtattttcccatttgaagcatcattggtgaagttttgatctttctttggtatttgcaacattcacactggcaccttctaaagcagaaactttgtcactccccttttttgaaagaaacttgacccttagcatgacagaaagggagcttgctaagacttgtgggaagacaactgtttactccaggaaacaattgtttaatgtacctgctctgtgtctttggagagaagaataccctgaatctcaaaaatctaacatgtggacagaaatgacttggaattctttcggtagaggtgaggggtgtggtttactgtttgaaaaatatttatttaaattcctggacagtgcattgtccacttgcaaatgcatttatttgctgaaaagggtatcaatagccttttaactccaaagtcatttttatcctggaagaaatttaaattttatttctaaatgaacccttgtgacacctattcctcttggttctggcaatatatggttttcagtctcatgcattcactgtgtccccttattttaagtcctattagggaaattaggaaattaccatcaccagatgctcccttataagtgtgtgttatagtgaacatgtgcctataggtgtataagaaagacaataattggctgggtgcagtggctcatgcctgtaatcccagcactttgggaggccaagttggacagatcatgaggtcaggagttcgagaccagcctgaccaacatggtgaaaccccgtctctactaaaaatacaaaaattagccgggtttggtggtgtgcgcctgtaatcccagctactcaggaggctgaggcagaagaaatcacttgaagtgagctgagatcacgccactgcactctagcctgggcgacagagctagactctgtctcagaaaaaaaaaaagcaataattatttatatattagaaatctccacttgagtgcaggagtttgaagctgcagtgatgcaagctcatgatactgcattccagcctgggtgaaacagcaagaccctatcttggaaaaaaaaaattaaaggaatagattccttcttggaaataaacttaatatgtgaaattttggacttgaaaatttgatcaagttaggaaacatttttttttaactttccctgaagattcaaagctgaacaaaagttcatatttgacatggcagaacctattagcaaagtgtgattatggccaattctgttcagctttatggagatgtagaacacactagtaggtatgtgtacttgtcatcaggcaatctcagggcatgggagaaatacttggtcattactctccaactgatggctggagagtaattacttcagtgaaggtacactatcatgcctagtgataccaggcctggcgaccattttaacttagcacagtgagtcatgttctcgacaaagtaagcattcaataaggtaggaaaagcctcaaaaaataatttatcttaaaggtcctctgctcatgcaaatgtgactgatgacattctgccagggtcatgtatgtaaaattcttagcatgtctcttcactcattcaaaaaaaaaaatctgttggaatgcaagttccctcaaagtatggggttttcacacgttgcccaggccagtctcgaattcctgggctcaagcaatcctcctgcttcagcctcccaaaatgctgggattacagatgagagccaccgtgcccagccttgaaagtacagtcttaataggacatctttatatctactcaaatttgtaaatatgctaatgatcgacaaattacttgacacaattgacattgactgaacccacctactgtacctcagaaattgaaaccattgatttaatggaacctttcatcaagtgcattagtccactaggcactcctatttattgagttttacattgatttttctcagttcaaaagagggcatatgttacatttaggaatgaaagtttgattttataagccaattaaaaaacagaattcccattagaaaaattaccttgtagcaagttttgctagattctaactgatctttaaagagggacattcagtaccctaatctaaatagcattgaaaactttccgtttcttttgggagaaattgagaattattttcccgagtttatgtgatgagagagaaaattatttaatcacaatcacgagcaacttagaaagacaaaaacacaacttttatgcatatatgcatgtatgtgggggtagatggaggggtgtaaatccagagagggacttgattgtgagtttcttattttgcatttttattctcattggcagacagatttattttattttattttttgatgacaacactccatgtgtctttattttaatgtgattccatgaagaaacttgcttattgattacggtcctataactcagaaatgttaagttatggttttaaataggggttaattaccattgatgtgtgaatacaggttctaaaagaaatgcatgtcggaagagaaactgaactgaatagtattaattttactgttttcaaagctctcttctagctatgataaggagacagaatacatgtgccatctccacctggttatctagatgaacatattaaggtttggggcaaaggtaattgcagtttttgctattgaaggtaatgaccaaaactgcaattacttnnnnnnnnnnnnnnnnnnnnccattggtcacttagatatggttcagaataaacctcttcataaatattagagtttgatatttttagttgacaatactatggctccttacatggaacatttttctatttaaacccattcatatgaaccaccactagaaaaggactatacatacttacatgaaatcactataatttttttaagccctggtgtctaaaactgcatacaaactgcaatatatgagagaacaagaagcatcgtggtcacagtttattttgtaataacttgtgtaaattcaccagacagtgcagaaatccaagaaagaaatgaagtatgttatcatatgggttaatacttcaggcattagttcaccaatgtacttatcccattcttggtttaggctatgtaacagcacattcggcttacaagaattataaaataacctaatacataatacacataaaagataccttagcagcacatgataagggctaatgaatggtacagatatattgcaaactttatagtttgtaggattagctaatatattcttgttcagtttctgttttgaacactgaaaattgagacttgaatgactcttgaagcctgtgcactttgtcaaggaaagattcatttctattgcatatacaattcttgttaagatgggaagcagacgcatcatttggaaaaaactttcttgaaaggctgaaactaagagaggcttgtagagtatcagaaaacataacttttcactgcacataatttggagttaactgcatttttagatattgatatgcatcagttagttttgcatgtacatcattaaataatgaaaattttcaatggaaaaaaaaaagagaaattcaacttgataaaaggaccagtggaccaaaagctcttcaatatacttgtgaggcattattaacaatacaataataaagagtgaaaatcatataacttctgtgaaaccacaatctttgttctgtctgaattcatttctgccagctcacaaacatttgacttttgttgaatttggaaaatacggtttcttgtcctttggtcctagattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggtaagaaaacaatttaaattcttgtttattgtaatagattgccccaaatctatccattattttcacctctgcctccaagcctgcatatatatagtcatatctcttgcatatagtcatttgtcctttccatccactcaaaggctggatgtagacaatggctacattttctaaatatgtttgctattgattatgcatcacagccaaatttaggaaagtttatttgttactttttgagaatgtgttgtggcttataagatgacagtaggaatcccaaccaaatttagtcatgtgaagattctcttgcattccccaggttgaaacctcttagcagtttggttgctcttctggtcatgcatcatggacatctcattgcctttctcaaaacacagcaaagattaactattcttctggccttgggcatgtctagctaatatctagtctattgtaggctctgagaaaatctcaacctaaatgaataatggaacagaaatatggtgaatggaaacaacagtgtctgaccagaaataaacatcttcttactgggaaataggtggctgttttgcatggtggaggaagctgcaggcagagttaaattccatgtgatgtggaataaatcattctgcagtttttgtgacatagaatagcatacttttcaacctatattaaataagatccagaagccttgcctctttattactccttattccttccagaattctagtattatggaagttagtctctctgtccccaaggaggtagatgattctgtcgaccagtcaggtcattctgaataaatctcctttttttcttgagatggagtttccctcctgttgcccaggctggagtgcagtggggtgatcttggctcactgcaacctccgcctcccaggctcaagcgattctcctgccgcaaccttccaagtagcggggattacaggcatgtgcccccacccctggctaatttttgtatttttagtagagacagggtttctccatgttggtcaggctggtctcaaactcccaaccttaggtgatccgcccacctcggcctcccaaagtgttgggattacaggcgtgagccactgctttcggctgaataaatttcctttttttcttttattggttgcatattgctaattcatcttatcttcttttcatcaaggactatgatgccttctttgaagccagagaaaataatgcagtgtatgccttcttaggcttgacagccccacctggttcaaaggtatgataccctttttttcctgttttataggtcattttattgctgctgaacttttttaatcagtaagattttcatttttgttaagtattcaaattaagtcagagacaatcctttatagcaaaaagtgccttctctgcatccacttaattcctattagggcagaaagatgtgcataaccaaatgcataaactatgtgtttagcaggtaggtagagtgacttccccatcaagctgcccatgggagcaaatttctcattgacctatgcacagataagtgcttagcaattttaaagccttcattattccagctgtcctgcatggttctacatcgacagtaagcatcttagttcatggtaatctccttggcagcacttattgtctttgtgtgagagcaaatgatagagtcatccattcaagttaattaagagcatctgcattgcaaaactggtcactaaattgctcgccaaatttgaggcttttttcctgccaacacaaattaattttttaagtagcagcattttcaggagagaccaaataaagaaagcaacaataaagttgcctgtctagtgagatgtccccaaactatcaactttaaacatacctttgccttttatagtagttcttcacacaaactgccttaatcaaaatgcgtgtctcttgctctgtcattttatgttttgctcttagcaactaattgtatgttagacagattctttgaactccaattccctctcctattttaaaaggctgtgttattgtctgttttcactagacaaaaatttactagtactgtgttcatgtcattgtaaaatggttttcttgccgaactttcttttcccatggataaaatcttatattttaggctttgtacaatttgagccataagaaaagtgaggtaaggcacttttctttaaataagatagagtactagattgcagcatctgcaatccagacagagcagcatctggaggcttgcattgtgcattttagccccaaatagactgcaagaacaaaccagcaatcctgagaggacccacagaccctctcaaggaagtggactgctcatgtaggactcaggagacaccccaaatactgtgagtgccccaactgaggaagtggaaaagggagaccctcctctcccgaacagataccctcactggagaaactgaaggtctgtttgcgggagaagtttccaactttacctggagctgagtcaagttagagagcccagcgaaatacaggggtaaaggaagcaacaggaaggccctggtatctcgctgggtccccaggcagctcatttctgcctggcaccatagggatccatcgggagggtggccagaggagcaggggttaaaactccacagaaagaaggaattctctagccaaattttgtaacaattcgaaaggggaagaagcctcctggccagaactcgggggagggtgcaaatctcgcttgcagacttcacaggcaagggaagaaccaaaacccttttctttcgcagctgggaggtggatagccttgggtgaatttttaagcccctcttgccctccacctggaaacagactcagggctgttggacgggggcttggtggaagtgagaccaacccttcggtttacctgggagctgagtgaggcctgtgactgctgattttacaggacttccctgacaatctgcctgactcagcagaggaagccatcctaggtatagaactccagtgacctgggaatctcacccccacccctcacagcagccacagcaagacccacccgaggagagtctgagctcagacatgcccagcccctcccccacctgatggtccttccctttccaccctggtagtggaagacaaagagcatataatcttggaagttctagggccctgcctactgcgggtccctctccgcaatactacagctgatggtttctggaaagcgccacctcctggccaaccagcataaaaatagagcattaaaccaccaaagcttaggaccctcacggagtccattgcaccctccacctcctccaccagaccaggcactggtatgcatggctgagagacccatagatggttcacatcgcaggactctgtgcagacaaccgccagtaccaaccaggatctgggtagactcgctgggtagctagacccagaagagagacaacaatcactgcagtttggctcacagaagccacatccataggaaaagggggagagtactacatcaagggagcaccccatgggacaaaataatctgaacaacagccttcagccttagaccttccctctgacagagcctacccaagtgagaaggaaccagaaaaccaacagtggtaatatgacaaaacagttcccttcaacatctgcaaaaaaatcacactagctcaccagcaatgatccaaatcaagaagaaatccctgatttacctgaaaaagaattcagggggttagttattaagctaatcagggagggaacagagaaaggcaaagcccaatgcaaggaaatccaaaaaatgatacgagaagtaaagggagaaatattcaatgaaatagacagtgtaaggaaaaaaacaataaaaaattcaggaaactttggatgcacttttagaaacacgaaatgctttggaaagtctcagcaatagaattgaacaagtagaagaaagaaattaagagctcaaagacaaggtctttgaattaacccaatccaacaaagacaaagaaaaaagaataagaaaatacgaacaaagcctccaagaagtctgagattatgttaaacgaccaaacctaagaataattggagttcctgaggaagaagagaattctaaaatcttggaaaacatatttgggggaataatcaaggaaaacttccctggcctagctagatatatatacatccaaatacaagaagcacaaagaacacctgggaaatccattccaaaaagatcttcgccttaggcacactgtcatcaggttatccaaagttaagacaaaggaaataagagctgtgagacagaagcactaggtaacctataaaggaaaacctatcagattaactgcagatttctcagcaaaaaccctacaagctagaagggattaaggccctatcttcagcctccttaaacaaaatgattatcagccaacaattttgtatccagtgaaattaagcatcatatatgaaggaaagattcagctcttttcagacaaacaaatgctgagagaattcgccattatcaagccaccactacaggagctctaaatcttgaaaggaatcctggaaacacatcaaaacagaacctctttaaggcataaatcacacaggacctataaaacaaaaatacaagcttgaaagcaaaagcaaaaaacaacaatgaaaaaatctagagtacacaggcaacaaagagcacaatgaatgcaatggtacctcacatttccatgctatcattgaatgtaaatggcttaaatgcttcacttgaaagatacagaactgcagaatggataagaactcgccaaccaactatctgctgccttcaggagactcacctaacacataaggaggcacataaagtaaaggggtggaaaaaggtatttcatgcatatggacaccaaatgagagtggggcaactattcttataacagacaaaacaaactttaaagcaacagtggtaaaagagacaaagagggacattatataatggtgaaagaccttatccaacaggaaaatatcacaatcttaaacatatatgcacctaacactggagctttcaaatttataaaacaattactaatagacccaagaaatgagatagacagcaacacaataatagtgggggaattcaatatcccactgacagcactagacaggtcatcaacacagaaagtcaacaaagaaacaatggatttaaactctaccttggagcaaatgaacttaacagatatatacagaacattttatccaactgcagaatacacattctattcaacagcacatggaactttctccaacatagaccatatgataggccataaaatgagcctcaataaatttaagaaaattgatattatatcaagcactttctgagaccacagtggaataaaactggaaatcaactccaaaaggaaccttcaaaaccatggaaatacatggaaagtaaataacctgctcctgaatgagcattgggttaaaaacaaaatcaagatggaaattaaaaaattctttaaactgaatgacagtaatgacacaacctatcaaaacctctgggatacagcaaaggtggtgctaagaggaaagtttatggccctaaacgcctacatcaaaaagtctgaaagagcacaaacaatctaaggtcacacttcaaagaactaaagaaacaagaacaaaccaaacccaaacccagaagaagaaagaaataaccaagatcagaacataactaaattaaattgaaacaaaaaaatacaaaagataaaatgaaacaaaaagctggttctttgaaaagattaaaatggatagaccattagcaagattaaccaagaaaagaataaaggaaatccaaataacttcactaagaaatgaaacaggaaatattataactgacaccactgaaatacataagatcattcaaggctaatatgaacacctctatgcgcataaactagaaaacctagaagagaatggataaattcctggaaaaatatcactttcctagcttaaatcagaaagaatcagatacatttaaaagaccaataacaggcatcaagattgaaatggtaatttaaaaattaccaaccaaaaagtccaggattagcctgattcacagcagaattctactagactttcaaagaagaattaataccaatctgttggactctattccacaagataatgaaagaaggaaccctctctaactcattctatgaagccagcatcaccctaataccaaaatcaggaaaggacacaaccaaaaaagaaaactacacaccaatatccttgatgaacatagatgctaaaatccttaagagaatactagttaactgaatccaacaaaaaagcaaaaagataatccaccatgatcaaatgggtttcataccagggatgcagggatggtttaacacacacaagtcaataaatgtgatgcaccacataaacagaattaaaaacaaaagttacataatcagctcaatagatgcagaaaaagcattcaacaaaatccagcatcactttatgattaaaactctcagcaaaatcagcatacaagggacataccttaatgtaataaaagccacctatgacaaacccacagccaacataatacagaatggggaaaagttgaaaacattcccactgagaactagagcaagacatggatgcccactgtcaccactactcttcaacatggtactggaagtcttagccattgcaatcagacaagagaaagaaataaagggcatccaaattggtaaaaaggaagtcaattggtcactgtttgctgatgataggatcatttatcttgaaaaccctaaggactcctccagaaagctcccagaacgataaaagaattcagcaaaatttccagatccaagattaatatacacaaatcagtagctcttctatacaccaacagtgaccaagtggagaatcaaatcaagaactcaaccccttttatgttagctgaaaaaaaaaacccacttaggaatatacctaaccaaggagtagaaagacctctacaaggaaaactgcaaaacactgctgaaagaaatcatagataacacaaaaatggaaacacatcccatgctcatggatggatacaatcaatattgtgaaaatgaccaaactgccaaaagcaatctacaaattcaatgcaattcccattaaaataccactatccttcttcatagaaaaaaatcctaaaattcatatgaaatcaaaaagtgattgagagggcctaaaatgggacagcagttttggaaaggaaaagatggatttaggagcctccccccaccaaaaaaaaaaaaagttacaggatttaggaattaatgagttgcttgtgcctgtaaagacctgagcgggattaaagctagccatgggatctctaaccttggtgattgggaaatgaagaaaagatcatggaggaaatagaaaagtcagtgatccagggaagaagttagccttggaaatagcatgtggtgttctgagagtggatgaaattaggagaaaggaataaaaataaagagaaattttaatgtgtgggaaggttagggaaagtcagatttgaaagtataaggcaggaggaaaacttatccgcaaggagtgaggggaaatttgaaacattagatccctgaggagaattgaacagattcagttgaaaattggctagggaataggctaagatcataaataaataaataaataaacagacaaataaataaaaaacagctaagcagggcccagcagtagttagaactgatgggcccataggaagctagacatcttggttaccatgtttcttccatcattgcttaagctcaggagtaggaatagagtaaatgaatagtgaatgttatgaaggatgggcaagaaggacctgatagactgggttaacaagaataggtgtggtattgacaatgaacatgaagagtggattggtgatagggagattttgaattttggtatttaataggtttttccaagactagaagtgatccatttcatgtcagaatgatatttttatacttcagctcaatttctagagttttcccctttaacaggataataagccttcaacaaagaaccagatgaacagaaagtatactaaataagaaagacaactggttaacccacattgaaaaagtgaattgataataaaagttatatgataaaatgagataaaatgtttagctgtaaattcagcaaaactaaaacaaaatgataatagtgctgagaagggtggattgaaacagttgctataatacgttactgatgttggcataaattggtacccctttttgaaaaccaaaatggcaaatacgtgtcaaggatctcaaaaatattggtactccttcacccagtggtttcacattgggtattataatcaagtgaaataatcctatacgtggaaaaagcttcatagataaaaatgtgaatagaagtgttaattataatcttaaaactttgaaaacaagttaaatgcttaacatatttaacaagaggttcaactaaattcatgcattgaatggactttatggataaaatatgaatcaaagtattatactgtgtctaattctgaactttagaaactagttaagtatctaacgatagcgtcaacaaaaatagtttatctactgaatgaacttggactgtcatgaagaaaatgaaaatttgtgaaaacatatatgtaaatgagctacagaattattttgaaagtaaggttaatattctaattacatttaaaatgtatggataggacaaaaaaagaaactgaaaggtagttaatatgcattttctcctattctctacttttaaataattatcaaacatactctttacatttaaaaaataattgaaaccaatgcactggagagcttgatattgaaaagtactctgtgtcaaatatttccataaggcaaagaatccttctgtgtaagacaaataattgttgtattcttttttatattggattgtttaaaacaaggtatgtatttgtctactgtgattcactcaattttgtcaatatgaaatatttcttagtactggcatttcttactttaaagtggagatgatggttttgagatatgaaataagatcactgatatttttaccacaaaataaatatttggtgatgcttgtgcagaaaggaaaacgactctattggcaaaggcatgttcacttatgttgaaagaatagagggtatgggtcagagaaatgtcctcgttagctttagttgaattaaactgctccagggaggagctccggagtccatctctgctgtgagatttgaagcaatcctatttatactgaattcatcctatttttactacatctccaagagagactgcatgttcataaacttagctgtggtattgattttagctactaggcaaaaaaaaaaaaaaaaaaaaaaaaaagagaggggaaaagcaggaaagaaggatggatgcctataatgggccaaacactgagataggcacctcaggtacatctcattttatctttccaccatccctttaggatagatataattagaagcactttagagaggataatttaagtaatttatcaaagggtatataatgatttagtagtgaagctgaaattttagcccaggattatctgatttaaaaccagtgcctttatggaatgatgtttacattgggaatacggaggaagagaacattatatgcttgctcttaaagctctctgtttgattggatgactcattctacaaatactgacaatttgcttgtaggcactaataaggagttcagataaattcacatatttgatatataaaataagattagaaaggtaaataatttactgtaactttgatgtgttctaaagacaaattataaagaattttgagatgaattttgttctggatttctatgccagtgatttctcccattaaaaatgataacttagagctgcagaatttatgacaaattataggaaagattgatagtgtgtcactttagggaaataaacttctttccctatatgtgtaactagtattaatccaaaatactagttacaaatcgaaatgaagaaaacaatacaaaatgaaagaaaacgttggtattttgaaaagttaaacaaaattgacaaacttttagccagactaagaaaaaagtggagaagatttaaataaaaatcatagatgaaaatgagacattacaacttatactgcaggaattcaaaggattattagtggctgctacaagcaattatatgccaataaattggaaattctagaagaaatagacaaatttctagacacgtacaatcaaccaagattgaaccatgaagaaatccaaaacctgaacagaccaattacaagtaaaaagatcaaagccataacaaaatgtttatcagtaaataaaagcctgaaacccaatggcttcactgctgaattttaccaaacatttaaagaaatgctaataccaaacactgcatgttctcattcctaagtgggagttgaacaatgagaacacatagacacagggagggtaacatcacacaccgggacctgtctgtgggtgggggagtaggggagggacaagattaggagaaatacttaatataggtgacgggttgacgggtgcagcagaccaccagggcatgtgtatacctatgtaacaaaactgcatgttctgcacatgcaacccagaacttaaagtataataataaaaaagaaatggcaataccaattttactcaaactattctgataaatagaggaggaacgaatagttccaaaatcattctacaaggccaatattaccctggtgccaaaatcacactagaatacataaaaaagaaaaagaaagaaggaaggaaggaaagaaagaaagaaagaaagaaagagaaagaaagaaactacaggacaatatctctgatgaatactgatacaaaatttttcaaaaatatattagcaaacagaattcaacactatattagaaagatcattcatcctgaccaagtgagaattttttctggaatgcaatgatcattcaatatatgcaaatcaaccaatgtgacacattatatcaacagaatgaaggataacaaccatctgatcatttcaattgatgctgaaaaagcatttgatataattcaacgtcttttaagataaaagccatcaaaaagacttagtatagaaggaacatacttcaacacaataaaagccatatatgactgaaccacagctagtatcatactgaatgaggaaaaactgaatgcctttcctataagatatggagcactacattgatgccactttcaccactgttatttaacatagtactgggagtcttagctagagcaaccagccaagaaaaatacctaaagttatccaaactcaaaatgaagaagtcaaattatccctgtttgcaaatgatataatgttgaattcaaagagttttaaagacttcaccaaaaaaccattaggactgataaacaaactcagtaaagttgcaggatgcaaaatcaacatacaaagtcagtagcatttctatatgtcaacagcaaataatatgaaaaataatataagaagtaattccatttacaatagccacaaataaaattaaatacctaggaattaacttaaccaaagatcttaaagttttctacaatgaaaatgtaaagcattgatgaaagaaattgaagatgacataaaaaattgaaaaaatattccatgatcatggattgaaataatcaatacattaaaatgttcatactgtccaaaacaatctacagattcaattaatataaaaatatcaatgacattcttcacagaaataaaaaaaaatctaaaattcatgggtaaccacaaaagacccagaatagccatagctatcctaagtgtaaagaacaaaactagaggaatcacattacctgacttccaattataatacagagctatactaatcaaaacagcaaggtattggcataaaaacaaacacatacaccaaggtgacagaatagagaacccagaaacaaatcctcacatctacggtgaactcatttttgacaaaggtgccaagaacatacactggggaaaagagagtcacttcaatagatggtgctgggaaaactggacatccatatgcagaagaatgaaacttgacccctatctcttgccatatacaaaaaccatttcacaatgaagacttaaatctaatacctcaaactatgaaatgactacaagaaaacactgtagaaactctccaggacattgatctgggcaaaaatttgttgagaaatatcccaaaagcacaggcaacgaaagtaatcatggacaaatgggatcacatcaagttaaaaagtttcttcacaacaaaggaaacaataaacaaagtgaagagacaacccaaagaatgggagaaaatatttgcaaactacccatctgacaggggatcggtaacgagcatatatgagaggctcaaaccactctataggggccatgcatggtggcttagacctttaatcccagcactttgggagactaagacgggcagatcacttgaggctaggagtttgagacctgcctgaccaacaaggtgaaaccccgtctctactaaaaatacaaaaattagccgggagtagtggcacaaatctgtaagacatgcttctcaggaagctgagacacgaaaatcacttcaacccaaaaggtggaggttgcagtgagccaagattgtaccactgcacttcagcctggttgacagagtgagactgcctcaaacaaacaaaaaacaactctataggaaaaattctaataatccaattaaaacgtaggcaaaagatttgaataatcctttgtcaaaagaagacatatgagttgcaaacagatgtgaaagtgtgctaaacatcactgatcattagagaaatgcaaataaaaactacaatgagatataatctcacctcagttaatatggcttttatccaaaggtcaggcaataatacatgctggtaaggatgaggagaaaagggatcattcatacactgttggtgggaatgtaaattaatacagccactatacagaacagtttggaggttcctcaaaaacctaaaagtagaactaccatatgattcagcaatcctgctgctgggtatatacactaaaaaaagcaaatcagtatatcaaagagatatctgcaatctcatgtttgttgccacactgtacacaatagccaagatttggaagtaacctaagtgtccatgaacagatgagtgggttaagaaaatgtggtatttatacataatagagtagtattcagccatgaaaaagaatgagatccagtcatttgcaacaaaatggagggaactggagattaccattttaagtgatataagccaagaacagagagacgatcaccacgttctcacttatttgtgggatctaaaaatcaagcaattgaactcatggagatagagaatagaaagatggttaccagaggttgagaaaggtagtgggtgattgagaagtgggtttggttaatggcacaaaaaacagaaacaatgagtaagatctagtatttgataccaaaacatgaagactacggtcaaaaataaattaattgtatactttaagataactaataatataataattatgttgtttataatacaaacaatacatattggagttatggataccccgtttacccagatgtgattattatccattgcatgcctgtatcaaaacatgtcatataccccataaatatatatacctactatgtacatacaaaaattcaaaataaaaaaaagaacaaaatactggctatggagcaatgttaggtccttagaggaaaaaggatttcatgttaggtcatttttgcattattatacaactgcttctccaactatgtatgctatgtttttgaggggtcttagtataaattattttttgagttatgtgtagaaattcttgaaagcttgttctataaaatgaagcaagatgcatactgtgactttaacatattcattttgacatctaaacactgttaaagcttcaaaagaacttagggacttttccttttttgactaggcatttgcaaaggtgagtctattagttcattctcacactgctataaacaactacccaagactgggtaatttataaagaaaagaagtttaatttacttacagttccacaggctataaagcagacatggcttgggaggcctcgggaaacttacaatcatggtggaaggcaaaggggaagcaagcacatctacacttgttggcaggaggcgttgagttaggtgctacacacttttagacaagcagaaataaggggatggtgctaaaccattagaaaccaccccccatgatccaatcagctctcaccaggcccctcctccaacaatgagaattacaatttgacatgagatttgggtggggatgcagagctgaaccatatcattatgcctctggcccctcccaaatctcatgtccttttcacattgcaaaatactgtcatctcttctcaacagtcttccaaagtcttaactcctttcagcattaactaaaaagtccaagtccaaagtctcatttgagatgaggcaagtccatttttcctataagcctgtaaaataaaaagaagttagttacttccaagatacagtaggagtacaggcattaggtaagtgctcctattacaaaagggggaaattggccaaaactgacaaaattgctctatgtaagactgaaaccaagtaggacaattattacatcttaaagtttcaaaataatcttctttgactgcatgtctcacatccagggcacactcatgcaagggatgtgataccagggccttgggcaactctgatcctgcagctctgcagggtacagccttggcaactgcactcatgggctggtgatgagtgcctgtggctttaccaggtccacggtgcaagctgtgagtggatctaccattcttcctggaggcagtggcccctttctcacagctacactaggcagtaccccagtgtagcctctgtgtgggggctccaaccccacattttctctcagcactgccccagtagaggttctgcatgagggctccatgcttgcagcagacttctgcctggacatccaggtattttcatacatcctctgaaatctaggccgtgactcccaagcttcaactcttgcctgctgtacccccacagccttaacatcatgtggaagtacccaaggcttgtagcttccatcatctggagcagtggcctgacacatatctggggcccttttagccatggttgtagctggagtggctggaacatgagttgccatatcctgaggctgcacagagcagtggagctctgtgcctggcccacaaaaccattttactattccaggcctctgggcttttgatggcaggggctgccataaaggcctctgaaatgccctggaggcattttctttattgtcttggctattaacattcagctccctttacttatgcaaatttctgcagtcagcttgaatttcttccctgaaaatgggtttttattttctaccatacggttaggtttcaaattttccaaacttttattatctgcttcccttttcaatgtaagatgcaatttcagaccatttctttgtgaatgtatatgagctatgctgttagaagcagccaggctacatcttgaaccctttgctccttagaaatttcttccaccagagaccctaaatcagggatgtccaatcatttggcttccctggaccacaatggaaaaagaacaattgtcttgggccacacataaaatacaatgacactagtgatagctgatgaactaaaaaatattgcaaaaaaaaaatctcataatgttttaagaaagtttatgactttgtgttggatcattgatatggtttggctctgtgtctgcatccaaatctcatcttgaattgtactcccacaattcccacgtgttgtgggagagactcagtgggagataatttgaatcatgggggcagtttcccccatactgttctagtggtagtgaataagtcttgtgatctgatagttttatcagaggtttctgcttttgcatctttctcattttctcttgctgccactgtgtaagaagtgcctttctcctcccccatgattttgaggcctcctcagccatgtggaactgtaagtctaattaaacattttttttttcttcccagcctcgggtatgcctttgtcagcagggtgaaaacggactaatatggtaaattggtaccagcacagtggagtgttgctgaaaagatacttaaaaatgtggatgtggccaggtgcgctggctcatgcctgtaatcccagcactttgggaggtcgaggcaggtggatcacttgagatcaggagtttgagaccagcctggccaacatgctgaaaccctgtctctactaaaaatacaaaaagtagctgggcatggtggcatgtgcctgtagtcccagctacttgggaggctgaggcaggaggatcacttgaatcagggaggtggaggttgcagtgagctgagattgcaccacggcacaacagcctgggtgatagagtgagattccatctcaaaaaaaatgtggaagtgactttttaactgggtaacaggcagaggttggaacagtttggagggctcagaagaagacaggaaaatgtgggaaagtttggaacttcctagagacttattgaatgactttgaccaaaagcttgatggtgatatggacaataaggtccaggctgaggtggtctcagatagagatgaagaacttgttgggaactggagcaaggtgattcttgatatgttttagcaaagagactggtggcattttgcccctgccctagggatttatagaactttgaacttgagaaaggtggtttagggtatctggtagaagaaattttgaagcagtaaagcattcaagaggtgacttgggtgtggttaaaggcattcactttcataaggaaagcagagcataaaagtttggaaaatttgcagcctgacaatgtaatagaaaagaaaagcccattttctgagaagaaatgcaagccggatgcagaaatttgcataagtaatgaggagccaattattaatccccaagaaaatggggaaaaagtctccagggcatgtcagaggtcttcacggcagccccttccatcacaggctcagaggcctaggaggaaaaaatggttttgtggttcagacccagtgtctgcatactgtgtgcagtgtagggactttgtaccctgtgtcccagccactccagccatgactaaaaggggccaaagtacagcttgtgccatggctgtggtgggcacaagccccaagccctggcaacttccatgtggtgttgagcctgtgggtgcacagaagtcaaaaattgaggtttgggaatctctgcctagatttcagaggatgtatggaaatgcctcgatatccaagcagaagtttgctgcagaggtggggctctcatggagaacctctgctagggcagtgcagaagggaaatgtggagttggagcccccacacagagtccctaccggggcaccgcctagtagagctgtgagaagagggccactgtccttcagaccccagaatggtagatccactgacagcttgcaccatgtgcctggcaaagctgcagacactcaacaccagtctgtgaaaaggtctgggagggaggctgtaccctgcagagccacaggggcagagctgcccaagaccatgggaacctaccttttgcatcactgtgacctggatgtgagacatggagtcaaaggagatcattttggagctttaagatttgactgccctgctggattttgaactttcactgggcctgtagcccctttgttttggccaatttctcccatttggaacatctgtatttacccaatgcctgtaccatcgttgtatctaggaagtaatgaacttgcttctgattttacaggctcataggcggaagggactttacttgtttcagatgagacttcagactgtggatttttggtttaatgctgaaatgagttaagactttgtgggacttttgggaaggcatgactagttttgaaatgtgaggacatgagatttggagaggtcaggggtagaatgatatggtttgtcactttgttctcacccaaatctcatcttgagttttatttctataattttcacctgttttgagagggactcgttgggagataatttgaatcatgaaggcagtttcctccatactgcttttgtggtagtgaataaatctcaccagatctgttggttttatccggcgttttcacttttgcatcttcctcattttctcttgctgcctcctcttaagaagtgtctttcaccttccgccatgattctgaggtctccccagccatgtgggactgtaagtccaattaaacctctttttctccctcgtcttgggtatgtctttatgagcagcatgaaaacagactaatacagccacattcaaagctgtcctgggcagcatgcagcccacagaccacaggtttgacaagcttgccctaaaccatctctctcaagtgcaaatttcaacagatcccttgagctggggcacagtgtcaccagtctctttgctgaagcacagtagttgtgaccattactccagtttcaaataagttcttcatcttcatcagagaccacctcagtatggaccttattgtccatgtcactatcagcatttcggtcataacaatttaacaagtctctaggaagctccaaactttccatcatctttctgccttcttctgagccctccaaattgtaccaacctttcctccaaagttggttccacattttcaggtatctttatagtaataccccacccctggtaccaattttatgtattagttcattcttacactgctataaagaactttttgagattggacaatatataaagaagaaagaggtttaattgacccacacctccaaagactgtacaggagccatggctgaggaggcctcaggaaacttacaatcatggcaaagggtgaaggggaaggaagcacgtcctcgcctggtggcaggagagagagggagaggtgctacacacttttagacaagcagcagtaggaggatggtgctaagccattagaaactgccctcatgatcaaatatcctcccagcaggctgctcctccaacactgggaattgcaatttgacatgggatttcggtggggacacagagccaaaccatatcaatgagtcagtagtatatttcgttatttttttaaaggatatgaagaatgaattttggtgtcatttaatattttcttctttcctctacttttgccttttttgggtaaaaatctagtgtctcttttagcttttctcccttcttttgcatgtaatactgggactcatttggacagtatcagtcctcctgagactgtcaagtattgatttagtgacaggtgtttagaatgatgttgtctaccacgcttgatttctacaacttaagtctgatgtttccttttctggagtcaatcttgccactcatctttagttcaacaaactttccttgaagtttattttgtgtcaagtaggtcagagttcctatgctagaggtgagtacctcactatccagaggagaaggaagacaacctgattttttggtgtgtattctatcataaaacatgaaaactacaatattttaatggatagcacattttctaagtaatttaaaccttaattaaccaaaacccaactaattttaaacttaagtaaccatgtttttatattctcaattttcatgaaaaaaaatcacacaaaaaggaaactgactatttttaagtaaaatatcaattataattgtatatcacttgctttcatgaaagtattccaaatcattaggaatgattaggtagtctttttgtgtatctgtttctagaaatctgtttgtattatatagtttttctattaagaactttttaagaaatctcttctgggggcttttgtttattcttagtagttggaactaatgtagtctgactaaaatacacatgggtgtctgctctgtgatgtttaaacttatctgttttgtttgtttttcatttcaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaagttcttgcaggtaatgtttatgatatgttaaacgttgtaatttcctatcgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaagtgggatgccaagtaagcttaaaatggcattctctagcaaagagattagacttttaaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacataacttatgtgttcttggagtttatataatagtaattttagatgagtaatatctttttttagagggttgggaatgcaaaaagagaaaatagtagaaagaaaaagctttgaatgcaattcaaggttttcgttttctatgttttctttttagggcttttaatctcacaatacacatgaggtcaaatgaacaattttattgggtttacaaaaatacggcataaagaactctagagaaaacagggtgctttgtaatacactggaaacgcaaaaaaagttttttagtcaatattttctcctaagctttattaaatgttgctgatgatacttgcaatattttatgtggtcattttcacttttattttaatgtcaaataagttaacactgccaaaatgggcattctttaaaaatagatgtattttttgccatgtttatataacttaaaattaacatagtatattaaagtaaaaggttgaattgagtcttcctaaactgaaatattttattttgtcagctgagaaatatgttttgtagatacaaaaatgcaagtgaaattctgaatatgaaggtgagttttatttaaaaaaatctccaaaatatttggccggaaaatataatctttgccacttgttatattacattcagattgtttctgtttgtaaatcagacttgtttatttgttatgttcagttattgagctggtttgttcttgggaatatttgactctcaggaagattttcattttcaccaaacaatgcaaattggacgtcgattgcattgttaaatgtcaacatttctttgggagtctgagtgtaggggtaaacagaattttaaaacagaagttgttaattacttgcttgggaaagtttaaatacagaaaatgttggtgaagtcagatttcattgcacatattccattcattcagcaaaaggaaaaatgaggattcacatggattttattacccagttgtggatgctgaaaaatattgaaaggttgacattggtctaatctttttaatgtaaaatacatatttcttttcttttgaagaattccaacaaaactgattaagaaacatgcacatttgattaatttgaaccttctagtcttctgcttccacccatcattcttcccctgtatctattatcaccttcctttatttagcaaacaaaattttgaaatcctttgtaaagagtactataatgttaccataattcctattttcacacaattgtctttttaacatctttactgagatatacaattcacatactgtaaactttgctcatttaaagtgtataaggcagtgacttttactatattcacagaatcatgcaaccatcactaagatttaagtttagaatgtttcatcacccaacaaataaactctacccaatagcagtcactccccatcccccactccctcagcactatgcaaacaccaacttactttctgtctctgtggatttacctattctagacattttatataactaaagtcatacaatatgtggtcttttgtggtttgtgtcttctagttaccacatttttgagtttcatccatgttgtagcatgcattagtacttcacatgttttattgaataacattccattgtatggataaaagcacattatgtttgcccattaatcagttgatggacatttgggtggtttccactttttggctgttacgcataatgctgctatgaacatcggtgtacaaattttttgttggaatacctgtttttgtgtcttggatatatatgtagaagagttacatgattgttctgtatttaacaatttgaggaacgtgagacttttccaagttggcttcactattttacattcccaccaacaatgtatgagtattgttctgattttcccaatttctggccagtgcttgttgttatttacacttttgattacagccattctgatggctataaagtggttcctcattgtagttgtgatttacatttctctgatggctaaatatgttgagcatctttttatgt
